United States Patent 8,216,786 (GENETIC POLYMORPHISMS ASSOCIATED WITH CARDIOVASCULAR DISEASES, METHODS OF DETECTION AND USES THEREOF) - sequence listing, part 13

SEQ ID NO: 1309 - DNA, 1240986 bp, Homo sapiens
gataaggatttgttttattttctcataggaacggcttgtctttaggtttttttaaggttgacaacaattactttttcaagacctatattcaagtctaataaatttgaagggcttacgaagtattctttctgactttttaaaattacagaaaacatctacctgagaaattttcttttttgcattaacaaaccatatattcctgtcttttgatttaattgaacaactatttaacatagcattgtgactttataattattgctaattcccaaaggttagcactttcatattcaattgattgtgatgttaagcttatgattttatatctagggcctactctgacattctatggagaaagcaaagcaagaacaagggaggggagatgggaaataatatatgtatgttaagaattaagttagtgaaggaattttgcagatggaggtaaatttgcttcttgaactttgtttaaatcttaactttcaaattataaatgatcaggtaggacacaagcattggttaataatcacagaagttattaagtatattaattgaaagcatctgctttcgaaataatgtcaaatggtatgaatagttttctacaagatgtatgtattaagaagcactagtaaagaaggccaactccaaataaagcagtcagcttttggaagagtagctggaactgtggaagaaacaaaaaagaaattgcaaaactgttgatcctgtagacattgccagtgttacataaaagagcactgtaccttgaagacaacatattataagcctaagagtaagaaagaaggtgagattatggtgatttaaaagtgcattgagagagttgaaaaaagtagttggatatcaagacacattatttcctagaaaaaaaaatcagagtgacaggaagaaaacatagttaccatgggccttaaacaggcaaatatgttgttcaaatagggatgtattttttttccataaaagaaaacccattttaaagttaagcctctgatatatttgatttgttacatacagaaaggcttaaactaagcctctgatatgtttgatttattaaatattacacaacaccatcaataaacagaaaagttttcccttttgattcttttccatcagagaggtgtgttttgcattttaaataaataattgttgactgtatttactcctacctttatttattcaacgcaattagccagtatagtgagcgccttcctgttctaggtgttgatgaacaaaatagacataattctttgctttcatagtttacagtctaatgggagatgtatctatctaacaaatatttatgcaaatattagggttagtgttagggttagaatgcgtaatatataattatgcattgtgataaagtgcttttagaagggaaaacattatggggatgattctgaaggattatcagagagagtttttttagggaagaactgaagatttattgaataaatgactcaagagatgagaggcggtaatggggaagtgatagggctaggatttgaaggcagtgaaaggggttgagaataggtcttcacgggcaaaaagagaattcccattggaagctatgaaatgttaagacgtaattgcttaatgcttggagaacttaaagaactaaaggatcactgtaacactttggtaattaattactcatcaaatgctctaccttattttgatcccattgtagtccttccttgaacattttcacaacctaagcaataatcctgtgacccagtctaattttaaagggaggaaattgattatggatcaaatggcaaggctaatccttcctgtaggcaccaaatttgttatatgttcatggttttctgtcatgtcattggctgtggccacaggctgggcaaattgtggtttgaaaggggagatgtgagtagttgacagtactgtttgtgggacgagaactgtgtgttcttgtctcagatattgctgtgtatgtagatagcaataggggatttcacaaatggagaaaatgcttgtactttctattaaattgtctaactgacttttaaagtattaaatgccatgaatactcaggttcaacactgaaagtattagaagaaggaaggtttagttgttaaacaatgtatatatttaccatttatttacatggtatatacagtatgtaatattttatgtatttactgtatatttattttggaaattcataatacatactggaatgttaaaagtactgatattaatactgaaagaaatctcttttcttacatttttctcaatctctcccaaacatttttgaccatgaaaccctttttcattacatttattaccattttaaggaagtagtgttctttagttcacattctgagggaagccctgcattagagtcgcctggttgctagcagagctttctttgacactcctcttagaacaacatatttgcctgcttaagatccatgataactatgttttcttcctgtcactttgaatattttctagaaaatatgtgtctttatacaactacttttttttcttgaaagaatcaccacttaaaagattccacctctcaatcttggtgcactggggattaagtttccagcatatgaactttgggggagacattcacatcatagctaacacatttgctttttttttctgtgggaggtgggataggatgggatgttaagccatggcatatgttgctgtcgctcctttaattatctgtgtttgtgtgtttgtatgtatgtgtgtatatatatatatatatatatatgttatttgtgtgtgcccttgagagtggcataaagtaaactaaaaaatagaccaaacatggaaacactgttatcttaggtaagttttagttctgtgactgctgagagaatattacttgctgttttctgatggagggtctaaccagtggaaactggaaaatgaaagtaagcaattttcactaagttctctatgttcctaacagcagcaattgcttttaatattccacaaataaacattgtgaagatttccctgttattttttccacttaaaagttgtagtcaacatagatgattttctaaagaaactagatgattagaattttggctgtattataatctggggaaaaattagatgaattttccataatgactctctacattaactctttgagtaaaaaatttgtatgtaatacagtgactctagacagacactattttgtgctaatatcaaaaaagtgtgaaatttcctattgtacatttatttatatggtgcattgaaactatatgatactttagatattgctgctttgggtaacttcttcattatataggtgtttgaacatttgtcttttaagtttaaatctggaacactaatatttattctttacctaccagattaaatgcctgtgctttcaataatgaatttttaaaaatccagtctagaccatgaaggaattactgaatcttctctaaaaacctacattaggcaaggccaatgataatgttgtagttagttacaaatacatagtgaatgtatgcatctcctgggccccagcctggggcttctacccttgtttcaagaataatacgtggcaatatcttggccctggaatgatatccatttgctttactagcctactatttcatttgcctgtcgttagaaaagtggatttctggatttccatctcatgatgattatagaaaagtcacaatttgaagattccttaatttgaagctaggtgatatttacatgcccattaagttaatgagagtggagatctccatgtatttccctactatgtctttttgcctgcaaagccccctctcccttgaatcactgacattctcacaatgtaaataaatttcttgacatctttctcttgcccaatgcagtcatttgacctactaataaaaattcaattcacccaaatttctatttcattgtccttcttacatctttagtattttcttaccttattatttttaaagagtttgctagcaaaacttcagttttctttactttaaattttggttacaaaacctgtaagaagaaaatggccaagttatatcaactgctaaatactagttaaaatacaaacaacagcaaaaaagacaaatcatggactagagagctattctataagccccacaatatcaaatctgttttcagaatcaaaattacttttaaaaatactttagaatattttgtggaaaatattgatgatttaccttagtaaaagatgcacatttaatataccagaagaatcactgaaatggaactgagcaactctaacttatttatcatacaggtatgttgcatgctcatgtacatattcattacgcttcaaatgcagtaaaatggtgtcttgtgaataaagcattttaaattctattttatgcatttaaaaattttacacttatttcaaaatacaaaaaacctaatatttttcttgattttttttcttttggctattgtaaatgagcagctgactaaagagtacaaataaatattcattttgttagatagctcatgagttttcatgagaactagtttagcctgagacccaataataacttcccgtcatcttaagaaggggactataaaaattcatttcacctaatattaagcatgacactaattcagtattaaatgctaagtacattagcaattatggtacagtacgctgttactttccaagtctctgcagtaagtttttcatcattaatggtttattatttttttcttttctacgcagaacttaccatttgaaatagtataacttgaaaacagccaaactatttcaatttttacttatatccatgtaaatatatattccttatggccaaatctatccactaaacacaattataaaactagttctataggaattaataaaatagcaggcacttgaatccctgtacttaattcacagggaatcaatgtaagttccagtttctgtaaaaacaataaagcaaaaagggatccttgaattattgtctaatttatcaaagtataattaaaattctattgtctgactcatccccctttatagtccaaagacagttccggttgtgcattattattcattgcaataggatgattgctttcctaaaacatattaacacaaagtaatgtataagtgggtttgtaatgtgcctaaaataataggtattatcattacagatcttccttggttttacttttctatcagtaatgtggaaagcaaaatttgaaaatatttataaactagagaagctcagatattttgaattgaatagggtgaccaactctcctggtttgcccgagactggaagattcttagaacttttagttttaaagacaggacaatttcaagcaattttaggattagtacaatctctggcaaatgggttcaagttacttaccctgagccagaatgtaatcttgttgaaataaagacaggactgttttgtgaaaaggaactttttgaaaaccttgttgctgctctttcaggattttccaaatttgtcctcttcacctccctgacccctaagtcaagcaagttgatgttaaagacactcttctctctctggatacagaataggacagtagcaacacttataagttctgcagaaagtaatgaggggtaggggcctcagctctacatcacctagtctggatatgaagccagtctttgccattgattaggtgaatgattctgtgactccattttctctaatattaatagaatattaataatattgaacttatagggttgtatgaacaatacctatcatgcattaagaagtcaaggaagttagttaattttttgtgatcttgattatgattagcaacttagaacagaccgtcatgtctgccagtaatagctttaaaatctagattcctaggaggacttgttacttttagcaatcttctgccagaggaagcttctgtctcctgaaaggctcagctatatatttgtttgtttattttttcccattcaagatatacacatgaaatgacagaagaaaatttcaaaacttaagattcttccaggaaatacagtgtcagtggaatggataagtggataaaattagcacagttcttttgggctaattatgtttttagtgaaggatgacaaattctacagatttatttttgaatagccagtattataataaagctactttattggaatagctcattaaatgattctgagaatccattaaggaaggcatgtcagtttttattctcaattatgaggattgggtgcaagactaaagagcatgttggagttcaacaggccacagtttggtctggctaccagtagaactttgcttctattaaagttatgaaaaaggaagactgctgaaaaacaggttgtgagttgtttctggaattctagagtatgaagtcagttccttcaaaattgcattgttctaactgttagcatctaatgtcaaagcttcatctcagataggcagtggggcagggctcagatcaagccattctcctctactctatccctgaaggaatctgaggtagacacttcctaattagcagaaagtagacttgtgcctgatctttgatcttgtaatttagccaattaagtttactacatgacacttagtaaagataatttgtctgttaagacgtaattgcaggactttgatttttcacatagggtttatttccagcatttactaagtacaacgcagaagatgtttaagaaaatattggaaacactcaaaaggttgagatggaaacctggtcgctcaagatctaaacagctggtcaaaagcatcattgaaaaacatacttaaaatatttatttttactttaaaaatgaaagagaaaaggctagaatcctggattttgcatatgaaattataaagcatttaaggggaagtcaatttaaaaaaataacacagcctgagataactaaatatattctattccttgaacaccttttaaagtcaattgtaaaagtcatgtcttttcagctttttactctatttgtgtttgttataacagattcctgactctcaatatcagattcatcctggaacagattttatatcatgagatgtaaatttaaaatgaaaatgtaatgtgtatacatcctatagttgcatttagatatgccagcttaaatactgataagtatttacataatttagtgtaaaaaaactcacttttttccaaaatgcctaaatatttttggtttttttatttttggggaaagtgttttagtttttattttcctttgtacatgtagacagactttctacaaatgaggaagaaccttctctctttgtgctgctcaaaaacattaagtaaccccatttaaaccctaaataaactctaaaacatcaatgaaaaacgtatttaaaatatttgttttcactttaaaaatgaacgagatggctgggcacagtggctaatgcctataatcccagcatttttggaggccaaggcgggcagatcacgagatcaagagatcgagaacatcctggccaacatggtgaaccccgtctctactaaaaatacaaaaactagccggcgtggtggcgggtgcctgtagtcccagctactccggaggctgaggcaggagaatcacttgaatccaggaggcggaggttgcagggagctgagattgcgccactgcacttcagcctgggtgaccagagcaaaactccgtctcaaaaacaaacacacaaacaaacaaaaaaaaaacaaagagaaaatcctggaattctgaacccagcttagcagttgtctaattatgtcctctatacattgtatctggtatatttttagacataaactcatggcttcatgaaccccaataatagatctataggaaaaagtcattttgtattcaacattttcccatggaaataaagaattcccacaggttaaataagaatttggccttttgcccagaagaaggaaattttcatggaagcttttttagaatacagtgagttatacaaagtcacagtacttctgcttggtttacttttaattaaaacaacagtaattcagagctattattattttcaatatttgtaagttgctcatttcttcattgcaaaagaaaatgttttgagaatgatccattttatatatcacatttagaaataaatgcacttctgaaagtctgtgttggaaagcagaaaaatgaagtgtcttgtgtaatctgcattaagagaattactagatcataatctacataaaagaatatttaggactatatattttgtcatttagtcctctaattaaaaacaaggacactttaaatgaacaagcttgttaagataccttgacctccctccctcctttcctcccttcctctgtctctagcttaaatacaaaaagttgtgtattcaaaagcaacagtgtgcaagttattttgatactattctttgctaagtttagaattgcattgcaattcaattttattttctgtccactttgttttagtgttaaggaataaccaaatagagcattgaggattataatattgagtgcccaagaatagtaatcaaaaatctgccaataaagatgctataaaattggatgagttcgtaatgtcttaagcaaatattagggatttaggtacgtattaggcagatatttggggattctaaacatgtgttcccatgatgggagtgtaacacttggatagaaaggaagttacctaattgtgatcattttggggaatattgagtgggcagggatgagggtgggagtgggtagaggtgggggtgactgcagtatagtgtacaattcactgcagcctgcgtggtctccctcgctccttcacgattttccctcttcttcaaagtttgtgtcaggatgtcttcctggccattcaagtggaaagatacattcctaacagcttggttgtgaggaaagtaatatttttaaaggtatgattcagtttcaagatgaaatttttggagctcgggaatgatttttaacccccaccctctccccgccaaattcagcaaatggaagaagcaaggcccatccgagaactattcccaggcaccagctcaaggcggagggctcatggggaagctgagtgacctgctagggcccaaatccgtttttggcctttgccctaaaacagttccccgatgagagtttggaaggggcagaaaggaaagtaactatctggagcaggcgaagagtagcaacgcctcgggtgctaaaatcggaaaccccaccccctaccccacaaccctttcccaaaggtagtaggctgaaagggggaattcctcgcgggcgccgactcgctcgcatctcctgagaggcaagtttcttcgcaagcgttagccacctgtgtgaggcgctctgggtgggaaaggtggcgtgggagaagcgacagctcggccacaccgctcgggagctttccttagtgaggccggccgtcaaaatacctccagaactcagagctttgatgatgcagagtcccctatgcctcgtacgtcgctaggatcgtagctcaacattctccaggctggtctgctctggagtcagctgaggcctcccgagtttgcccggggtcctccctgtcccctccctcccacctccccacccccgaagtagcgctcccgcctcgctccacccgcacacccccggcgcgcctcggaggcttatcaggctccccgcacgccccgcaagcttccttgggcgcccggcgcgagggactctgagagcccagccgctgcctcggagcccccattcacgtcccctcctcccgctcccccgccaccgcgcctccgactcttctcccccgcgccgcggcgcccaccgcgtctcaggtttaatcccgggttggacctgctggtttgctctccccgctctgagcctcacagccagcccagagaagtggaatctgcactgaaactctgggtggctggagccggcggactgggcatgctcagaagccagggctggctttggtctcaagtaggaagctttggcactcgggaggcagcggcgactttggggaaagttgatcggagaggggaggaagcctcaagacgcggagcagcggcaggaaggagcccccggcagcccggaggagcatgggcaccttgcgggatttacagtacgcgctccaggagaagatcgaggagctgaggcagcgggatgctctcatcgacgagctggagctggagttggatcagaaggacgaactgatccagaagctgcagaacgagctggacaagtaccgctcggtgatccgaccagccacccagcaggcgcagaagcagagcgcgagcaccttgcagggcgagccgcgcaccaagcggcaggcgatctccgccgagcccaccgccttcgacatccaggatctcagccatgtgaccctgcccttctaccccaagagcccacagtaagcaggggtgacgcgccgggtccatgtggcgccctggcgatggggagctgcgggtctctgtattgtctgtcggcccccgcccctcccgcttgccatgtctgtcctcatcctcagaaatgtttcattttaacgggcacttcttgcggggctgtgcacgtttctcagagccagactcactgcacatacgttgccttcgtgtctttgtcagatgtcaaggtattatttttaaatatacatatacattcgtataagccacctagtgtacgtagagtttgaacacgtcccaggtgtgtgtccgaccgtgtgtgtgagtgtgagagaagaaataaaaagcccccgtctcccaaaagccctggcaaaccagcccagctggaaaatcctaaatgcaggctcatcagacttgaaatgaaatgcgtctgatcacccatactttctatgcttttgtggctctcccggatttctctacctgctggcgcttcacgctggtacccttcaaacctgacgttcttgtcatcatcaaagtgtgaaacataagcaaataggcatagaaaaaggaagaatttttgatttcctgaattggatgacatttacaatccataaatggaagactagtctgttgattttgaagaaatattttttcataacatatgagggagaagattgcttattttacttaagaaacgtgcataatgttactaatggagcatctccatctcccaagaggtggttgcttgtttccagggtcagatacagataagcacacttatcttatttaaaacgtggacccattgtttgccttactcttggcttctaatgcaaccactctggcattgttctagccttttagggaactgtgcaattctgatgttagtgggcttcataacttggatgggaaaaatttaatgaaacttgttatacaacactcaactcagagttcatatggagagtaaagcgacaggaacatgaggttaacagaatgtgggagagcacccaaaagaacggcattttaaattaatagataataacgtaattgataaaaccaaggatattgctgcttactctactactaacgaaatcacattggctggatggcacgtgttacgtaataatgcaaggtccatcgaaacccttcacttcataaatacaacaagttaatataaggagaaagtaaatatttgattatctctatttgtatttattggatgttttttggggagaatcacagcatgtaccaattactacttttgaaaacttagagttatacctatacatgttgattcccatggaacatttgctgttcatgcaggcttagtttagggaggagtttgtattctgcgagggagttggaaagagacaataaggataaacatttctgagattctgaccttaccaaattgccctaatagttcagcagacttagatctgccttagaaacctgagtgatctgaataaacttcaactttctctggtaaattaatttgcaatcctgacatgcctgactgttttagctaacgaggtacatgaccatctctcctgggccaagttttgcataatgaaaaaataactcaaagacagctctctgcatctttaaacatttcataggatctcatttttgtatccgcaggacttttgagtgacacagagcaaactctgcttttacaaaaagaccactttaataggtttcatagtgaagcatgttgaagccagctgataactccagttacacattccatcagagatttacaagattctaggcagtagggaatgagctatacaatgtgataagtttaaaagcctctttgtacatgacttgtagaatatctagattgaaaaacaaacaaacgaaaaaggtccagagtggaaaataaagctggtgtggcaaataatttacagcatcccattataataacattttatctatcattataataacattttatctatcaaacaacactgtgtgtcctgatactgatttcttactaataacttgtattttaaaggactcagctcttaaggtattgccatgatgctttgggtgactctgaagtattttattgaggaaaatgatagaatgccttccaagcttaaataattttggaaaaacatctgttcttttttcacacttacataaagaaaactagaaaaaaattggcttgagtagtagaaagtgtacctttcttagggaaaaaagaagtacattgtatgcaaaatgaataaatcttatgttgtttgaatggttgtacaaggtagctccacaaagagttaagaaaacctgccaaaccaaagaagacttgtttgcctttcaatgtatttcactatgaataatttgattacacggacttactggcaacaagtgtttgtgtctttgtatttcatctttactacatcttaaatgtagccatctttcttaaacatacatatagattattgtgagtttccagttaaaatgaaactatctaaatagacacattaatttccagtttacgttcatgctagtttttgattctcttttttttagatgtaggtaactgccccgctaatgttctgttcatttatctgatatatgcaaatatatctgtttagtttttacttactaaggttgccttctgaggattataattttttttagttctggtttcttggtaaatttggtcatttaaaaatagtataaaatgtaaattaacttaataacttgaatcattttaacatttttggcttggaatttttcctttaatgtgggaattggagggaaggttctgtcagattccagcactgagccaggacactcctgctataactatgaggtaggaggagggtttttattggtctctttcacaatctgtatagatacaatacttatgtgaaggaaagaactgatgtagcaaattggaatctgtattccactgctaccaaataactccttgagaatgtaaaactactaaactatatttggaaataaactgagcaaataaacccttaaaatgaaaaacaaaacctaagcattcattatgtgagatcagatagcctgttgattgcctatatagaatagttcttatggacttaagtaattttatttcatgaagtttcattcctgaaattgattctatatcatgttagaacattcagtctctgaaattttgatctaaaccccttatcttttgaaaatattcccaaatcttttccattttcatgtcacagggtttcagtcatttcagttggattatatagacttgagttcctaaaagtggttagtgtctttgtatttttgtaagctgttgctttcactccatgttctattttgtttcctttctttttcctttgttgttgttgttgagacagagtctcactctgtcacccaggatggagtgcagtggcacgatcttggctcactgtaacctccgcctccagggttcaagcaactctcccatcgcagcctcctgagtggctgggattacaggcacgtgccaccaatgcctggctattttttttttttttttttttttttagtagagatggggtttcgccattttggccaggctgatcttgaactcctgaactcaggttatcagcccacctgggcctccaaaagtgctgagattacagatgtgagccaccacacctggcccctgtttcactttttcattgcgaagtactttggaggagttgaggataaaaatatttatttatatttatttatttatttatttatttatttatttatttatttattgagacggagtctcgctctatcgcccaggctggagtgcagtggtgccatctcagctcactgcaagctctgcctcccgggttcacaccattctcttgcctcagcctcctgagtagctgggactacaggcgccagccaccacgcccggctaatttttttgtattttcagtagagacggggtttcacagtgttaccaggatggtcttgatctcctgacctcatgatccgcctgccttggcctcccaaaatgctgggattacaggtgtgagccaccgcacccggcctatttttatttttaaggaggcattcattttaagagattatttaatcttttaaactttatactgatatatctcaagaaaaacaaaatgttcctaaagactgtatattaaattctgttggaagttgagagaattctagaattctagtgtaatcatagatggcataatattaaaacatagatggcttgaaaggtagaaatttaattccaaaagtgccctacatctcagttcaatacttctatgggattgcctgtgacatgcaaaatattgtaaggcattagaggtaagagctacataggtcctaccatccaggagtgaacaaggggttaacaatactgcacaagtaaatattctagaaagtagatagagtaaggtaagtcacaggggagataactaagagagttggcaaaatataatcaagcctgtttggttttatggtgtcagaaactcatgtggaagtagaagggtttaaagtaagtatttgaagaagggctatgatttaggtgagtggaaatgagaggaaagagggagggatagagatagggattggggaaatacattccaagccattagcaaagtgacagcacagaaaaagaaagcagggcccctctgggaattgggagcaactagtggctgtgctaaagtactgtagtgggaactgtggaaaagcaagtttaggccagtgagaatgagaatcttggtttctatgatttgataaagtaggcgagagggcattcttttgggttttagaatagctaaggctcatttgtgtgtgtgtgtgtgtgtgtgtgttttacaccaaggactaatagttacccactaatgcagttctgaatgccagaatatcagttcagctttcttacccccaccatcacagtcctgttaatagtcgtaactatataactaggtaagagtagttaattgaagcaaacagcagatgattagaagtcttaaagaaaccaagttccaagttcctttttccactcacttccaaatgttctcattgaaagtaatctaacttgatgccacagactagcactgcagattcctcacatacctaggcaaactgaacatcaatgagaattgaacctgaagttgtttttcgaaagtcatctttcttgtttttgtggaggagttaaattccaacctaatgttattctaatagagtttctaatttaaggttgattgttaatttgacattacagtttatgcagtagaaatgaagtcccgggagcatttataaaaatgtatgagaccagcgtgctaaaaccctattagggtattttgaagcacagtcaagttgcatgcccccaaaatgggtcttataatgaagatactggtaagctcttaaatagaatggctctactacctgcctgagaatataaattaccagcttccttgctctactgggtcacatttccaagctcctgctacttgttatctggattcctaatgggaaagggtagaagaacacagatgatgtttctattgttgctgtttgcaggttataaggcatatggacacatttttttttctgtctgcctagcaatggagggtctccatggtatcctagcaaccatattcgaacaccaggctgctgctctttctgccatctctaccataggtgctgcagcccatcccaagaaactgggtctgttgctagcattccagatcctctgacttgaacctttcaagctcagagaacgcaagacaatgtgataaataagcacatgctgaaagcagcatttaccagtatgctcaacaacttattatgcaatcacatccttggcattttgtatcctaatctgaattgttgagctggtactgtttgccaccccttccccgacagcccttgtctgcttcctcacactcagttctgacaccggttctgcttccctctcaccatcttctgtaacgactgtgttcctcagcacttccttaaaatttattttctgagaagttcagtatgtgcaacctgtttgaactctctaaggataattttgtttgtaagagcagaggaattttctccctccaaaactgtcctgtaaatataaacaatagcacaaaaacttcagctacacaaaacagatgtttaacacaatgtggaactaatagtacactctcaaaactgtcttatttctgaatgaattttataagcatactactctccagcttttttcattgcttataaaattcatataagcattccttctggaggctctaggggagactccatatcttgtctttttcagcttctagaggctgcctatattttaagcgtgaaatttataagcaatgaaaaaagctggagagtagagtgagaagaagaaatgcatatcgagggaacaagaaagggcgaaacgagatgggtattggtaaaactatgccatatttgcaaggaagttggaaaatagtgataggctttgtgtgcaagtaaataggtgacaagactggaaaagagcttgcaagtaagatagtactttatggatgaagactgccatagagaagagacacccaaattagagtatatcgaaggcttgccttcttagggagctatactgaagatagtttcccattagaccagtgcttgttttgaatgcattgtattgtccctttgaaatgctccttaatttgacatcattgaggacttggtggtgtttgtgcagccaacagtgcagaggacaagaataagggcaacaactcagtgcatcctgcttctgaatgaaagcatcaagaattacactgctcatcatcatcagattgggtaacatttatggagcactaactctgtgccaggcactgctcctgtgctttatatagattgtctctttcattgattgaatgattgattgattgattgagacaggttctttctgtcttattgcccaggctggagtgcagtgacacagccatagctcactgcagcttcaaactcctgggctcaagtgatcctcttgcctcagcctccagagtagccaagattataggcacatagcaccacacctggataatttttaatttttttctgtagagacagggtctcagttgcacaggctggtcttgaacttctggcctcaaatgattctccagcatctgggcctccaaagaaagtgctgggaatacatatgtaagccaccgcaccccacctgatcatcttttttttaggacaaaaacaaccctatgaggaagattctggattatcccaatttcacagcatgagaaaaagaactctggggcgcagagaagtgaagcaacttgcccacagtcacactaggttgagcctgaatttgagctccagagcttttctccttagccactaggctctcttactgcccaaagggtcatggggattaggtagctgcaggaaaactttatgaataacatataggtcattctctggggtgtatctgttcaccaataattaaataggaagcagaaggactctgggactagtggaagaaataatgtaggacggcggttcccaaactttcctgcgcattagaatcacatggggaacataaaaatccaattcctagattgtaccacaaaccaattaaaatcagaatgtccgggtgttggaagctacatatcagtaatttttgatgattctccatgtaactttaacgtgtagcaaaatttgataaccactctaataggaagatgacaagaggagtgtgtgtgtttgttgtgtgtgtacatttgtgtgtgatattaaacaaaagaccaggataaagtgttcatctaaagagttgaatgtctctattggctaaaacctttaagcactaggggcctgcgaaagcatagctggatttttttttttgccaaattgtacgtgtagacaaattgtacgtgtagtttagttgatgccttcttgtttattctcctaaacaagtgatcatttccctacctagcccattggttctcaaacatagctgtatgttacaatcacctagggagctttaaaacatacatttgctgggcaccacctccagagcctatgatttaattgctctggggtagacctgaggtataggtatattatttttactcccaaagtgattataatattcagccagggttgagaaacctctgctatgacccattcattgttgattgttacagactacttgaattcctattctttggggaagcacctttcttgtttctttttgagcaacccaagtccctggcttgcagtggagccaggcagcttcagctccccaatctccctagcatctgaacctatcagcatcactttaatctctggggttacctgttaaggacctggggcacacaaaagtggcagcagctctgttcagtgggtaagtttgtttcccctttcctgccagccagggttcctggccactttcaaatgtgacacacattaggatcagctttcatcccaagttttttgtttgtttgttttgtttttaaattcttgctgagggcagctgcctctgtggccagatagtttctttgggtcccagctcctgctatccaatgctaagttgaaggtgaaacaatgatgagcgcctcttggaagagcagtcctgggcttgtagcgtctctcttggtatgtgatgtctctgcagccagctacagttttttttttttttcctacagatattttatccttttaaggcaaacagcgtgagctcaggctgaggagtactttccgaggagacttcagagaaagcagaactagcacatcaacctttcagccccctttccaggaggcttggtttaagtggacagatctgggcattgctggcagttgagaggtcggagacgacacctgcaataaaagatcttggtgtgtccctcatgaagacttccaggggaaatgagaattcctaaaccctgtggtcagacctcactgctgcccctattgccagctctgtgtgtctttcctgccctctgtccccttagatccttgttacaaagtcctcaaggtgttgctaatggtctctgctaggagcctatttacatttgtaatttaatcattaccttctcaggtgaggatcagccaatatagcactttatataagcaatgaaaatagctaatataattgcaaatactttttgataaaaataatcttagaatcggagtcagcaaggagcttttctgtcttttccccactcctaaaatatgaaaatgtattcagctgacagatagtatgttaaaacagaatagatgtaataaggctacccggaggattggggacattaattatgcagggaagttaatcataagtaaagtaaacactttcattatgaatccagcttcatggagtgcatttggttattgcgcgtaattggggagggataagaggaattagaaacaatgaaaaacatgaccaaaaacatgtgtttaattattatgacttagcagttagaagcagaatgataggcagaagttggtggtaggacactgggaaaatatctgtgtctttgcattcttttattccaacctatgaaaggatgggagttcatataaaaagaagaaattagtgacaatttactaccaagatatactactttcacctgcatcaaaaataaaataatgttaattacttttgcctttctaaagatcataaatgtaaattaaacttcagatttgctttaagatagatgtaatttaattcacttctacatagaggtggagagaaaataatgtaagctatttacttatgctttggctgggcataaaacatgagtaaataccttacattatttttatgtgattataatatgcatcaaaaaacagatctaatgttattgaccttctaatatttagtgtcattttctcacttttagaccctacctactgttaagaagtaacattgtacttctttgaacatgaggtaattatagtatcatccagtcagtttaatttggttaattggattgaatgtcaatgatgacaaatacactctagttaagcagaatacttggactattttcagaaacaattgtattatggtaatatcaagctttcaccagatcttggccaaggaataaggagataatgtgaggaaaaaacatatcttctggatatactgtacatcatcttaatggtccagttttatcagtaaattatggttttgacaatgcttctaagtttggactgaaaagaaagaagaaaatatggccaggacaaaaaagaaaaatgcaaaatctaagttttgctcctctggagtaattgctacagatggaaaatagggtgggttggtcataagctaccatgcctacaggtggctggcaaacatgctgtaaaaggaagcacagctccacacttgtatcttcctaatacctacgttacctaattcactggtgactaagtaacacgttttgtattaaagcgagtaagagaagatagccttagattagatttgtgctggtttgacagagtgtcaccatatccttcacagagaaatattaaacatctgaaagtgacaggtaccattttgctaagcctgtgttgacaactcattatgtcagtgggaagagagaaataagaaaatatgcactggaatgaaccctagagtgtacactgcatgcactgttgagtacagaacttcatgtgaatcatagtcttcattctcggtaattgctactcttttatttttgaacttttggagggtaccaaagcttagaaaagtacgcccaaagacacttagaaaagtaagagtagtgttttttttttggctgggagatcgattcagtgagttcctctctgagcaaatggattttacttaatgtaacttttttttcagttctgaatgttagaggaaaatctttttaccccgtagtgtatggtacagtgcaaaatgaaagaattgctcgaagtttgtagttattcatttaatacctagctttataaaaatgtaatgtgaactccatcatacacttgtatgagcagtgtttcttgttatagatctgaaaagctttagaaataatgtgaaagaaagaatgctataacttttaaaaagaattttatccttggtcaggaaaaagtcatttttctcttcttcaaaattttacttcgattctttgttcttcatcaaaggaaaatatgacatgaaaaattgtgacttgcctgattctgctttccagatgttttaccattacttagtatggaaacctatattctcttgttggaaaaaaaggaactaagcgagaactaagtgattccctgtttatgtagcactgaatggcatacaaataagtagatgttactttgaaactgtcctcatggaaagcaatggcaaataaataaaataagctcactgtgaatgagttatcttttttaacttcttgacaccttttacatacttcatgaatttatctaggctttgcctttccgttggtttgctgaaggcattaacatatttattttcccttccttttggcttttggtgggaaatgctcagcttaataaaagtgttttctttctgatagataacagctaaaagggtgtagcccatgtcctttccaataacaataattagagaaagaacttccagaaatagagaatttaggcacttagaagcattatggatatgtgtgtttgggtgtttgcttacatgtttttaaataattataataacttttttccaaaaattctgatatttgaagagtatccattaaaattcatattctattcattatataaccacgatagtttaagcaactcacccccttagaaaatggagaacagaagaaccaatattgaaatattttggtgaatataccaaatttggtgtgcagacaggtgtatcaagttgaacaaacagattactagctcctttatcctgaagtgtaaaagcaaaaacactgatcatcaaagaggaggatactcttctcgagtgaccctttctcatctgaggttcgtcttatcttttggtgcagtcactgaagtcctgtgctatgtaagtcatctatcgtaatagagcagtgctccatcttctggattcctaagggttactgtcagggtgatggatggaaaatggctcaagtatacatttatttttcttggcaagagtgagattctctgcaagatggtcttagaggttattaaagaatatctcagaaaacccttgctagtgagtttttaaatcgtctctgacagcttttccctctctttcttgactcctgttaatagatttcaacacttctttttgtagatcaatccattgctttatcatcatgaaaggaagaatataatattaacaacttctcttgctcaaattaggctcacttttttttcttcattttttttctggacctagaaacaatttcctctccaaagaaatctttgataaagtgaaagtagtaattgttactttttagccttgtctttaatggtcaattattgatgatgatgatgatgatgatgatgatgataatgatgataattactaaaaatatttgtccaactgtataccatatatgtgatctcatttaattctcacagcaatctgataaagtagctactgttatcatcccagtttttcatatggagaaaatgaggcacagaggaattagacaacttgcccaaaacaaaacaatggcctgaagtgctgcaatgcagggttatgtaagcccagagctcatgctcactctctatatgctctgttgtttagctatttgtttcatcaactcatttttagcagaagtctcttgtgcagttttgtttcttttatatagagagctctttggtaatttttaatatactgtatacccatactcatgatggtcatgggtgcattctcttttagagactagcgtgccttagtataatgatagttctttcaataatactgtattgctactatattcaattttggtttgctgttttgttttgttttgagacatggtctcactctagtgaccaggatagtgtgcagtggtgcgatcttggttcactgcaacctccgcctcccgggatcaagcggtcctcctgcctcagcctcccaagtagctggaattacaggtgcatggcactacatctggctaatttttgtagtttttgtagagacaaggtcttactgtgttacttaggctggtcttgaacccctgagctcaaacgatccaccagccttggcctccaaaagtgctaggattacaggggtgagccactgtatccaacctctatattcaaatttttattaaacacaactacatatacctaaagcatttctagctgattcatacatagaaagttttcctcatcttgtacttgagtattttgtttgtttttagtttaaaatttttaagtagcttcggcttgttcctcttgaatcaaatttccattttgaagaaacattacctcaattttccaatggtttacttcctcactgatttccctcttttcccttaaatattaatgtctttaatagaaatttttggaaagtttatcaatgctttctgattctttattctggcagttaataaaaatttctatggattggttttcagttttttttttttttttggttcaatcatttaccaaatatttgttaaggaactaatatagggtaagactatagtatatgtgtcttcttctcgctcacatagcatttaatatctgaaaatcagtggttgtaggttatatgctaaaaaagacactcctttgtttcttccaacatggattggacccagcattcctaggttgggattgggcttccatttctcagtgtttgggtttgtggtgccgtgtacattttttccatatccatcagagtttgaatttctatgttttgactgttattggttaacaactacttcccccagaaaatagtaagttacatgaaaacaaagtcaatttctctgttgctccatgttacatccttggagcccagaaatggatggcacacagtagatatttaatatgattttttttttttttttttgtcaaatgaaggacaagataaaacctcttcatgtttctggcccttagatacttcagtttttaatttacagtttaaacattggaaacctatgtcactgagctcagtggaatttccaagcatgtttggtattgcatttggatgctttggcatgcctttgtggattgcctgtgctccaaatggtcatgataatccctatcactccatactctcttcaactagcccataccccttgtttatgttattggcctgccctctgaaggcatttccatttttcagattgggattacagtcatgaaaagttctttctagtttgaataatctgtgatttgtaatgcctttccaaggaagcacagttgttctccaactctaataaatgtgtaatcccaaactctgcaacataaaatctcataaattggttaatcttaaaaataagatagactgattgctaataaatacaagcatgggattagtggaaatagaagataatcttttcaaattcttactaattttattttgcagacacagccagaacacgtactaagaaaatcctttcaaatttagatataatttttactctccaaaaattcttgaagatcttaaaattatgagttggtagagaccattaatcacataaggaaatactttttaactaggtgcttgcctcaacattaatcaaaataaacacaggaaaaatgtgaaggtggaatttgcttgtatattgtctcttagctcttcaggatggaaactgagaacacctaatcctataaaaaacttttcacctcatctagtcatatgcttatgtgagtatctgaagttatttttctaggtgacctatttaccaatgcaactatagattttgcaacatattcattggctagaaaaataaatatgtgtatgatttcatttatgcctcacaatacctgagcaaataatggaggacagatcatcactgttgtacagatgagaaaattaattatcaaagagttaaggtaatataacctaaatccaatagttcttaaatgataccactgtaaacccagtaggtcatcacacttagctcaacccattcttcacactctgtgggcattcatgtactcatgagattaccttgagaagccactgactcctgtgattcagcaatgcatttatggaaattacagtaggtaagctcagaacatggcatatacaatggataggagaatgggttctaatttaattgctactttagcactaactaggtgtgtaatattgaatctaatcttccatgttctcactataaatgaggattataacatttccctgattggagataatgcttgagaatccccagcccagtgctcaaaacatagtatggggctcaataaacagttgctgttgaggttctcattactatcataatttttattagttttgttaaaccattttccattgataaagtgctgtgtacatgtctaaaccaaatggaagaacatgagatggaaagaagttcagtaatgacaaggtcctggagtagagcccaacacaacccagcttggctttactgagtatgactcagaggaagattgagtgacagaaaggatcctacacaatttctgtgtgggataactgtgggcaagaagggttgaacataggcaagtgtgaagttccataataatgttatttattttattcaatgagcagttacaggcctaccaaaaatttaagaatggattgatgaagtttatactgagcactatgtatttaaaccatgttaaaaaaatcatgaaaataattgtattatgccaaggtaaagctgtttatgctctaaaagacaggaagtgttagtatttagtggttattctgtgcagatacatgtatgtgaaattgtaataatattgttcgtaacatttattttaacatttgcagccactatatatgtagactatggcattgctgctctggttgaaggttttaaagacccactgctttaatgatttgatttaaatccatcaaaagtgtttaaagaaaagtggcttctctgtttgttgaaatgtttgcatagaagtcattcactagtaatggatttctatttgaaaaccattcattcccaacttgaatgttttctgtccagaccaagaagctatcagacgtagaacataatcttagcttataaatgctttctgttaatgaccttgatactgtatctcaagatgtcttttcaaaaacaatatgattgtggataaaagcaatgataacagtcctgcttgcctgtagaggaatacattaatggtcttggacaaattcttgacagtcataatgatgagctgataatggaatgctttagaataaaaataaaaatactagtttattttgagatgtgtcatgtaatacaagaaagattatttttaacagctttatggaagtataatttatataccataaaacttacctattatacatgtaaaatacaaggtttttcactacatttatagacttgtacgaccatcaccacaatccagttttggaacatttcaattaccccctaaatttcctggaacccaattgcagtcagtccctgctctactcccaggacctggcaaccactaatctgctttctgtatttataaattttccttttctatacctttcatataaataagcattttattttacaaatatcaatttacttgaatgactatgtgacacaatttatggcttattcaatgaagtttagaatgctaaggttgtatttggacccagggcatttgttgttatattggacactaaatctcattactgtgagaaaagctcaattggcctggtttttgttgttgtttttggagaattgaagcatttagttttgtgcctagatctggtatattagtgtattaatgatctgattagcagtaacaacagcagtagtagcaggttgccatttatagaatacttacggtgtgcaggcattctactgaggattaatataccttttccctctaatcttcataaaagttctgaaatatagggaataattgctccattttagggacagcaaaagtaaagcaagctcagagaagttaagtaatttgcctgagatcacctgttgctgcctgtgcctatactaagaatgattaatcttgaggtactctggtaagcaaactgtatggcttctgcttttctacagctttacagttctattttcttcagcactaagatatatccttgaaataaccttccaacttggctttttggctccctgtgcaaattctgccatgaagtgttaaaagaacagagtcaacaggttaaagataagcactgatccctgaggtgaatatagaattgatcagagagctgtttgtgaaatgagagaggcaaagggagagaagagatttgattgatgaaataaaggaatggacaagcatacatgagaaaaatgtaatacaaaataactttacgggcttagagagaaagggagaaatttcagttctttagatgtgcctgaagtgatgatttcgtgaagaaagtggagggtttcaattaaacctctcttttgaatagaaatgattttaaaggaagaattctaatgggttcttgtgccactgaggctgaaagcagatgaagaagacgaaatggtctctaaagtaggtggtcccaaccccagtgggacataactgatttaggtggctgaagctaactccactttgtctcactaaggatcctggcttgctaactggctggctgtgttccccagaagcctttgctctgatgcctatcagtcctgcctggtgcaaaggcttctgggttatgagccaactggggatgctgccaaatctgttgcttattcagcagtgaaatgaggtagcactgttagcttgctttcttattgtgcgggtaccagaaatgaagtttcagtgtgagagaataaagaatagtcttactttgaggattcactggagactgataaaggaatttcagagacaataaactgttccatgtgtttacagtaagttggagatttaagattcagttacagatttttatatttaaataagtaatagtgaacaaaagtgagcaatgtttgtggatgggaaccagcttggataaataactaggtataaagcaattaggaattcaaaatattagagatatacctatgtatacacataaacaaaggatttagaggattttataaaaacgcatgtgatgcaacaggattttcaaaacacactacgaatcgttgtgcaggttgatactgtttccttgtgttttgtttgtttgcagaatccagaatggtgagcaaaacctaaaagatatagagaccctgcggttctcaaagtgtgagccctggacaaacagcttcagcgtcacctgggagcttgttagaaatgcagattctgagatatctctccaaactctttgaatcagaaactctgggctagggctagcaatctgtattttaaccacccatctaggtgattctgacgtgccttaaaagtagagaacccctggaataatataggatgggaatttagagctgaatgtggcagactgtacataaacactattggaagcagtttatcctggtgcccaaaataatggagcagagatttttagttaggagctgtctctccttgcactttgctagtacttggcttgttcccctccttttcaaggctgatctgcctttcacttccaggagaacttttctgcccataccagtctgaaatgctttgttttatggtatactataggtttgcatttctttaggtctaatattcttttggtttttaatgtcaactcttgtttttttaattattacttcataattttttttcacattttgtgagggtgtacattatatatatgtatgtatgtgtgtatatatatattttatatgtatactatatataaatacatgtgtgtgtgtattttatatatatatttatatgtatatatacatatatacatatacatatatatgtattttatatatatatatacacacacacacacacacacacacacacacacacgccatgcactcaggtactactacctcccttctctgaacaagtcacttttatcccatacattctttattgcattatcttaccttggtttcttgagagcacttaattacctgaaagtatatatttatttgtttccttgtggttgtttgtccatgtaagctcacctttgttgatccaggccccaggctttagaccccagaatggtgcttggcacagtagatgtgcagtgaacaatgagtgctgtttgtctatccggatctaggctctaaactactaggggacagaacttgtgtcacaaccttaaattagaaatacatatgtaaagagactagcatagtatctagggcatagaaaacacttatgcagtgttttttataaatatatatatgtatatatatttcccttttattcttcttgtagcactcagcttctaacagttctttgcactcagtctgtacgtgaagatagatgaacataacaattgagacagagtattaaatcttaataattaggaaacaaaatggaatatatcagtattttctgtgttttcattctgtatggattacttattgaatgggtcgtgtttggttttgagctatgaatataagaaattctaaaaattaaaatacatgctaaacaattaaaatctgtaacataaatgcataattcttacctgaaacctttggatcccagtgtgctttagaatccagatttttttttttctttcaggtttttgaatggtatcatgaaagatacatgtagaatggattctgtaacatccactgggggtctagggcagcgctccataaaaaaacgtatctacatttcttcagcaaaacatatggatatttactgaaataggaaacacaaaagctgccgaaacccttgtggccaaattaggttgggttttgtgaccaagtgagttttctgcaaacgtacaaagctttggtgtttagagttttgattttggctttatgtgtaagggtttatagaccttacagtttataagcaaaactaacatttatatttcagactgtttttcatcttcagaagctatattagtccacaattagcatttgagtcacttgaagcttagggaaattaaataacttgatcaaagtcacagcgtagtatacaaataaaagctgaatttgaactcgggtctggctgaatccacattccttactcttttccctgcagagcactgatccttaaaatcacacattacagataagaaaggctataaaagttgcaaaatgtacccccttcattatacaattaatgacaaagacgtctggagggtttatgatctatagtaacatcactgctaagaggcacattcagaatccaggtctcttaatatctagttctgtactctctcattttccatgctgacttttagtttcgggatgcttctaaattattggcctcagaaatcatggttgttgcagaggtaaaggcagttttcttctagtttttctcttctatatgagctcccaaaatgttttggtcaaacggtttggctctccgtgtttttgtaatcaaatacctaaacgctggtaatgcacacttaactcaggttcaagcgggggactttatttacttgggcacagctagagtgtattgtaattccctgtttccttagttgccttgaagagtaaagtaagcaatttcatttaaaattaatagccccaatcttatttttgccttattcacttaggaaaaccttatagttaacagcaattgcagttattttcagcactatttcaagggaattctttgatagcagccagaccgcgtgcccagctttgctgcttttagacaaactcaagtattggcgcagtgtgatactcagtactggggaactgcattctgagtcaaagcaaattagtttgctgtctgcttgaggactttacagatttacacaccttcccaatgagatttgtaagaataaatttttgtaaatcaagggtttgaagactcctagtgaaattcacatttaaggtagaaatagtattcttcattttattgaagtcatatgattcaggaaaaataaattgaggacttttggcaggctaaaaggatctggaaaactttagatgtattgtttttacctcttgtttcagagatagaaatgtaacatttttaattatgagcttttgtgttttgtttgtgcttgaatttatgtgttatatgctcccatcaaagttgtgtgtgtgtgatattattacataagaattagaaatatgcaattctttttatttaataaatttagtagtgtttctttttttaaatggtagataaaatgaaggcacagcagctcaagagggatagaattggaaggaaagggaaagaggagggaggtgaaagaaggaaagatagggctttgaaaccgatccaggactctgtgtaatgagctcttggttccttatcccacatttgtctggccattgaaggtagaaattaacccttatgttgcatttgtccatgaactaaagactgagcctgtgtttagacacttaataatttttaggtcagtagcccagttggcactcctactagcctcatggttgcaaaaactggatagttagtagaccatggtgttttcttgtatgggctctggagtcagagaaacctgaattcaaattcgagttttgacagtacttgtgccctttacctctctacaccttggatttctcatctataaaatgggaggcagcatagtataccgggtaagagcatggtctctggaagtacacctcccagttggactctcaggcctgccaatttaatgctgtgttactttaggtaagttgtttaacaactctgtgccttaggtcctccatctataaaacagagataataatagtgtcccagatttctgttaggagaattacacaagattatatgtgtaaagctcttagaaccctgcctcagcagttgctaggcctcctcatcattccgctagcccagtgactttcaactgggaaagactgcttcccaagggcatttgcaatgttctggaggtatgttgcttgtcacaactgagaagagggtagatgccagggatgctgctatgtatcctacaatgcacaggacagttttcataacaaagaattatctgtcctaaaatgtcaatagtgcattagccagtttggaaatctagttccctctaccccaggttccataactgtccctctggtacctacagtggggtcttccccaaatgttaggtctcagcctagcagtctgttccctggtatcttttctggttgactcagatcctgccatgggtgcatataatgctggttggccatctcagtgatgactttcctggggtaggggtccatataggaggaaaacatgcaggctgcaacctgaggttttttattttttatttttattgacagagtcttactgttgtcagctggggctggaatgatgcagtagcatgatctcagctcactgcaacttccgccccctgggttcaagttattctcctgtctcagcctccccagtagctgggattacaggtgcctgccaccacacctggctaatgtttgtctttgtagtagagacggggttttgccatgttgccaaggttggtctgaaactcctgggctcaagcaattcacccaccttggcttcccgaagtgcttgggattataggtgtcagtcaccacactctgccttttttttgcatcttagtgctggtattagagcatttgtggccatctaacagactgattagcagccccacttgctgttactcccatcttcttatctcctttccgtagggtttttctctttgtccaaagttccaaaagcacttccaacaaggattgcagtgcccgccctccttcagagcagctcatctcccaggaatttttaatgcagattaccctcctgatagacatagaacttcagttgaattttacactcaaccttctggatggcccgcaggcaggaatggacagaggccattttcttcttcccgagagatttttatctctcaactttcaatgctttaactcttttttggatcctggcatgattcttgagaaatgataggtcttgggctagcttttctggatctcctccacccccagttaactggaaaaaaactagccttcttttcgtgggaagtatcacggaaagatcatgggtttttgggtcctctgacttgtgttgaagttctcactatgccccttagctcctatgtgagcatgaatggattatcattaatttctcttttattagtttctttttttccctaaaatatcactaataatacatgtctgagagattgttaggagagatagtatgcatagtgtttatgagcatggcccttgacatgcagctgcgtttgaattcaggctttaccactttctagttgtaagttcctggacaaggtacttctctgtgcctcagtctcatcttcacatctatcaaatatgtatagtactgctatcaaagcatagttgtgaggattaaattgggaactatatgagagtcttgttatttacctattccttcacctttcccgtgtcccagaggtcctgaattggagagagtgtggattgggttgtgagtaacagaacaggccaagactaatgcaggtggagcaaggtggactgcaatggagcaaagtgaattggtagagatattcctcttaaggacaggtcactgaatatggcggaaggatgaaagagagaaaatgtgggcctgtgttagccttttttcagaagcaatgatgctttggtaaaagaaggtataaatatatgcttaaacaaagtacataacttttgacatggtctaacaggggaacaaattaaccaacagacccttaaactctcaactttttgaaattgtcaagctgtccatgaaggactctttacaagttttaaaggacacctgtatgtcacgcacatcctcttggtttccttttaaaatccccacatgccattccccactttaaatccacttttgcttccaatagcctgcattggccactcttctttagcgaactttccctgggtaactgatggtttttcagacatcaagaaaaactggaagcatttaggagattccacccaccccagagcaaaccttgcagtttctcacatatgagagcacaaaagcctagctcccttgcctcagagagttgtaatttttcctccagcgttccttgctgcactctgtgaaacacagtctatagaacattgcctgaagttgcactttgcttggcttctttttctggggaacactcccttaataaattcttgcatgtgaacccttgtctcaggatctgtttctggggactttaatctaaaggagcccttctctgaggctcgctttgtatagtagcctcataccaacatgaatcctcattcctaaggaagaacaccctggagtgaggggcagagatgggggaagaattgaagaagttatttttacactttatacagtaagacaaagcacccattttataatttgacatggctgtaggtggttgtattaaattgttttttccttagataccagcattcaagacacacacacacacacacacacacacactcactcactcacgtgcttttcattttaataactagcattgcaacaatggatgattttctctagtttaaagaggtgtttgtgggctctcttgggaatctaactaggatttatgttccttatcctctgggaaaatgtgttcctaacttgaaatacttgacctgagggaaatggtttagtaatgtagtagagatagatgacctatattgaggtattttttttaacccaggactctgtggaataaagttaatgaggaaaacattcttgtgcccaccctgagccaggtactctgctagatattgctaataaagagaccatcattagaatatgttcttctccctggaaatgtgtaggatgtcctctttgtctctgcgtaataagattttttgatcatacactttgctgtgagtataattttagtcattgtgtttggctcatcatgagcccgtttaataagaaaacttcgtgccttcagtttgtgtttatttttatttttatttttttgagacaagatcttgttctgtcacttaggctggcgtgcagtggcacaatcatagctcagcagcctcaaactcctggggtcaagccatcctcctgtctcagcctcccgagtatctgggattctaggtatgcactaccacacctggctaatttttattatttttgtagagactggatctcactgtgttgcccaggttggtcctgaacccctggcattaagtagtcctcctgcctcggcctcccaaagtgctgtgattacagaaatgagccatcatacctggtctagttttgtgtgtatgttttaaattacttaacatattctattggataagaaaatagggaggccttaggaaggtgaaaataggaaatgtcaactgtaatcttgaaatggatgctgtagacttttgaaatttataagggagtattcttgaaaatttaaaatgtctaatgtttagaatgtggcaatgacttaagaaaccacactcagccactcaaaagtatgttccatgagatatccatttcctgattcattcactgccgaattgcctgcatttttcagtccaaattctacaatgtctccaatatgtaacacaatgaagtacaaatatctccttggttgatagaatatcaaaattgctgcaactgttacagctgtgactgccaataagcatagcccatagcccttatttttaatatatctatcttatcaaataaatatgttccttaaaataaccaggcttcactaaagacttacaggtaagaagcctttcaaacctttggtattaggacccaagtaactgatggaggaagtggtgatagagttgttacctgtattttgaaaggcaagacaggaatgtagactcttaaaggaagatggagaaaataactaacaattctaaagacttatgaatcttgcaagcaagaagaactatactctggggagattagcccaatgctgaggcattgcttaaacagattcctgggctgtgaaaaaagggtgattctgagtctatttactcttctttctatgcctcttgtcacgaatgcaaagtggttttgaaccaacatgaggatgaagaagttttcaccaagggagtctcttctggcttggttctcatccctctcgctaggcactaaggaaagttggaaattttttttcctgttactgaatatttgtgtttctaccccacacgagaattcataggttgtagccttaatcctcgaacctctcctatgactttatttggagataggacctataaggagattattaaggttaaatgacatcataaaggtgaggccctgatatgatagaattagtgtccttatcatagaaagacaccagagaggtctcttgctctttctctttccttaccatgtacggacacaacaggaagatgcccatctacaagcccaggagagaggcttcaccagaaacccaattggctggcaccttgatcttggacttcccaatgtccagaactgtgagaaatacatctctgttgtttaagccagtcggtgtgtggcatttgttatggcagcccaagaagacactaatacaggtgccaaaatcagactccagattacttgtctcatgttttgagaactttgtattctcctttgagaagctaaaatcctatcattttagtatatgacatgatttctagttagcaatggaagattaaacagatgcacatatttccactccttccccaaacatccatgaaataatgagtattttttataaaaatgctcaattctataaggataaaaaccaaacagagttggagatcatagtgagaacatgttggaagctgaaaaggatggaagagagagaaacttctgattatcagaccaaataaaactaaaatgctgagaagcgattggatttttgttgttcaacttcagaaaacataaggactggagtcaccagttacccctgggcctggggtaaaattgaggctaaaaatagatgaattgattaaaatgtgtttaagaattagtaagacctcagatcccctccctggctttgagaaactgggcatctgcccagtggcgtgctggcaaatacttaacaactaggtctcaaaatagttgtgatttgtggtatttgccaatttctgtggagtaaataccaccatcatggccaatgtcaagctactgcatgacatcactgaatgcagagttgggaagagatgtgagtagcacacctcgtgtagtagaaatacaatatgcaagtgacctcaaaagcataaaacatagtataataactagtaagtgatgaatttctttgtgtttattacctttgttttaatataaatttatttaactgcatatttgtataatttacttttaaataatgacagtgtttaacaatcagcatgacaacttccaaaaatttaacaacctgctcttgtgagctggaggacaaattgactcctataaactaccacagtagtttcttctccattctggcaagactggatatttattactgtaagtttaaaataaagggtctctggagttggaaaaaaaaaacaggcagaattaaaggcagagtctttcaacctaaaaagttagaatgaaatggaagttcataagtgaatttagaaatttcctagttcttatttcccattcggctcctgttacactggaagccagacacattccctcttggtaagagactggaagcatcttttctgggaaaattgacccactgaaagagtggacaaactctaaaggttttgacattgagagtccacaaggaaacacactaggtagatcagtctgttgcaaggaccatagttaacaagccccatctatgtgaacagggcttcaaatcagcacttttagtgatgcaaacgtaagcatctttcagggttcacaaagtattttggtgaagcaaataatgtaaaagagaaacacacacacatacacacacacagagacagaaaattgctacttggaggagacaaagtatgcatggagaggaaactttttaaagcaatcatctaccataaataacttcagacagataagagaaaatagtatatgaatggaacaagaagaggatactggtaagagagaaagaaaaactggcagagcacaaaaccagctcttggaaatgaaatgaaaaatattatagcagagtgaaaaactcaattaagatatggaattgagaaaatcttctagaacattgaacaaatggctaaatattcaaaagtaaaaaaaaaatagttagaaaatgagagtgttcatccaagatattcaatagaaaaagagaagatccatagaagggggtcattaaagaaaaatccaagaaaacttcccagaattgaaggacaatgtttccaaattataaaggcccagtaagggcccaacatagtgatgaattagatccactaatgaaggcatttgatcatgaaattttagaatactgggcaagcttcaaggggaaatatatttctattcaaaggattaagaagcagaatgactttatatttcttcgagctaaaaaaaagctgagcagtgtcctcaaaattctcaagaaaaatgaatttcccaacatagaattccgagcccaataaaattgtcactgattgtgatgatagaccgaagacatttctgatagtttagctctcaaaaattttacctactttacacgccttctctgaaatgtaataaaggatgtgcatcaccaaataagagggaggagggggtcaagaaagtgggatccggatgagctgaatcaagagtgaggtgacaagaaaactcaggttaacaggcaggaagtgtcaagcttcaggagctcctgatcctgactgaagcaaagccagtatctttgggagtgacttcatgtagatgaacttgatagcatacctactaggtatgaataaatgtattgagaggaaagcgtctggagtaagtacatacacaactaattacctaaaacagaaatgaacacaaaaacaacagctgctaacaatcagaaaacaaaatgctcttcagaaaaggacaattactcataatgtactgcatggattggctatgaaggacatttatagagtcataacaatgtgagcattcagtaatgatctcaccacatttgatatttcatagaactgggaggaagacatagatgggaagtctgtgtgtttgtttgtgtgtatatgaatgtgtgtgtagtaggagtggcaggaaggggaaagagggctgaatcattttcttctatagtagcaagtaaatagataattcctaaacagaaaacaaacagtagcaatataaatatgttagtcagatataggagacagaaaaaaaaatcatcccccacaattaaaagtggttatttctagggtgcagaatttgggtccagagtgggaaactgctgttgtaacaagccttatggaatggtttgactctttgtacaatcttcacatataactttgctaaaaacaaaacccaaattaaactgtatattgtgatactgaaaggcattactgacaaaatgcgtgacaagagatagttgtatataagatgtaagtacgttaagacactgagaggaagtggaaagcctttggaacatatttttgatgcttctgaataaagctgcagtctttccttttttcttgagatggagtttcactctgtagcccaggctggagtgcagtggtgcgatctctgctcactgccacctccacctcctaggttcaagtgattcttgtgcctcagcctctggagtagctgtgattacagggggcgctaccacacctggctaatttttatttttattttatttatttatttatttatttatttatttatttatttatttattttgtgatggagttttgctcttgttgcccaggctggagtgcaatgacacaatctcggcttactgcaacctccacctccagggttcaagtgattctcctgcctcagcctcccaagtagctgggattacaggcgggtggcaccatacccagataattttgtattgttttagtagagatgggttttcaccatgtaggtcaggctagtctcgaactcctcacctcaagtgatcacccaccccagcttcccaaagtgctgggattacaggcatgggccaccgcacccagccctggctaatttttgtatttttggtagagatgggatttcacagtggtggccaggctggtctcgaacttctggcccgaagtgatctgcccacctcagcctcccaaagtgctgtgattgcaggtgtgagccactgcacccagcccagtctttccttttgaaaaatgtgttgtgttatatttaattaaaatgtattcaagtgtaatttatggataaattgaaaaacattctggagcaaataaagatgcaaaaggatatgtataatgtgacaccatttatgtaaaatctccaaatgcaaaatggtataatttattggttatacagtgtaattttaaaaatctctattagactgatctcctaccttggatgtgtggtattatgtgatgaaggagggagataaaaggtgtgggaagtgaggtgctagctatatcaaattctttttgtttcaaagacagtgcacgaagggagaaaagaaggttgagtcaaatattacaaaatgctaaaatctacaatattgagtagtagttatatggatgtctattattttttgtaattatctgcatctttgaaatgtcttataacttaacaaaggaataaatgaggactggtagtcaacaagctgttatcctaaacctggagagtggggacacatagacattaaaatttttttccttttatttataaaaataattttaaaaattgattctgagtctgatgacatataattactataacaatcaattttattgaaaatgttactacttttgccttcatattgtttgaggacacaacattaaacataaactaaactttgaatatggatattcaaggtttagtgccccatggcccttacctggaagacaaattagagcaaaattaatgagtatatgattttgtgtaacagacaattcaattcaataagtagttatgaaattcctactttataagagacaagacagaaaaatagcaatgagcaatcagggttctgtttcccaacatgatttccactctgggaaaggatgaagtagaaagtaattgttaggtgagcgccctagaatcagataatggggttgagttagctgagttatttaattctatgaaagttaatactgaattttggatgagttattaagcctctctatgcctcagtttccttaatgtaaaatagcaacaagaatactatacacctcacaggattattgccatcaaattagcaaattcagatcaaaatacatgtttctgtgcctggcatagaattatggtaaattctcagtaaatgttagtgtgattgaaaattgtgaagacattagcatcaccaccctcgggagaatacatcatttaagacacgatggttcagctagagaaacagatgtacacagctttacgtgaggaagaattctttttttcgggactgagaaattccaagaaactccctaatgaaatttaagcttggaattacaacttaagtcagcttcatggactagcaatttcttaagacatcagcacctttcttagaggggaaaagtctgtgcccgccttgctcagattcactcagatcttggcctttcttcagcagcagagacagataaagtcccaccatggagccagccaaaaagtgagcatgaatccccagattgaaggcctttttacctctggaagacttgtaaaatgaagccagggaatagaaaaacaaattaagttgtggtttgaatatgtcactgaaatgctatgtggacaacaaaacttcatggtggggacatcagagagataaatttcatagtgcctggacattcattcattcatcaagtgtttagtgagcacttaactatctgcttcccaacaagcatgatgtcagggacacaatagtgaacagacaaaagtgttagtttttattaagctcacagaagctgaagagatagacaaacaataaaaataaaatacaagtaagtgaatgcagatggtaacaaatgttttgaatgaatgaaacagcttactgttaatgattgagtggggtaagaggatggactaatttagactggagagtctgggaaggacttttatttgatctgagattgtacttattaaaagggggtggccatgaaatgatctgggaagaaagagcaagtccaagggccctaaggtaggaacaagcttcgtgtacatgagggccagcagggctagagcacagtgagtgagtgggaatgcggtgggacacaaggtaaggagttgggtagacatcagctctcgtgaggctaggtagaagcttggatattatcccaatgcaatagcaaacactgcgaggattttatagtggggtgcgatattatatgattcacaagtttaaaaggattattttcccatctcaagaaactagaaaaaaatgagagtaaattaaacccatagtaagtaaaagaaaggaagtaataaagatcagattagaaattgatgtaatagaaaatagtaaaaacaatataaaaaatcaatgaatctaaaagttagttctttgataggatcaataaaactgatgaacctcatctgggcgcgttcatgcctataatcccagcactttgggaggccaaggcaggagggtcaccaggagtttgagaacagcaacacagtgagaccccatatctacaaaaaactgaaaatatagctgggcatgatggcatgttcctgtagtcccagctacttgggaggctgagctgggagggtattttgagcctgggaagtcgcagtttcagtgagccatgactccagcctgggcaacagagcaaaaccctgtctcaaaaaaaaaaaaaaaaaaaaaaaaagataaaactttataaccagacttaatcagcaaagagggagaagacacacaatatcaatgtcagaaatgagagagaggcattttacaaatttcacagatattatgaggataataaggaaattttttgaacaactttatgccaatacattttacatgaaatttacttacgtgaaatggacagattatttaaaaggcacatactaccaaagctcactcaagaagaaacaggtgacctgaacagcagtgtatctatcaaataaattaagtttatatttaaaaacttccaacaaagaaaactattgatccagagggcttcactggtacattctacaaaacattcaaagaagaaacaatgccaattctgtacacactcttacagaaaattgaaaaggaggggatatttttggctcaatttatgggatctgaattacctgatatgagaaagagaagggaattagaagggaagaaaactatagaccaagatgcttcatgaacataaaatgcaaaaactctagcaaattttagcaaatagaatctaacaaaattaaaaaaaaaaagataattcttcattatccccactggtgtacatcccatgaatgtgagattggtttaccatttgaaagtaaatcaatgtaatttaccaaattaaccagcaaaaacaagcaaaacaaaaacaaaaacaaatcaaaaacactatatgatcatctccattggcacagaaaaggcattggacttaagccagtacccattcctgctgaaagctctccacaggaatagaagggaacactcttaacttcataaagggcagttacaaaacccccacagctaacatcatacttaatggtgggcgattgaatatttttcccctaagatcaggagcaaatgaggatgcctctctttccacttcagttcaacattgtactggagcttctagctaatgtgataggcaagaataaaaagtatatttatattggaaaggatggagtataaatagctttttttcaggcaatattatcatctaagtagaaattcagattgattatatagaaaagctactagaactgggaaatgagtttagtaagatgcaggatactacatcaatatgcaaaatgtatttctctatatacactcagaaattgaaatatatctcttacaatatcataaaaatataaaacacttagtgataagtgtgacaaaagttgtaaaaaacctgtaaactggaaactacagatcattaatgaaataaattagagaaaaataagtaaatggaaatataaaatacattcatgtgccattcatagtattgttgtcaattcttcagaaaattgatctatagttttagggcaatcccaataaaaaaccaaggaggcatatttgtagaaattgatagactaattttaaaattcacatggaaatgcaaaggacttcaaaataaccaaaaaatgtttaaaaagaagaaaaaaggtggaggactaacaccacttaaggtttattataaaccttcaagagcatagctgtgtggtgttggcataaatataggcaaatagaataatggaacaaaatagagagtccagaaaccgacaactgcccccccaacacatatatagatacatgatttttgacaaaagcgcaaaggcaattaagtgaaaaagggatattcttcaagaaacagtgagtgctggaacaattggatatccacctgcaaaaatataaaccttacctcacctaatacagaaagattcaaaatggaccatagacttgaatgtaaaacctaaaactactaataaagtagttttatatgtaaaccttccatcttttagaagaacacataagatcaaaacttagcgcacttgggtttgagcaggcaaatatttcttatgacaacaaaagcacaatccataaaagagcaaattgctaaattgaacagcatcaaattaaaaacttctgtatttaagaaagaataaaaaggaatgtaacagactgggataatgttttggaaataaagtatctgatgaaggatttatatccaaaatatgaaaagaacctcaaaattcaaaaagaacaactaaaaaaattggcaaatgtttaaacagacatttcaccaaagaggatatatgaaaagcaaataagcatatgaacaaatgctcaacatcattagtcactagaaaaatgcaaaccataatgtgaatcattagaatgattaatattaaaagaatgatcatactaagtcagaagaaacgaacttatacactgacggtgggaatgtaagataatagaaccattatggaaaacattttgacagtttctttttttaaaaaaactgttaaacatacatctaccatgagatccaccgattccacccctgtgtatttacccaagagaaaaacaaaagatgttcacatgaagacttgtggggtgtccatagcagatttatttgtaatagctagaaactggaaacaatgcaaatgtctatcaacaggtgaatggataaagaaactgtgatatatgcacacatgaaatactactcaataataaaaagcaataagctgctgatgcacactacaacctgaataaattatgctagtgaaagaatccagaaacaaaagaatatatactgtttaataccatttatacaaaattctagaaaatgcagactaatctatggtgacagaacaaaccggtggttgcctgggatggagagaggaatgagtggaagaggctacaaagtgtcaggaggaaacctttgaggggagtgagatgtttattatcttgactgtggtgatgttttcattagtataaacatatgccaaaacttatcgatttatatattttgtatattatatatttgtgtatattttatacaaaattttgtatattttattgcacatcagttgtatctaaagagagctgctaaaaattaggactagctcattctaggggttaaatagagaatgaactgtgagggagaggatgaaactgaaagcccaactgcggaatccacttaaaagatgagagtagcagcaacttggtgatagctgagcaaatgggaaggaatggactgccatagtaactgtatgtgaaattaatttatctccatagtcaaccctctaactgtatttgaaaaagcataaagaaaggggagagttttttgtcatccctgtattggatttacaagtacacttcaatgccaaggaaaggtgcagatagatgaagctgtgtggttctttgggggaatcctgaatatttcagttctggtgaagtacagagttgatagtgtaggactggagaggtttggaaatgtagaactgagcccagctgtggagagccttgcattttactactttatgcagtaggtgggcagtaaagaaccattaaatcatttaattaggaaagttaccttgttgattttttaaattaaattaaattattgtttatatttttaaattttttgtgtgggcacatagtagatttatatatttatgagatacatgagatgttttgatacaggcatacagggtgaaataagcacatcatgaagaatggggtatccatcccctccagcctttatcctttgttacaaacaatccagttaccctgttgatttttggaggagattactttggagctatttgtaggatgccctaaactttggaggatgttttaggcagggagacaaggtaggggaagctaatgaagtaaggatggaaagatgattgatgcaaagggactacctattggacttgtgagttgatactgaatggtgggtgagaagaaggggagccttcacagttgggcaatagcaggatgcaggatgcttataagagttgctgaaatccaataagtttgtgtgcatttctaagggacttgactttccactaaattctttgtttgattcattcacatattttaaaagagatatttacaaagctctctgatgaagttagcacatgaagaaactgaagttcggagaggtgtttttacccaaaggtagaaaactgcagagccaagaacagagaatagttctttattttctcctgatctaaagatctttcttataaagccacagtgtatgtcaagaatgagcagtaggggtgctacttcttgccatgctcttgccatgctactatgcaccacctacagagcctatctgaattgttgtagttttctttattttgtgctgaaagcattgttttatggatggcgtgtaaggtaggaaataggttaagtacagtagtatgtgtgttttatgttaaagacagtaaagaacttttcctcctagtaactggtcttgtcttatttacctttcctgggtgaaggagttctggcagttgcggtctcaaatcatcattgaattgcagtggtaagcactagctagcttacatttaatacttttaaaacatgtactggtttcctaggaaacaatgccttgactactgtaaaccaaactttaccatagatactagttatacaatttctcagcagaaaaaaagctttcgggttttaacacagaaataaaaatgtaggttgttggaatagtatatgccgctttttctagttcaacaaaggagaccaaaaaaaccccacaacctcaaaatagatccttccactaaaaataaatattatatataatacagatcttgccagattttatcatcctcatgaatttctgaatctggagtctcttttttgcctttcattagattcataataacatttgccagaaatgttgctagttaaaatttacaaaactattgtgacatatgaggtttgaactagatctggatgtattatggaaatagatgtgatgattaaagtaccagactagtttcttttgttcggatatttaatttttattgtatatttggaaaattaggatagggtgaaattaggaactatatgcagcattttaaattttcagtcttctttagttcactcttaaacacatgtatgtccataatgttatgagtttagtgtcgaccatgttaactaatttccatttttccaaattcatatgaatgctagactagtttgacatagtatatagaaagatgtttgaaaacactgttagcatattatggtgctattcaatataccaggttgtattcagcagaaattggaataaaagattgcaaaagctctatgggcttcaactaggcagaaggagactttaattttgattcaacagctaccaaaatccctcattagctgatgacatggaacaatgattttacacctctgtgccaactcccattttctcataaactaccagacacccataggctttgcttttctgatatgcatcgcaatgtgctggaaaaagcatttagctttgtagtaaaatagacatggatactgattcagtcactagtgagtgaggttcagagaagttaagtgactaactgaaagatgcacagctagtcagtagcacaggtagaaacaggagctagttttcatgaatcttcaatcatgccaatgcagttgccactatatttttatgcctttctgttccttcagagtttttcaattgagcataagggtggcagtgtgttattcagggtgttatctgtgaatagttattatcccaccaatgaaaccaaccagagccatcttctccctagctgcccttcccacttctttgttactcctttatcttatgttgttcctcacaggaaagaaaagttatcaagtaaaaactgttcagtgtttttaaattgacatctatacatgtgtagagagcaactaatctttatgagggagatcctgtttaaaatacaaacaatgaaattttgcagtttgcatagtcaaattacattagcatgttgtatataagtagaaaggaactgtcttaagcataaaccagccaaagcagtaggaatattttgagcattctatttaaaaaaaaaaaaaaaaaaaaactaaaagaagaggaaaagtgaaagcctcaataaaaaaatgtcatttttgccaaacataactcaattccattgaaagtagctatttctgtagtagcagttggcgttgcacctatgagcttcacactcagaacatgagatgcatttagggaagggggatttccaggggagcacttcagaaaaagtcagcctgtaaacgtgtgtgtgtgtgtgtgtgtgtgtgtgtgtgtgtgtgtgtgttgctttgatcattttaactaaaactgtgtttctttcctgcctcatagtttaattaattgatttccttagctcagaaacaaactagcatttaacatcttccagtatatagcttcactttgcttattcacttctgttccttgttgtctttcaacgtgaagattatactctagtcaaacttcctttaatactacattgctcctatacgacatgatttaggttaaatatgcaaaagaacatactgatatgaaagctagggaggttgtggaaactctttcaggagagtttttagatagattattttctgtgcaataaagagtagaaatagcttcattgatatattttgttttgttttgttttgttttggtgatactttccaactctgtgatttcctaaagaaagtcagtcagcaatttgtcagttgtattgattgtctgctacccatgagtgactctgtgtgtgtgtgtgtggatgtgcacatgcctatgtttagaggacaaagtgtgaaggggagggggacaaggtgggaaggggaacaagagaaatataaaggtaaataacacttttccttttttcaattattccttttttcaaacttttaaaaaagaacctggaagcaatcaagtagataacatcaactaaaatgtgtggaactggtattctaagtggtcatttacatagaaaatgttttgattttcctgaggatagaggaggaggcagctttattatttttttctgactggtgtactcttttcagctggacagttactgaagtgtattgaggggttagataaggtgcatgctaaaacattgtataggtttctacaaatgacttggagcccaagtaaatgggcaattaatttctgcattttaagtatttatcaatataatggtattttatcctggaaatttggttattactgctggattaatggaaactaaaacttatttgaatatttgttttggcttatccaatgagtatttatgtgcaatatctgatatattatgtgcaaagtaaagagaagcatacatctaaagatttaaagaaagaggccagtgcagtggctcatgtctgtaatcccagcattttgggaggctgaggcgggcagatcacgaggtcaggagttcgagactagcctgaccaacatggtgaaaccccatctctactgaaaatacaaaaattagctgggcatggtgccacacacctgtaatcccagctactcaggaggctgaggcaggagaatcacttgaacctgggaggcagaggttgcagtgagctgagatcaggccatggcactccagcctgggagatagagcgagactccatctcggggcggggggagggaagatttaaagaaggagagatgttacaataatgttcctttaaacatatatatatataaaacaaatgtgaaagggggagagacagagagagagagagagagagagagatctgtcgataattgatgagattgttcttttcagccaaatttgggagaggtaggatggaggtgctagaccctaataaatgaatgtgagggggtaatttgtaatgtaagaatgataaagaagaaggctgggtgtggtggctcatgcctgtaatcccagaattttgggaggccgaggcgggaggatcacgaggtcaagagatagagaccatcctggccaacatggtgaaaccccgtctctattaaaaatacaaaaattagccagcgtggtgacgcgcacctgtagtcccagctattcgggacgctgaggggggagaattacttgaacctggaggtggagtctgtggtgagctgagattgtgccaatgcactccagcctggatgacagagtgagactccatctcgaaaaaaaaaaaaaaggaatgataaagaagtagtaccaaaattcctttttaagaattgtcatagtgcaaacatagagaagaaatcaggggcaaagggtagcaatggaaagtcaagacaatgttgttcttgtagaggagaccgagtacatgtataggctgggcgaaggagagagcttcactgtagggaggcagttctggtgtggtggtggaaaagtactgggctttcactcaacagatttggagttttttctcaactctgccagtcggtaactaattgagaaaggtgagtaatttgcttaatttacttgaggctcaaattaaataacaaatgtgaggtcagtttgtgaatggtaaaatgctgcatcaataatgtggcattatccacggtagactggcggaacatataagcactctgcccctctgaattatttcaaccatgcatttcctgcctcttgaagaagagaaacaaaacagagggcactgaaatgatttgcacctcactcaaaatgagtagaatgtaattataatcccttcgaagaactagaactcttcagtccctgaagacacggcttattgggcttctgtatgaaatgaaggacatggactaatcctggaaggacattccagtaaatttgggatgaacagtattcatgtatcatggggattaaagccatttgaaatcaacatgcaaggaggtgaatgttaatatgatgcaaacagaatacagaaaagctgaagttgaggaagtgaacagtaaaaggtgtctgcaggaattcttacaggaattgaattctgagctagatttggaggaggaaaggcaggaactggtgggatgatggtaggaagcatttcctctgaaatccctggagggggctgagttcaagatgtagttaatagaccagtgggagatgatgggagagagggtggaaggctggatcaagatggtaagatctgataccatgagcaatattgaacagcgggggaattcctgagcaagaagatggcattgctatcagaggaagattgttccaccctttggcatctctgtgcaggatgagtagaggtgggagcctggagaatcagataagtggctgttgaaggcatggggtaacagggttgttggaggctgtggaatcataagagggaatgggtagatctgagagataatggagaaacgtacttgaaatgtgacatttttagttaacctgtacatgaccatttgttctgctctctcttattgtggagccaattttgaggaagtaatatttctgtattgtaatgaacatggaaatgcttcatgggtattccccaatttcagttaccctgtatcctaattatagagaacctggactcttaaacacagcacagcatggtctttcactctggtacaaagcaatcataggtctgcttttgccatgggtcccataatgcttctttgtgcacagtatggtgaaattctccttattgggaaagtccataatggtgttacattcttgttatattctatcaacattttaaccagttatcttgctcctcatgtggtagcacttgtcaagctgtattttttcacaggcaataattgaggtcttggctgatgaagcaaatggcctaatgagtaataatcacatatttggaatgtacacgatgagccaagcatgttgctacgcacttcatgggcattatttatggtgcttaccacggtttgttgaatgcttactatgtccctagtactgtgtgggtactgtgtgtgtttgatatgggtaatcttatgtaatttccacaacaattaggaagtggatagcattctttcttccatttcatagataaaggagacaagacagagttctaatggaggcattgctttactacagaagaaacaatttttgatagctttgtaagaaagctatgctcatataacataccttattgattccttaaataaaatacattatgtaacagctctcaacggagtaaagatgggatgtggctgagcttttaagttgttttcttaaacatgattgcagttctatgtttaaaaatgagtcaagaacatctgcttctttctagggagatattccatggcttcttaacaactgctctaacttttgtggcagctgtctgaaagttagctgtctcttgaggcagtgatgtctttatcactagggggttttcactaaaatctcagtgatgacttgcagatgtcatagatgttggatgaggggaagggaagttgaattacatggcattggagatccttcctaaccctgagagtctttgaggttctaagttccattaaaactatttcaggacacagttaagagcagagcagcaatctttaggtcagtgttttatggcatttggccaaaggccatttaaaagttgatggagcaaagagaagtggatataatgggattttgaaaaaaaataaaaaataaaacaaaaaataacttcctgtgcaaaagcagattacttttaagggtaaattttagaaaaggaatcctcagatcaatatagtgccatgccattttaattatagaaagtaaattaatatctgctctttaaaaaagacagttaaaatggttctaaaagtaatgtttgaattcagtgagtttctaaattagcttaaattcttaagaaaccattaaaaatgataataactctgtttattatcattacagaaagctttcgtatagtacttttatctgtgccaaatactgtactaaatgttttccatgaattttctcgataatttctacactaacaccatgagataggtattcttattagcatcagtttttcgaatgagtacttcaagtttcaggaaagtaaagaaacttccctgaagacagtatctcaattagaacacagttctgattcctacgtcttccctctgcaacctactgttgttctattcgtctctgcagaatattctatttaatttacagtaaatgactatagctgttgtgcctatttatggtttagcttgctaaggagttaaagaattcttgctggaacaagctaggttaattgaagggaaaagcaacagcatattggttctgaatgttaagcttcaaattattttggaacctggtctcttagtaactgatatgttactgttacattttagaaaaaataaaaaggaaatcatgaaatcctaagccatatcttggacctgaatataggttgctttaggcaatgaatagttgtccttagaataattcttcatttcttgcactacctccaaaacgcaataaatttactgtcttagtagtttgaaaatgtaggcttccgaatgttcacttgctaaattcatattatttgtaacatataggctatggtgtccctattcagttagtatggttcagttgcaccacattatgtcttaggtaaagtaaactaaattaaattttcagggagcaatggaaaataaaaggaaatgttcacagtctttgagttattgatctttgtgattttcactgccttatactttttcctgaaaatattaacacatttttataaatcttaattatttgcataattagagaaattttcctgattatctagaatacattaaattttgaagagaaatctggaatatcaaaaatacacattttagactcatggtacagatgtgtacagttaaatatgcttctcaagaaaaaagaatcatgccttaatctaggaaagatcatattttgatagagaaatttttggcaaaacaaaaatatataaaaccactttctactctaatttaatgaccctgttcatttcctgttttgattttggacataattccaacactaactctctagagactgttaaaattcatggtctaaaaatataatgacaattttaactttaccacaagacaaatctttccattttacagtatgatcatgttgatatactttaaaataaaatgacacttagaattaagttcagaggttttggaattttaaaataagactttggattcgtataaaaaataattaattttttagtcaatgttctagaaaaattattatttatgcttatcaatggagaagtaagtctacttgaaaacagaaaactaatctctccttaagtgagaagaaacagtgatcatgagcttggacatgaaagtttacaaatgatcacaggtcctaagcttcagtgggttctccatatatcaatgccaataaggccttactttcaaatttcccttttgcatttataatgtttgtaaggcttattgagaatttttttttaacttttaagaaaaagtttggagcattttattattttttgaaagatagttgtggaacagggtggaggaacttgctgtctagaatttagaagcttagtaaaatcccattataaataacaaagtgtgctcactgcttctaagattacaattttaatggagaaaattaccttaagctaaataatggttaactatatgaatattagggagggcaaagttgttgaggttgttgattccgatttttctggtattgcccaaatcacaacaaactacaaggccccctgtgaagaggaaaaaggtgtacaaagggatatttaaggtcttgaagtcaatcttcacatatatcactatttttttaggcctagtatacaattttctctctctgtctttccttcacaacattttcaaatttctttccttctacattttctggcccctgtttttgaacaaagctgaaaagttcagctctgtcaaattcaaggaatttctcaagcacatgtagaggagtttgcaatgaccatccagaaatgacatcctaggttttaagtttctataatggacttggtatacttgacttagttaagtaatagaccaagtggaatcttcattaaacagctatcgttcttttctgttagcatatacactacacatgtattaagtgtctcttagtcattttgccaatttaatttaataaagcaaagagacattgtattaatttcctattgttgctgtaacaataccactaacttagtgacttaagtgatattgttacagcaacggtaggaataaaaattcacacatttttattgtatagtcttgtaggttagaagtctaatgagggtctcactaggctacaattaagatgtcagtggggctgttgttcctttttggaagctctagcaaagaatctgttccttgtcttttgcatcttttagaaacttcccacattctcagctcttggccccatcccatcttcaaagccagcaatgcaagtctaggtccagtctttctcatattgcattactgagatcatctctcctgtctccctcacttacaagtatcgtggtgattaattgaacccacttggataacccagagcaatcttccgagctcaatgttcatactcttcattacatctgtaggcccctttttccatataaggtaatatatatccaaattctgagaatccgaaagtggacatctttgaggagccactatttgctttctgcaggcatgcagagtttttgtttaatagtagaaacatgtctttgatggaggaaattattatattattttttgatacatttaagcataatttttggctcatgagtttttctctctctgcattctacattgttcgggacacattcaaactatcactaattaaataaatacaggagggaagaacttcattacaaataataatagataacattcatgaagtactgcactcagagatgagaactttttatgtcatatctcactgaatcctcataacaactctctgcagaaggtacttttccctaatttttataaataattgaagatttaaaattttaaagattttttccaaggccacccagctagtaagtgacaaccgtaagaacacagataatgtggcaccaagattggtgtcaaaactccttgagaatatgcatatctatttgaaaatgtcataatcacccatcagtacatcattcacaatgggcacccactaactgttcgttggattcgtgaatggtcttgcacagtaatatatttcattaattttctgcatggtacagttaacaagtgagataaatatggtcctaatggcatagtattaaggaacactgctacacttattgcatttaatgttctctgttgtggtgattgttggcacttacctcaagagcaggcccttgtcattgccagccctctgcttcttgtattgtacgtacatctgtcgtaccttctgctgtacccctagcatcatgtcgctgctaaacattttggcagaaaccttaggaacatctgttgccttagtccaggaacaaactagcagctctctattaaatgaggatggcatttggcagttcaggctttagccttcttcggaagtccctttggtctaaagcaatggaactaaatccttagagctctaccatcccacatgtgtagcaaagggcaaaacccatatgaaaggcatatggtggaacaaatcacaataatgcatcatgcccttctcccaaacagtagtgagacatccgtcttactgggatgccacatggacacaatatcaacacagcaccaagaggcttttgttcaaacaccatttctagtcctaacttttccagataatggctaagtgatgttagccctgtgtcttaacctctgtgggaagaataaaaacctaacccatctgggttgcctcttgtgggtatatacgtgtgattaagatttggtctctgattactaaggaaactgtaatttcccaaggaaaaactcatatataaaaacccaattcatgtaaatcaaaatcacaaactatcaatagttattgctagacatatccttcttggttttcttctaagaaagaaaaaagcagccagtgacatccagcaactgatctgatgctcatagctggaactcaggttatcacaaactgatttgacactggcaactacgccatgttgttctcccgttgagcatcaataatgtcataaaccacctacttcagatcgtgtcactgtgcatactacaaaatagaccagatctgtctctctcactaaaaccaggtatcttcctgtctcagtaaatgctcccttactaggttcaattttaggcttcctatagcctgccctatctatacgttttattgagatatctaatcataacatttcccctgctttctgacaacacacaatgtaggacaaacttctgcttccttagaaccttcctcaaaattattcaacaaaagccccaattctataataggttcttctgacactgttgtactgagctacctcacaggtggttccctgtggtatgcattctccctctgcaatgaataatacaccaaacttgttcacttacatttttacctgatgggcattgacacttccaaaaactagttctatcaatgactgaagtcagatgattgcataaaaatcctaacattttacaacagtcttaattaacctcgttctttaaaaataaattttattactgttatccatatatatggtttaaaaaatcagcccaaaaaaggcttataatgaagaacagaaacttcttgcatgctccgtattaggcctttcttgcgttgctataaataaatacctgagcccgggcctggtggctcacgcctgtaatcccagcactttgagaggccgaggcaaatagatcacctgaggtcaggagttcgaaaccagcctggccaacatggtgaaacaccatctctactaaaaatacaaaaattagccaggcgtgatggtgggttcctgtaatcccagctactcgggtggctgaggcaggagaatcacttccacccgggaggtggaggttgcggtgagctgagatcatgccatgtgccactgcactctatcctgggcaacagatcgagactccatctcaaaaaaaaaaaaaaaattactggaggctctgagactgggtaatttatagagaaaagaagtttaagtggccaaggttctgcaggctgtacagaaaacatggtggcatatgcttctggggaggcctcaggaagcttacaatcatagcagaaggtgaagtggaggcaggcacttcacgtggtgaaagcaggcgcgagagagtgaagggagggaggtgtcatgtacttttaacgggccagacctcagaaaaaatcactcgctattgtgaggacagcaccaagagaatggtgctacagcattcatgagaaatccacctccatgatccaatcacctcctttcgggccccacctccaatactggagattagaattcaacatgagattggatggggacagagatccaaacactatcatgctcttttcatccgcattcctcagagaagatatgatctgggggtcaatctacttttgatcagaacctgatcaagctactatccttaattcttaatttccaagtacttctttttctctgattatcttttcttcattgtgttttcttagacttttgtcagcacactgtcctttggatattctcttttgtggacccaaatttgacgtaattattatttttattgatgatgttatttcaaatcatttcttgaccctgaaatactatgtgtgtgggggtgtggagtgggaggatggagagggtctttttctttccctttcaccttatagaagtgaccttgattacctatttacgttgaggagaatgaggatttaggaaagttgacccatgtttgtgggtgtgggacttgatagcgtgggagggagataactcacatgattttgatccctaaaggccagaatgctgaaggttttgttctaatttgctgatgtgtagttgtgtcttcattggaagcagtcatatatgaagcttttatgtatgaaagatcttatgtatgaaatttgttcttagattgacagtattacttcaccatgtaaaacaagcatggctttagccctaattgttctataatccttttgtttgcttacaaaaaaacggggaaactccaaacgggctgaatgaaagacttgagttaatttgctctttagttacccatccagtttgcatatccttgccctccctgaactcttgggcaaaactactcagaaatagcctattattgtgctcatctgtagttctaccacaaagatgctctcctttgagttgacatatgacctgcaatgttctaagtgctttatgtattttaccttgtttaattttcatatcaaccctgagtcaacttagacattctccatattgcttttaaaatattggcacttggccaagcatggtggctgatgcctataatcacagcaatttggaaggccaaggcaggtggattccttgagcccaggagttcgagagcaggttgagcaacataactaaaccctgtctctacaaaaatgtatgaataccaaattggctgggcattttggcatgcagctgtggtcccagctactcatgaggctgaggtgggaggatcacttgagcctggaaaatagaggtggcagtgagccaagatagcaccactgcactccatcctgggtgacagagtgagaccttgcttcaaaaaaattaataaattataaattatataaatttatttaaaaaattataaagtataaattatataaatttatttaaaaatttggccaggcacagtggctgaagcctgtaatctcagcattttaggaggccaagttgggcagatcacctgaggttaggagttcaagcctggccaacatagtgaaaccctgtctctacagaaatacaaaaattagctgggcatgatggcgggtgcctgtaatcccagctacttgggagggtgaggcaagagaattgcttgaacccaggaggcagaggttacagtgagccaagattgagccactgaactccagccttggcaacggagtaaaactctgtctcaaaaaaaaaaaattatttattttttaaattatataatttaaatataaattatgtgtttttaaatatctacatataaaaattatatatttttaatttaattatataaatatataaattatataaatttatttaaaaattataaatatgtaatttatataatttaattatataattataactatataatttttaataaacttatatgatttataattataaaaagtgtgtaatttataaatatataaattatatgatttataaatatacaattttatatatgaatatataattatatatacatataattatataaatgatataatttatatataatttatttatatataattatatctaatatactatatataattatatataatatactacatataattatataattatataataatatactatatataattatataattatatttaattttataattatatatattatataattttttatatgtaattatttatatatttatatataattatttatatgttatttataattatttatatatttatatatttataattatatatttataattatttatatatttatttataattatttatatatttatatataaatatttatatatttataattatttatgtttttatattttatattattttatactttatattttattattttatattttatagtatttatatatttataattatttatatatttatatataattcatatattcatatatttatataaatattcatatatttatatatttatttataattatataatctatttataaatgtataaattatataatttataaatatatgaatcatataaatttattaaaaattatataatttgtagatttaatgctattcccattaaactaccattgacattctttacacaattagaaaaacatactttaaatttcatttggaacccaaaagagcccatatagccaagacaatcctaagcaaaaagaacaaaactggaggcatcaggctacctgacttcaaactatactacaaggctacagtaaccaaaacagcatggtactggtaccaaagcagatagaccaatagaacagaaaagagacctcagaaataacactacacgtctacaaccatctgatcttcaacaaacctgacaaaaccaagcaatggggaaggattccctagttaataaatggtgctgggaaaattgactagccatgtgcagaaaattgaaattggaccctttccttacaccttgcataaaaattaactcaagattgattaaagacttaaatgtaaaaccaaaaaccatatgcaccctagaagaaaacctaggcaataccgttcaagatgtaggcatggacaaagatttcatgatgaaaacgccaaaaacgattgcaacaaaagtcaaaattgataaatgggatctaattaaactaaagcgcttctacacggcaaaataaattatcatcagggtgaacaggcaatccagagaatgggagaaaatttttgcaatctatccatccaacaaaggtctagtatctagaatctacaaggaactgtaatttacaagaacaacaacaacaacaacatcaaaaagtgggcaaaggatatgaatagacacttctcaaaagaagacatatttgttgccaagaaacatatgaaaaaagctcaacatcactgatcattagagaaatgcaaatcaaaaccataatgagataccatctcacaccagccagaatggagattattaaaaagtcaagaaacaatagatgctggcgaggctgtggagaaataggaacacttttacactgttggtaggaatgtaaattggttcaaccattgtggaagactgtgtggtgattcctcaagaatctagaaccagcaataccatttgaccaagcaatctcatcactgggtatatacccaaaggaatatacatcattctactgtaaagacaaatgcacacatatgtttattgcagcactattcacaatagcaaagacatggaactaacccaaatgcccaccaaggatagactggataaagaaaatgtggtacatatacaccatagaatgctatgcagccataaaaaggaatgagttcatgccctttgcagggacatagatgaagctggaagccattatcctcagcaacctaacacaggaacagaaaaccaaacaccacatgttctcactcataagtgggagttgaacaatgagaacacatggactcagggagggaaatatcacacaccgaagcctgttcaggggtggggggcaagggaagggagagcattaggacaaatgtttaacacatgcagggcttaaaacctagatgacaggttgataggtgcagcaaaccaccatggcacatgtatacctaagtaacaaacctccatgtttggggcatgtatcccagaacttaaagtaaaataaaaagttaagaaaaattaaaatgcaaaaaggcgattaacattttttctttgctttaagaaatgagaggtttttgtgatacttaaaaaaaatccggatagacttaggaatataaatatatcaattcgctatctaatttaattgaacccagagttgcacgtatagcaaactgttctcacacatgaatttgaactttaagtgattccatatgcacggaattcaaaagctattctaatgttttaagaatacgttcattatttttatcagtatttttgtgtgggacattaaaattaagtgaatttccatttgccctctttgtcataagttaatccatctactttgcatctgtggctttgctttgaaaaactaatgttgtgtagcttttaactcctaatttacaaagtaaaggaaaaaaataaaatgtatggcagcaacgtgacctctaggctgaacagatttcaagatgaaatgcctagtatctatttacacttagaccagggtaagtggaattgcaaatcaaatgcatctagttttccaaagtctgataaagagccttttgtagaatcttacttttaattgccataggaatacattatacatttggagtaattaaaattaaatacttggtaattagaagttagattttattgcttatgtagtaagaaacatacacagatgcttaagagagtaaaaatttaatattcatgtctcaagcttagcattaataaccatcgatttggcaacaaagacgttaattcgatgaaagtttatgccagtacaatgaaaacaaatatattttaatgatagtaatttttagttacttgtaatgatggcctgcaagaagacatcttacttcagagttttaatgtgactcctactcttgcctcttggctatctggaatacggtctctgtaaatttttcaggtgatctaatgatgatgatgatattgacatattatgtttgtaagcactttgtcttttgacatgcttttatatgcgtcatctcagtatctttatcaccacctccaagtttttcacaacaggaaaacacaatagaagacataaacagggccgggtgtggtggctcatgcctataagcttagcactttgggaggtagaggcagatggatcacatgcggtcaggagttcaagaccagcctggccaacatgacaaagccccatctctactaaaactatgtaatcccagctactcgggaggctgaggcatgataatcgcttgaacccgagaggcgggggttgcagtgagccaagatcgtgccaccacactccagcctgtgcgatagagtgagactccgtctcaaataaataaataaacaaagaaaaaaaaaaagaaaaagaaaacataaacaggaatatttccaactatctgcctgcaaaagccttgaagtctaatttgtggacaaaactttttcacttatagttaaattataaggtagagtcaagtgagacagttagacacatccccaaggaaagagcttcattaaagtctttggaatttaaacttggatatgacacaaactagagatctacaagtcagattggaaccatgcatatattttagtttcctagcaaggcagttggaaagcattgaatttgatgccttttggtagccacgttgccacaatattctccaatctcttttctcatttgtgatgacttccctagccctgaaagaagggtcacatttttccctcactccatagggccctggtcctatcaaattttatgtgaatagggcttccaggagcctcaaggtgtaggactttccaaagacagtggagtttcctactgctggtgtggaggatagagagacctagtctcattgggtgcaaacagggaagattttagggaagagatgacttctgaggtggaccttcaagcatgaactttatactaatagttttgcatggataggctgacatacaggaaacgactggaaaactggggacctgatttgtttaaaactgaagtaaatcagggctttagttacactacttacttgccaatccagttgttcaagtcagaagcctatgaatcatcttaataaacctcttctctcctccattctctaacagagaagttagagaatggcttccctttctaaatattttcccagcctctattctccatccttccagacctcatcatagtccagatcctaatcattacatggcaagcaatctgtctctctgactgtgagaatccctgcctaagtgcctccatatgtctctgtagcctacacaataaagagaaacttccctagcatgacataaacagtctagtatagctcggctcctccatctctcttcatcattatttcttggtctgctcatttactatcaaactatttatagttccctgaatacatcattttattttatatcctgtatctttaacatatttcagaaaaataaattccatctacttttttttattttattttttgtcatgcatcacccactcaattttctggttgaacaataaaatataaaaagctaaataatcctagcactttgggaggcaaaggcaggtggatcacgaggtcaggaattcaagaccagcctggccaagatggtgaaaccccgtctctactaaaaatacaaaataatcaaccgggcatggtggcaggcacctgtaatcccagctactagggaggctgaggcacacatttgcttgaacccgggaggcagaggttgcagtgagccgagatctgagatagcgccactgcactccagcctatgcaacagagcgagactccatctaaacaaaaacaaaaaaagaaaaaagaaaaagaaaagctaaatagtgattaaactggacaaactgacattctactcaaggaaataaagctgtgcaggatgaaaatgagttttattaaagtccaaatatttattatatgccatattaaacagtaaatagtcaaagcatttatttctttttagtaacaattaatgttcctggtagattttcccatcctctgaaatatttgtatggcacgttttggtttgatttccttcattcataattttagtttccttcatacttcttgatcttcaagtatcaaataatgttttgaagtacaattagaagtatgcagaattatttcatatctgagttaatctttccaacaaataaatgaaacatcttatttttgtagagtttattctacaaaaatattctgaggaaggcctcaaaaatctaattatctcattgtaaaactccacattaacagtactacagataactgttttagttaaaatagacatataaatcattgttcttgtaacttttgtttaacctattaaaacggaagatgatgggctgggagcggtggctcatgcctgtaatccctgcactttgggaagcagaggtgggcggatcacctgaggccaggagttcgagaccagcctgatcaacatggtgaaactccatctctatatacatacatacatacgtgcatacatacatacatacatacagtggaagatgaatgtggaaggataaggtacagtttgtttacttgtgcacaagcattgcaacatcaagttgtttgtctcctagtggcagttaatagtatatggttcttcattcctttttcattcaaacagctttcattgagtgcctacaaatgtgtgataagaagagctcagcttagtgtttagagactttctcacgttatgcaggcttcttacaaggtttggtggaccttgaaatccatttgcattttttggaggggtggggatggacagctctggcagaatttttatgccataaaaatggctgaagtaaatgttatctgtaatttttctcaagaaatgattgcttgatcaaacatacaataaatagatttttttacaaagcttaaaagaatctattcccagcccacccctctgtcttagctcgggaaataaacaaaaattaaaattacctgtaaacctcaggtgtgggtttgaagtattaaaaaaaatggaaaaattgagctgaaactttcttgcatagagagatatcagaggtacgtctttctaatcaaggacagactctccatcacttatcctgatttacacttttagttcttctgggtttgggtttgattgggctggacagctagttagctgttgcctgcctgaggctacttgccctaatgcagagaaattcctggttctcagagtcacaggcagaaaaacttgaaattatttattactacacctcatctctttcaattaaaaatattaagacaaattataataagatatgtctattcaataagattagtaaaagacactgaaaaacttaacagtcaacatcttacatgttacaaatgtcatcataaggctatttcttgtgtcttccctacataaaaggttaaactttattattaaaatgtaggtttttttgaagacactttattggggtagctagagtaactctgtgagagacagaactctgtttgtctgatttaataaaaagacagagcctatgcaatctacaagtgtttctccaggaatgatttatggacatcagcacgtacataccgtatgtattttatatattatatatattatgttatatatatattatatatgtaatataatatatatatataaaatttaaggttcttgttaaaaaggcagatggtaaaatagctaagtaaatttcaaatgtctcttcacaaaaactgataaataagtgaagtaatggatatgttaattagcttcatttaattatgccacatcatatacatatgtcaaaacatcagagtgtaccccataaatgtatataattatgatttgttaatcaaaaaatgcatatggtcgagtactggctgagatctactaaatccaaatctctgggttggaggcttggtgtctgcattttaacttgtccaaatgagccttacaatgaaatctgagacatagttaggtggatggtgagaagtaccctcagtgatggctgtcatatatggataatcctttcctaagataaatcagagtgatgggggccaaagtgcaaatgtcttcacttatctgaaagggaatctgcatgtggatggcaaaaccaacatcctatactatactcccaatcccataagcactccagccacacatgccaattgtagcagctagtcttcaccaggaatcttcttataccacaactgtgcccctcttgcaaagcagggtaccttttctctcctttgcctgatccactgctcttacaatttgatgataaccaccatcagttttgcactgatcactcctaggcacctaaaccattgttctatgtattgtagtgcaatcccagagataggtgttgttttcatgctcattttacagataagaagactgaggctcagataagctatggaatcatggacaaacattgaggaaatagcaggaaaaaagattcaaactcaggtctttctgcagccactctgctgggctgctgtcatgcaaacatttactgcctgactttctggacaagagtgtggagagctttgatttctaaaactgcagcacagctaataatgaaaaaagagatggcctagttctttatttccttatcccctacaagcttttatacatgattttaatatcaaagggaagatattaaatctcactcgtgaattatgatgaacactaattcacagactaaaaaaattctgcataaatgtgtagatgtgtattgtatgcattttgtgaaaaaatatattaaaaagataaatgggagaggtgccagtacattgttaaagcctaaaatcaacaacattgtatctcttctcttcctaattaatttattcctggatcttgacataataaaactatgtcttttatctccctgctccctcatttagaatcttatttaaagttaacttataagaaagcaaaacttaagaactcaacatctttaaaagtcttacagatctcaaaactgaattcaaaattttaatgttaattgattctaatatccgccattatcagaaatctgaatgcattcttgttgcttccaaatttagaggtctaacaactatttgtacttttaaaaacttcaataaataggagtcaaggatttaatgtgccagatgagaaattttgcaaatcattataattactggaattcctaaaatctgtttgcagatgtggggagtttcgtcattacttcaggcaacctgtattctcactgtggttgtagcatcaattaactctgctttcattagctttctcatttttaaaatcagggattgattttaaaatcagatgatctctaactgatgatctcttatagctcaaataccttttacttctttgaaaaatgtagtacttattgtgataccatgcagtagtcctgaaaatgcttcaaaaggattccaagtactttatgttactgtaaactgcaccatgaatgtggaaagttgagcacaaatggccaaataatagtggagaaaataatagtgaatgtcaaccttttgtagctccttttctatcgtagatttaatggaatgtgagtctgcagacttcacagagaactatttttgaacagaaatatgtatttgaaccccttcccctttcttagatatttgaatgacattatagttgtatctaaactacaccgtggtctaatttaacacctggaatggcataccactttccctatagtgtacaatatttggtataccaccaccctgaaatattggctcataaactactgaaaaaatattgttaatcgtagaaaagtagaatatcacccaataaaccagtgtatatacagcccagagactcctttggaaaataataaaatggataaataattgggattttagcagcaatttgaataacttatttactcacttactcaacaaatattttctcatcagacattcattccctgtccatgttgagtttgtggagcacttgtgtgagggaatatattgaacaaataagtttaagtatgatgacttttacaaaagtagaagtagagggtgctgtgagaacctaaaaggagttaattcatctaatttgaatggatggctgaatcagtggaggatgtctgggaaaactttcccaattaagggatttttagcagagatctgaaaaaataagcagataatatgccaagcaagatctgggaaaacctttttaggcagagagaataacttatttgacgtttttaaagcaggagagagtattctttttgataaattaaaagagaactagtagagttatagtgcaaatccaagaaggaaaatggggcacggagtagactagaattctgatgggtatgaaagtcaatgtaagaatgatggacttattcaggggcactcagaagttttaagaaggggtggggcaaaaaacccagaatataatcagagttagtttttctaaatagtatttattttgaaatagttgaatactcacaagaatttgcaaagagtagtttagagaaggtttgtgtacctttcacccagttttcctcaatgataagacggtgcatcagcatagtatggtgtcaaaatcaggaaattgatgttgattaaccatggttaataacaatgtgattaaccgtgctgtagatgttatttgaatttttcagtttttacatgcaaaatttgttttgttttggttttggtattcaaaagttcgctagaatgtttttaaaggagtgaaaaggattaaatatggatattgggggagcagtttgtaaaataaaaagcaaagttgagttgatagatgaaggtatcctaacctagaagtggcatggactcaagaaatatttaggaggtagccatggacacaggaaggggaacatcacactctggggactgttgtgggggaaggggggaggggggagggatagcattaggagatatacctaatgctaaatgacgagttaatgggtgcagcacaccagcatgacacatgtatacatatgtaactaacctgcacattgtgcacatgtaccctaaaacttaaagtataataataataaaataaaaaaaatgatcagtgagtcttggtgagtggatatggggtgtgagagaggggataagttcgaaggtgacctatggatttctattttgagcaattgggtaggtggtgatgttcccagttgaggttaaaagtcctggaggagaagcagatttgctgggaaaggaagatgcattcagttgggacttcggtgagcttcaggtacctatgtaggcaagaatgctttctgcctggagctctggaaaaagctagggtgtgagatatagatttagtcatcctcagcttatagatagtaatttcagcgaaattatctcaggagaatatgttaaatgaaaagattttaaaaagtttagaatagagccctgggatctaaaaatattaagtggtttgggaagaagaatgagctggtaaagagactgagaggaaataatgaagaacatagagtttttagtgtgtgtgtgggaggggggcggggggagagagagagaagaggaagggagatgaaaatacaggagatatatggaaaaatagcaaaattatgtcatataagcaaagtcctagtaagctctatctcttttctttgatttcttctgaagttataattggaaggtttcttgtagttctctatgtgtgccattcttttgaagtttagtatttataatgtcgccaactcaatttcatgataaagtgtgatgtcttctgcaacattatttacatctttcaaaatgttattttggattgagaatacttgaatatgccacattttagtaattattaattaattgtttctttttttttgagacggatttctctgttgcccacgctggagtgcagtggcgccatcttgcctcctgggttcatgccattctcctgcctcagcctacccagtagctgggactacaggcgcccgccaccatgcctggctaatttttttgtgtttttggtagagacggggtttcaccgtgttaaccagaatggtcttgatctcctgacctcctgatccgcctgcctcggcctcccaaagtgctgggattacaggcgtgagtaccgcacccggcctaattaattatttcttaaagtgaataggaacttaaaaactatggccgtgggggcagggtggggggcagggaggagtggtaaattgtgcagaaacgtttaggtttaacaagatccaaaatcctgtaattaaggtatattttaattacatatatttaagctataaatatatgacagtaaatataccaacaactggatcataccccaagctaactgaaatcaaagtttcaggataagtcctgggcatctgtatttttaaaaatctccaattgactctgatgcctagtgtggattgagaatgattggaacacttagtactatgagaatcttaggggtggtgagaaggttctatacagcaacttgaatgctatgactctgtagaaacctcactgataccagtataatgaaagtcatgtcaaataaattttcttgaaagaaaagaggtagccagtaaagaaataaaggacaagaaattttgagttgacctactgaatttggaagtaatcatcacaaatcccattgaaagttggagtgaatgaggcagggggttgatttacggtagatttatgctatgacgagctgagtgacaagttcagaatgacaagctgaaatgtctcagaatcatttcatattagatgggaagaaaaggtcacaccagtttgagtaagtgataactgaagcctgaaataaagctttggttaaaggaatgatgcaagagaaggttgatgattaaatgttgtgggaagaaacacatgaattttgctagacatgtgactggggataataataagctgaaagttactttggggactttcactaggaggggaggttatgtattggtggttccaaaagtagcttattaattagaagtatttactttttacttgtagatttactcctcattatgttttcaaaagaatgtaaggtatctaagaaggtcatttttagtggttaaaattatctatgaacataaggaataaataataaacatgaggataactgagtcaaaagtgaaatgaggtagtcattttattaactataaacaggagctttgctttactggtatttagaatttcaaaacactgtattcagcacagaaaccttaatgatcctcatggtgcagtcattcttctgaatggtgtcatttataatgcaattctaaacttaggaaataaatggaggggagggtaatgaggcttatatgatgccaaatgagtcaacatatgattaatattgagtctctttcacgttcactattgcctgcctttctgcaaagtggttttttgtctgcactaacttggtatgagaatcaaatctattcaataaatttcttgcatggattatcctgttaggttgctaacaagtatatttcctcaatattagtgaattcttcttactacaaatatggcagtctaattttgatttagttcaggttgattgctattttgctttgataaatgaggaggaatccagtctttttggacattgagttttgttttttttttttttttttttttttttgagacagagtcttactctgtcaccaggctggagtacagtggcatgatctcggctcactgcaacctctgcctcccaggttcaaacgattcccctgcctcagcctcccgagtagctgggattacaggcatgcgccaccatgcccggctaattttttacatttttagtagagacggggtttcaccatgttggccaggatggtcttgatctcctgaccccgttgatcagtgctcctcagcctccaaagtgctgggattacaggcatgagccactccgcccggccacattttttgaacaggtgatgagacctactctccgtgtaaacttaccacagtaagcgttgtagactttagtatttatctacttagtgtggtatgtgtgtgtttgtgtatagttttttaaatgaagagcatagcagtaagtctttctagctttctttctgggtaagtctgctttctagcaagtttcagttgctgtgatacccttatgcttaaagtaatctgagaaataagaccatgataaacgcatttttaaatgatttttaaaaactagcacagtggagagcagtgtttattattgctagactgaagcacaatattcatttctaacaaatcattggatgacctcacagatagaatagccaatgatttaaaagtaatcatagtagaaaatatggttctggcaggaatccaaaggatgagccattccttctccttgaaatgcttccctctcaccaccaccctgatgtccactgccctggttgtctttttgtgtctctgctatttctcagtctcctttgtgggacctctctcttgaccccacctctaggtttatttggtctttaagaaccagttacttgtctaagtctaaacaaccaatgtctattcagttgctcaagctggaaacctggggttgtttccttttccccatccttacattcattctaccagtaagtcctatagcgcccacttgcaaaatatactttcaagttagtctcacttctattcctctctgctgtcaccatcctaatctaggccatccttatgttttacttgaaaatagtgcaatagcatcctttctgagttttccttctcctctccttccacctggaattgctccagtttattcactgaaattctagagatgttttttacaatatagattataccatgtcactcattatctttgctttacccctttaacagcttttcatttcactaagaattcaattctttctcaccatctgcaagaccatgtctaaaacagactctgcttatgtctcgaaattgacctgtagctattctttctcttgatctaaaggatctggctcaccagcttccttctccaaactagagccagaaaatattctgttccttctgctttgagcacctttcctttagatttcctatggggtggctcactgatccttgagtctcagcctaaatgctgcattgtcaaacaggtcttcattttacatgctaagtagatcttcccctttattctgtattcagcaccctttctgtgacctttaaaacactttctctgtcttaacgatatatttgtttgtttacctctgtattaacaagaggtactactaaaattttagctgagaacacagatactgtttatttcacttacccccttacccctaatccctagcacaatgtcatatatgaggtactcaaaaaatgcttgttgaatgaataaatgaatcaacagtgtaaggatcaggctgagcagactactgtgtaaaggcaaactgacacacctggaccagcgtggttgttaagagggggtctggggtggaagttaaatgttgcataaccattattttaactaacatgactgatttgtttctaagtttccattgggaggattaggtgagataacatgtgcaaaaatgcctaaaatgaaaatatcgtatactcaaaaggctgtcttctgtgtagctctcctccttgtactagactgtgtggccaagaaaagtgagtgtcctcatagactacctccccttttcatatccctctctccattctctttgtttattctgggaaatgaccaagaaccctagagactgtggcagggctgtgtgcagagtgtgtgtccagcaattcttgcacctctaatagcatattcctacctgtgggtaggtcataacccaaccactgcatgaaagagtcccctgaagtcctgagaactgctgcgccagaaacattctggaattgctgccttctgtctgccctctgaattcttttgttccatccagctgcctcaggttgaagagcctatatcttgggcttagttttcatttgtatgcttgaactccctttggattaattctttaaactgtttctctctagaccacagttttgctcagtgtcccacaacctcggggaccaacactcatccctctataccctgtccctgatttctggaatctcagcctgaaaaagacctcagcatccacctttaactagctggaggccttcacacagagttacatcatgtgcctgcctagttaactgcagttcaagcatacactgtgctctgaatcccatgtcttttgcatttactttttgtactcaacctccttggcttcacggcctgcctaaacttctttattgcttctctgtttctttttgtcctcctgtcagtgattgttgtgaccttattttcacaaaggatacatttttaggggtgtttttccagattgtggataacacttacttccataaatactatacttatgtcagtagcaactctaggtcactctttaaatcactttgtggataattatagttgtgttttaaaaccgtcaatcactattgcctgcatttacctgcagtggctgattttgaagctagaattgttgtgttggaaatataataaatattaactatttactactgaaagggacaaagttttaaaggacatatggtacatgataaatagtggattcaagttataaaatcacattgatttatcttcttttttctcaaccttcctttcttcctaccccctctgtctcatgccgtgaaaatcttaaggtagctaactcagattatagtgtatgaacccttatactaacatgctttaaggttacaaattgtacatattacatttctactgtaaagtacttatatggaaagcattaatgtttggtatcttatattcagacttctctgaaatattataatttctctgaaatattataggtcattagttacattaattacgaaatctgccattttgcagttttttggaattttatattttatcttttaatgggagcttcctttttatttgaaattcaaatacagatctccatccaaattgataacaaattttgtgtacttcatttctcctccatatgtacatattgaagtcatctgaggcaaggtatgtaggaataaaaggagagaaaaggagaaagaaagatgtgtgctcaagtcagataagagaaaacaaatgtgaacatgctggaatcaaaataagttgaatccattgctgaattcaagacgtgtttctgtattgagattatccttctgtaaaacccataaagcatgctcaaacttctgtaatgtagagaatgaactagatcagaaaggggatctatgaatgaactatgacagaattttgaactatagaattattgtgaaatggccacaattccctgctgataactattgcagtggatttgttgactctttattcaggtgagtttaaacgttaaaatggccaaagatatgagaaagagacagaaaaagagagaagaaacagtgagaaaaagagagataggaagatccagacagagagagacacagacatagagagagagagagagacagagattatgaatgaatgaatatgaatgtgtttcaaataaaagaaggtttaaaaagtgttttattgcaggctgatagtcagtggacctgagtcctactttaatctctcatatgaacttggcaggcatctaacctctttatacttttgtttccttacctgtcaaataaggacaaataaggttctacctactgcataggtctgtggcaataatacaatgaaacgttagatatggaaatgttttgaaaacatgaaatgctctatgtagataaaagtcatattatccaagcataacattcttctaaaattttttaattgacagataacatcatatgcttttatcatgtacaatatgatgttttgaaatatatatgcatttacaatggttaaatctacctaattaacaagtgcattactttacatagttatcatttttatggtgagaatacaacatccattgtccttacatgtttcaagaatacaatatgacattaactacagttgccttgctgtacagtaggtctcttgaaatttattctccctattaaactgtaattatgtaaactgtgaccaacatctcctaacaccttttcccccctaactatcccagcctttggtaacaaccctcctcctccctagttctatgagatcaactttttaagattccacatatgagtgagatcgtgtggtattcatctttttgtgcttggcttgtttcacttaatataatatcctctaggttcaaccatgttgttgtaaatggcagaaattaattattttttatggttgagtaatattccattgtgtctgtataacacattttctttattcattcatgcattgatggacacttaggttgattccatagcttggctattgcaaatagtgctgcaataaacatgaggtgcagatatgttttcaaaatactaatttagtttactttgggtatatacccagtagtgggataacatggtagttctatttttaattttttgaggaatcttcatactattttccgtaatggctatagtaatttatattctcaccaacagtgtgtaaggattcccttttctccataccatgtcaacacttgttatcttttgtctttttgataatagccattctaacaggtgtaaggttagatctcatggttttgatttgcattttcctgaagatgcgtgacactgagcattttttatgtactcattggccatgtttattttattttgttgagaagtgtttattaaattcttttgcccatttctaaattgggttatttgggttttttttgctactgagttatttgagtttcttatttattttgggtattaaaccctggtcatgtgtataggaggcaaatatttcttccattctataggttgtgtcttcattcttttgattgtttccttaactgtaaagaggctttttttgatgtaatcatatttgtctatttttgtttttgctgcctgcgattttgaggttttatccaaaaaatccttgcctggatcagtgtcatgaaatatttcccctatgttttcctctagtagcttcatagtttttggtcttgcatttaagtctttaatccattttgagttgatttttgtttatgatgagagataagggtctaatttcattcttctgcaaaagtgtaacattcctacctttgaaaaattagagataaatgagtggaacatttgcttttggatttttataagtggaataatttattcaaattgtcagtgaaattaaatattgtgggcttagaagtcaaacagatttatctttaaatcctgactctacctgtcacttactattgtgcaacattggacaatttatgtaattctctgagttctactatggcaaacttagagagtcaaaaatgaatcttaaatgagggaaggctctttgtacattgtggaacacagaataactacttaataattatgaatagtggtaataataaatattaatagtagtaatactactactataataatgactaatgttattgtcagtattgggttaatttttcactttggttaagaagcttggtaaccacagagcttttatgactaggagcatgattgtttgttttaaacttttagttattttcaaaattaatataaacaccatctcacttaaggcagactgtaaatgtctaatgtattaaagccttacgcaaaacaatggttggaggtaaaactgaactgagtatgtcagagtagaaaatctgccttgtgagacatgtaggacattgtaatgaagcgaaatttggctccaattttctggaattaagtgaattgagtaaagtagccaagtcaccattatcagtcaagagaaagtgtacactttgggataagggggtgatagagaatcatgctgtatttctgccattgaatacaaactgtatttttactagctgtatttttagtttaaaatttaaaatataaggtaatctgtctcagagattaagtcaacaagcatcttaacagaattattctaaaatgatttctttaatgatcaatttgaaaatcaagtcattgcagtaattgaaattacaacatgtaacacatagtggtggtgtgagttgctgggtttcaaaggactaacagtaacatcatggcactcaatgtatgccctgatgatagggttgcccagggtggtgaggaacttgtttatagtgtattcatgctgaccttgttggaaacaaatgagttctgagaaatttcaattatttagtgccttgaaaggtaagaaaaaaatactttaaaacattgaattgcaattagacatataaatatctgacattttttttctcagttattaccctgttttgctgtttgggcatctaaacttcagaaatagagttagttcttaatagatcaggccacatagttcttaaattatgtaatgaaatgcgtacggtcttatttattctcaggcaaggcactttacgttagttctgtgaaacttcacggttttaattccatgatatgagagaggaagcttacaggagaagagcttgatctggattcttttggaaactgctctatttttagttaggctcacgcgtaaaatgcatctctagagagctgaatgacttgaatagttgaatgggagacttttaatattgacgttttggaagtggatgaacacctaaaagaacaacaattttctttttcctcaattaatataagcctgccccatctgttaacatctaactagtgatttcaagagctacttagcattgctcctagtcaatgacaatgaggtgagagtattagttaaaatggagaatactagctgtatttttagttttagagaaaactccatactgttttccctggctatactaatttacattctcacctacagtgtaaactttgggaggctgaggcgggtggatcacaaggtcaggagatcgagaccatcctggctaacatggtgaaaccccgtttctactaaaaatacgaaaaaacaaacaaacaaacaaaaaaaacagccaggcatggtggcaggtgcctgcagccccagctactttggaggctgaggcaggagaatggcatgaacccgggaggcggagcttgcagtgagtccagatcacaccactgcactccagcctgggtgacagaacaagactctgtctcaaaaaaaaaaaagaaaaaaatgtagtcccttttctctgcatcctctctagcattttgttattttttgtctttttgataatagtcattttaactggtttaagatgatggctcattatagttttgatttgcatttccctaatgattaatgatgttgagcattttttcatatacttggccatttgtatgtcttcttttgagatatgtttattcagatcacatgcccatgttttaatcaaattattattattattattattattttaagttccttgtattttctgaacatttgtccttcgcttgaagcttgcaaatatttactcccattcttcaggttgcttcttcactctgctgatcatttcctttgctatgaagaagctttttatttattttttgacatagtcccatttgtgtatttttgttgtctatgcttttgaggtcttattcttaagacctttgcctagactcgatgtcctgaagcaattcccctcctttttcttctagtagttttatagtttggggtcttacatttaggtctttaatccattttgagttgatgttttgtatatggtaagatttagagatctagtttctagaaatcctgctgggtatttattcaaaggaaagaaaatcagtatatcaaagagatatctgtactcccatatttattgcagcactagtcacaatagccaagatacggaatcaatctaaatgtccatcaacagatgaacagataaggaaatgtggtacatatacccaacagaatactatttagccataaaaaagaatgaaatcctgtcatttgtagcaacatagatgaacctggaggacattgtgttaagtgaaatcggtcagtcacagaaatataaatactgcatgttctcactaatatgtagattgaatgcataaaagtaaagagcaggattatagttattagaggctgcaaagagtagggatgagggaaagatactgaagggttggttaatggataaaaaattatagctacataagaggaataagttccagtgttctatagcactgaaggatgaatatagttaacaataatttatggcatattttcaaaaagctaaaagaattttaaatatttccaacacaaagaaataacaaatgtttaacgtgatggatatgataattaccctgacttgatcattacacattatgtacatgtatgaaaatatcactctgtatcccataaatatgtaccgttactacatgtcaactaaaagtaaaaggaaaaaaaaaacgaaggaaaattaagttaccatctgaatgacatttgggcaaataaatattttatgggctatcttccctttccacatcattgtttttagactattaatatttcctcatgatttcatgatttaattcaaaggaactaaataatctattttagaactgcaggaaaaaagttagaaggcaattgacaattggtaaatattacaatgtatgtaataaaagataaatattattgttcaccaaataactatgtcgctaacattaattttggccagtgattcctttgttttgtatcaaatgctaattataggtctgaatttggcaaacagttttaatttcctcatgactatttttgtcataagattgggatagctatagcagagttggttgatgtgaaaatacagtgtgaaccttgttgaaaactggtttgtggttttgagggaatatctaaattggccaataactttgcaggattaaattttatctttatgtgggctggttggtagttcttagctcttagccagcttatatctgtggagttcattcagaaaagttgttaggcaagaaataggatccatggtttgggcagaatcttaacaattgtggcagcaacaggactaccaattttctttcttataggtattaatcaaatatttcacaatagatggatggagttgtcctttgaaaataactcggaattagaaacttttaagaggctctgcaaggagtatgtctgtgtgaaagagctgtggactgtcatgtcctcaatgaagacttggatgtctgagttcccaaatggatagacaatactgtaggccaaggtgactgtgaaaatcatttattgcttcccctgacatttgatcccaaagttgaccattcagtgcaaaagaaaattagtgagtgatgtttttggttaaaaatttttattatagaagatttgtgctacattttcagattgctttcgctgatttccattcttagcaataacttaatagctttgactatgtcttttaaagtgcctggaagtcttttttaatcaaagagatcagatgttaatgctcacatttctgggcaaggctgttcttggcatgtttactattgcctgtgacctgactgagggcgaaactgatctaaaacatgagtgaaagtagagagtgggcacacttcaggcctctggagatagttcttgaaattgagatgagacctaattctctcctaatatgtaagagttgcctgagagtaagtgatttaaattccaaataaatgtaagctttatgagacagtggttcccaagagtttcaattataaaactcccttattaacatgataatcaattttgctttcagtattcattaattgatgaaatccacaacagaaaacctccacaaatttagtaacattttaaagtaaatttatatcatttattctttatgtctgttatattgtctataaatcatacccctttttatagtccttcactggtgtttggaataaaactctttattgtagtcttcaaggtcctatgaaacccatcccctgcctacctcagtgatcttattctcccatcccattccttctttctcactgtatgcttcaaccatacaggtctcctttctgatccttgaatatatcaaggtcattccaaactctacacctttgtccttgtttttacttctacttagaatgcttttcctcgtcatcactgcaatagagaagacaatggttggatctcattgtcatataatctttatttcagagaggccttcctgaccacttaatctgaactagccttccctacaccttgaaataaccctactgttatttacatattgctagcctactgtatggtaaccataatgtagaatatccttttattagcttaagaaaaactaatgggggcctatttattaacagtgaatagtgctggctcccttatttgagaagtaggtatatgttttcctatactctaaaattgcccatttttacctaagattgtgtagaaagataatttctgtcaagtattttttctttacattcagaaattttctctgtaataagtaaatggggaaatggattttccaatttatttttctaaaattgaacatttgaaagaactattgctaatcctggcattaaattatctggggatattataccacctcatgaaatttttaaggaaagaaaggattatcatgttggtttcagaatttataaattaagttacactaaattcttagggtgttagaaaaatactctatatccagtattgtgctggagccaacttgcactggctcatgtaagatctgcttgttaatttccaggaactttgcaaacaggttgattttgcatgaaagcttgaaattggccatggtgggagtatttacaccatggaaattggcaaacgctacacaccatggcttcctccgcttttctccacccaagccagacagccagaataccagcatatcattatatatagctaatatttcagaggctgacaattcaatgatgacaaaggaatagggatagctcaaatgagtcaagtcgcttttatgggtgtttagatttaaaaagccacacattttgggcatgaaagaaaaagatttttaaaaataaataatttgtacacaaaggcagatagtaaagattaaaaaaaatcatgatctttgtggttgcttcttatacctcccaagtcaggctgctgaattatttcaaaatattgttaaaatatatactctgggttgagcagatggctaccttctggtacttgtgatatcggctttccccaactcccatactaataacacaactcaactcactgattttatatgcattatatcttagttacagtgagtgtcttagaccatttctttggggaaagaaagggattcaaagaagaattagatggaggccctgattaattatagtctataatgttggagaaagtaaagactaatgagagttgacctaaggttttcagtcctcaataggaaaggacttaaaggaaaattacatgaaaaggcagggctttgagtattattctctgacaagaccatctttggggttgtactacacagaggcacaaggtatctatcttgctgcgagagcagagacaaattgtgacaattcagaaataatgctatttggcaatatctgtatgaaggtataaatagtaagatgtggtcctatattgattagtttcttttgaagtgacacaacagcctatatggaagcctccagtttgtttcttcagagacctgaaattaaatgtcctccatccaaaataaaatttgagaaacaaaaacatcctgaaatcccgtccttcccatcccacactctacattcagtgataaacagttggaaagtttggataattctaaggaattgtgttagggctcattgtttaatcttttgcaatatcttcatcaaacagattaataatcttatttatgagaggggagaaagcgacttcaatcatgtttggatggcgctaattataattatgttcttggaagagggcttcatttttaatcttgctgaatttctaggacttaaatctttatagggtactattaatacttcctaaaggataatgtgtcatctgtatgtagctgaacaagttgtggttcttgattagtttttattgtacaagaaactatgaacccatcaaatggcctcactctctgacaaaaaaaaaaaaaaaagaaaagaaatttttaggaaagagaaaacgtaatgcaatttgaccaagattaattttctgaatgccaaataagcctagattcttggaaaattaatcccagaatagtagatctcaggagtcaatatgaaggtgccactgctattcttgagaccaggagtggtgaaggtaattataaggaggggtgaagataatactgcaattaatactgctacaacctttatcccctaccatttactgaaagtaacattttattcctcggtcttcacatataaacctattcagctgatatttttaaaatatcattttgtagatgataacatggaaattcagaaaagtaagacaacccactcaaaatttttgaggtgtcagggctaggattgaaacccaaatatatgtctcttcaaaacctatgtttttgtttttgttttttttttttaacattttagtaggcacatacattcttactctaaaatcaattttgtatcctgcattttcacttaaaaataatagaagaatttcctccatgccattaacactcctcataaacaaaattttaatggcagcataacgttccactctaggattattcttcatagtaatgaaatttcaattgtttttatttttatgtgtatctttgcactacttaaaactgaattattacaaaacataatggtgaaggctaggctggttagactgaggtctggatgaaaagcctcccagaaatggggagggaagactaacgctttagtcagtgttcactaccgcaggtcactcccctggaagccacttgctaaggaaatgaggactaaggtcagcttgtatttaattttttaaaaattaagacttttaatatgacattccaaatgtgctgcctcctctctggattgctaagttctttgctttcatcttatgtggcttctgacttctctgatagtgctctgattgtcctcctcctgataaaatatttcttaatatttcttccactttgattttgcattcttagaaagtcatttggaacttcttatcccagcaaataaatatcccaatgttttaagttctgctaaaactttctcgttaaccactgaattccaattacaaaatttatgaatatgtttcctactgactacctgtattgaatcccatacctaaaacatgttgcacttcaaacatcttgttcaatagagttgtatctgcctggttacctcagtctaagctgcttgaagaaagaaatattctctaaaaagcatgggacatgtgtaaagaactgttgcatttctaccagttgtttcaaatagctaagtaggaatccaattcttttttaatccaaaatattacttgagcagtattatctcccaccatttactgaaggtaacattatattcaccagtcttcacacataaagctgttaggttggtatttttttaaatactatttatagatgactggcatcttagtagacactgggcataaaataaagaacaaatttaaaatgatccctgcttatgtggagcattaagtctagcagaagaggcacataaaaaataagtaaacatttttttctataattgtgtatagtacaatacatccctgatattcttttataaatataaacagtagtaatagtatttgttctggaatgttgaaattttattcatgtttattcttaaactaaattacaaactttaaagtatgtatccattggttttctagcaatctttgtgattaagaaaaagtctaaagcaaaatggacttgtatgattttgttggttggttggttggtaggtcacttattcattaaatgatagaatacttaaaaaaaattcttagtgcctttttttttttttttttgttttgctgccatggacatactttgttctccagtcttccagaaaattattggattcctaacaagaaaatacatttgtggtgtgccagagcactctatggcgctgctaaacctcacaaactatgaaagagcttgtcagatgtgccagtaaatcttccctctcttgccataggtccaaggatcttataaaggaagctatccttgacaatgactttatgaagaacttggagctgtcgcagatccaggagattgtggattgtatgtacccggtggagtatggcaaggacagttgcatcatcaaagaaggagacgtggggtcactggtgtatgtcatggaaggtacggtttgtaactccaatcctctgacattcaaatattcttttttcatcttatcagctgcacacagatggcaatgcattacatggaaaattccatttttccttcttttattgagaaattagtttgagaagagttgaaacactacttagataaagtggttaactaattatgggaagtgtttgtatttagagtattaatatgagaatccagtattttttcagacatggaaaagttaaaaatgtgaaaaaagaaatatagtttattacactgaatattcttcatgcagtcaggtcactgagcaaacatacaaagcttcagcagaagctcaagatcactggaagtatttttggccgataatttaagcatcttcaactctccccttaacttttaatatgtgactagttttcctgctatgaagcttctgtaaaaagaaaatgtttttcatgtgtatgacagaggcagacaataaaggttgaatggaatattacctgcctaattaataggaatgatagcttgtttcatacatcctgtaaagactaatatagaaagtgttttgaaaaaaactgaggcacgcactgtgtaatatgttttatgcctagctaatttttcataatacttctttctgacctgaaatctatactgacatgcttttcttttgtgggaagaaagtagcttgagataatgactgaatcagcttggaagaaagtgagtgcagaaatacctataatgtaagatggtgacacatgaaaaccagtttcttaggtggtgattaatgttttatccaaaacatttgtgtgatagtgtcctataattatcaaacttacaggtcattcagagaagtggtgtatttgggcaagtcacttaatttctctgtttcacctaaccaatttgtaaaaaaagaagatattctttctttctgccagtggttttcaactgatgatgattctgtctcccaggggacatttggtgatatctggagacatttttggttgtcacaaagggggtgatgttggggggactgctgacttctagtgggtaaaggccaggcatactgctcaaaagggtagctgcccagaacaaagatttatctggcccaaaatgtcattagagccaacgtatgaaaaatcctgcattctgccttctttacacgattggtataaaatgagataatttgtataatgtttaatgtaaagtatagaacaccacaacataataataagtattatttctattaaaatcttgacagtatataagaaatattctttcttcattcagcatgcaccttttatttattctttgtcatctttttggatatatgttaggcattcagtttttaagtagtaatttctatcatttttttcccttatagttttcaccttctatgtcaacaatataaaattcttcccaggccaaaaaatataaatattcatttagactttcttctggtgacaaaacacaataaacaaaaatacacataatgtacacttggcagagaattgcaaagaaaagagatgaaattataggacaaggctatatgtggatagtgagcagaaaggatggaaaagtggcaaaaatatatagaggtcaagtatagaatataaagatagaggcaatatcttaagaactactaacaattagaaaccacgtttaaagcacttctgagattatatcaatagcttcatatgatattatttttcagatattatattggtcagcaccttttaataaaacagctattgtataaaggaaagtatacttttacttcatctgttttccagtgctaattattgctgtttcattcaagaaaccacaattttgaacacctgtggattcaatgttccttcatcttaaatatttcttacaaaagtagatttccaaacaaccatggacattatttctaaaatttattcatgttgtcccttcttactaagcctaactgaaagtcttctagctatattggaagaagcttgggaataatagttaatatttgttaatgtttagaaaatgcccaacacatagaacatgctttttctaaatattgtttacatataaaatttatttaaacctcaaacaatactgtgaggtaaaggctaatatttattattccattttgtagatgaggagactgaagcttaatgtggttaagtaatttgcccaggtctcccaactagtttatagtagagtcagggtttatacccaggctatttggattcagagctcaaactgttaactatggggctatgtattagtcaggactctccagaaaagcaggacaaataggatgtgtgtgtctatatacagtgagaaggagatttattttaaggaatttgtttatgtgattgtggaggctggcaagtccaaaatctacagggtaaggcccattgatcagagatgctgcaattcgagtctgaaagccgtctgctgacagaatttcctctttctaggggaaagatgggacttttttctatttgactgactggatgaggctcgcccacattattggagggtaatcagctttactcaatgtctattcgtttaggtgttactaaaatatcttcaccaaaacgtctacagtagaataatttttgagcagctttctggtattgtgacctatccaagttgacatgtaaaattaaacatcacaagtcaatcgaccccttgtcaccttggcacccatacatatcttcttaaaccatatttaattttcaaataaagacaagaacaaggtcatacttccacctaacatgattcaacaaccctgtgtacagctgcaaatttactaaccctttccccaaaagaagacacaaagttcttgggtgatgtttactcacctcattgatatcccgtagcttaaatactatgatgtgaagttaacaatacttaaatactatgatataaagtcaatacatcttatgctgcatgataaggagataagagaaggaagcaaacgaagttatttgatgcaagcacacacacacacacaaacacacacacccgaatgtaacaaaataagaaagaaatactcatgataggtgatatttcttccccaggtaagtatactaatattttccccattgcttcacgataattttaataaattttctttatcttccttttattgctagattgactaaacagcacgttatcttaattatccttttaaaaacagggttctaaataatatatcaatattcagagtcacagcttttgcaatgatgttgactgccttcagagtcacagcttttgcaatgttgttgattgccttcaattaaactcaataaaatgactacaattttataacctgatgccaatctttccctaaatggtaattctagccagctcagtgtaactttagcagatcttgtgctaatagccttatgtcaaaataatttaaaatttaaaaaacgatcatttaaattttaaaaagttttaattgaggaaatgtttcattgtatcattagttcaatcttctcaaaatttaggtagcaatgttcttgctatagatggattctttgttatctgtgaacattcatatttataaagagtataccatggtaataatgaatgaataggcagtaaaggatcttccacaagcttgcttactatcaagatattcagcaaaagacccagggagtttatgtggaaaatcagtccaattcttcctgtctctctttagtgaaattaagtggtcttcataaaatgcttaacatgtgccttacatatttttttttgtttgcaccccgggcagtgttccaagtgttattgcatacctaaatgccagaggttcttatggttttaacaaagagaatactcatatggtaagactttgttaattacgatgactggggaaaagtcatctgggtgtagtatgcagacattatcatgtattttcaagcaaaatgagttgtgttgctttcagatacttaaaagtgctacctagtagaagtttcgatttcaagttttgatcaacgttgttttggaattaactttttaaggcagtagtgtaagtagattatattgcttaaagctcgttttatgttttaattatgttagtatattttagtgagtcttacagaatatttggatacagtttattttcttaaacagatagactttggccttaattatgaggtagcatgtgttaatactcttatattcttgttctccttttttattatacagataaacttcagtctacattcattcaaaataaaacaaactttgacttagtgatttataattggtgatgcattatttggggtgaattttacctaatattctagtattggaaatgtctaatttatacctattataatgattgatttgcttagagatattggttttgttcatattttgtgatgtttcatggtggaagcagataaatttcattttaatttttaaaatggcaagtgtctgtttagtgtcctttgactattggttattttaagttaaactttttcgatgaaatcatcaattttttttttgcatttcaaattttatttttgcatttcaaattttatttaatttaaattaacttgttttgttttattcatttaattgatatacaatagttgtaagtagtcatgtagacatggtggtgttttgatacatagaatgtatagtgaacatatcagggtaattggcatatccatcatctcaaacatttttcattttctttgtgttgggaacattcaatatcctccttgtagctctttggaagtacataatatattatcattgtctgtactcatcctacaatcctacagaatactagaacttaccaatttttttcatgaggtgtttgttaatgataataacttttgttagttaattatatgccatgtactgtttagtcactttctaggtcttaaatttttaattctcataatgacattaagaggtaggcattctgttatctacatgttaataaatggtaaactgatgcctggagaagttaataacttggtcaagactatgcaatcagtatgttgaaatacacgtcttagccttggagtccccatgcctaaggaatgtgcggtgctaacttttgaagtacagattagaagtactgttgttacaagtttattatgtatattcaaacttgaggagcccataaaagatgcatagctttaaaccatgagattaaaaaatgatctgactatttgcaagaaataaaacttgaacagcaatagttcaaaaagaaaaaaaattcaagatatttcctataagtacttcttaggcctctctgcatcctttgaatattaaacttcatactgacctctctgtagatcatctggcatccattcctcttctcttattagttccttttttcttattgaaagaatggctatgatttggcttaattcttggtccacctctgtgtccttatggtttagaattaaattccaccatgtaccttggaggccttattttctatctgcaatcaatagcattgattttgtttttctcacaggtttcatttttatttttattttttaagaaggaacaattctttcaagttattacacaaatgactcttttaatggagcatttgtatactaactctaagtgttatgtgattattcacatctactctcaaaagactagactcatttctgttgttattgaactgagacttcacttacaaagatttgcttcattttccagtaagttggttgatacagtgtggtctgcctattatgctgatgttcaacactatttgttattcagggtggacatgaatcatgctagccaccgtcgacagtaaacttataccgcttcaaactacaagttctattttccctccccaaacattttttactgtctttatacaattaaatgatgtaatgaacattgacattcaaagagggattttatataaaattgaacattaaaaatgagcctttcgatgtcagatggcattcagaacactacctgagagtgtgaaggaattgaatgcattttcatatggattagctctcagtaaatttaacatgagaaatgggccattttattctttacaatcagatgttgccttttggccttatgagtttttcgtgttaatccaaaagctatctttagaatcgttgaaatacaaatgtacttaaagttatacttgcaattcctttatgggaccaagcttataatgttaatgttaaagagaaagcttgtgtactacttatataaaaacaaaacaaaacacctgattataagaggttatcacaaataaggagagtcttgaagcactaaatgtgaatattaaaatatgttttagttattgaggcaatggcaaaggaagggatgtgaaatatttagatgccatgtggggtatcgtgttcattttggggtgccatgcttcagaaaggactttaatatacttgagcaagttcaggaggcataaaatgtatttaaaataattgataatatttcatggacagatttaggaagaaaggatgactgtttttaagtgtgaaaacatggtcacatggaggaaaaaagggaagcattctgcataaatctagatggccaaagaagaaatgcaggttatagtgaagtctaaattgaatcaacttgagaatcaacattttgctaattaaaaatggaccaaaagtgaaatgggcagcctgatggtgatggcaagaaccttatctcctgaggcattctagcagtgactacatcgcatctgcttagagaaagtttgtgtgggttgaggagggattccttgtggctgaaccataacatatctcttgtatcttctgcaaactccaagactctgagtctgtgaatctgtgaactaatactctacaagttagcttataagagcctagccctcaaaagatttcttcttggaaatcctttcccttatgtaatgtatgtgtttagttttgaatattcttttacttatataaatctaataattttgcacgtattcttctaccacttgtttttgctcaatattatgttccattgtataacccaatttattgatactttctgctattgatggtatcctgaataattttctgttattttgctctctcaaattgtgcttgtttaaacagtgttaacggtgaatccttataaacatgttcagtaatttctctagtgtatatagatagaagtagaattcctgggtcttaatgtatgtgaaacttcaaatttgttaaataatatcaaattactttccaaagtggttttatctgattatacctgattgcaacttatgcctaagttttctgattgtctctcatatccaggacaatttatattgacaaacatttaaattttacctatctggtggatgggaaatggtacctcgtgatcttaattttcatctccctaggtatgaatgaggttgtgactatttgtgtttcttccatgaaaagtctgttattgtcctctcccttttttactgttggggggacagctttacatacattggaacttaatccttattgaagttacatgtatgtatcagtcttcctcttggtttgtgctttttgtatgtttttaaagaaatcctcttaaccagtgttcttcatgctcgtgtgtgtgtgtgtgtgtgtctgtgtgtgtgtgcatgtgtgtgtccatgaaggtacattcatagcttagttatgtgaggttcatggcttagattatctttacattgataatcgaaagagtaattgtccttttcaaagtaggaggcttgaaaagccatacatttttgcttttcttttttcaatatattttaagaattctttataaattgtccttcgggacagtaaatatgcttttgaaaatacttgatgacagcaatttctttttctgtgagagtggattttatatttggaaataatcacaagtcatttagtgacagatttgatgaatagaggtaggtgattaagctgactaatacagttttttttttggctaaaatatataagaatgtgtgtatatgtaccattagaaagtaatggtatttgttgtacaagttaagaattgaccaggtgttttactctaaaacatcattattgaaaaagtgacatattttgaagggtaatgttcttaatactcatctggttaatacgtccttgtgaaatgtttaaaaatatagccttatctcattgtggttctactaatgtacagttctccaattttttctaaggtattactggtggaaatgagtttattacactaggaagaggcatagtgtggcttttcttattttggaagcttcctgaaagctaaaaagtttgaaaattgctgtacttgttttgagatgatggttgaaatgccatcttttttttcaaaaaatcaatgtgacattaataaggcaaatcgtaggtcacattaaaaaggtacacatttttcccatcttattcttacttcaagcagttatttattttatttctatgctttttcattttgctaagatatcaatctctccattcttcactttgagagaatggcagattggaaactttaaaagtgtatttttttggtaaaaattagaaacaaaacagcatagctgaaaaagtaaaaagtgagaaaaaaatgtggattagtacttttttggcaatggtgtaataacacattgatttcttgctaatgaggtaaaatttacttcaaccatcattacataactgttgaagagtttgcatgctgaacacttcacacaatctacaattgttatgtgttcattttaaaaaacacatagatatatttcttcagggactttaacatgattttcagtgatttctttgtggagctggatagactaatgcttttaatatccatccctctaatgagaaagccttgaatgtttagtaattgttttggcacactctccaagggcaggacagataggagccacttcccagcacaggggagcttactggtgtggctaccatggcaacagcctaccccacccccaccacagagaacatccgaattggtctctgaagttcttatttgaattctcccatgtctccacatttgagaaacacaggctgtaattgcacctacttcatctgaatttaaccactgtagctttggaaggctgcagttttaatctgatctttatatttaggcccttctataaactcctttctgataaaatgaaaatatttttgtgctaaggctccaaaagtagtacacagagatttagaattatggtggatgacgtaaaatggtattaaaatcaatctgagaattcacactttatgtgtatttaaaataccaaggaattattattgagtatatagttacattaatgatttgtgtagaatcttttatttgtctaattcatccaactttactgaagtggatttttttccttgtatcacaaaacacccataagttattcataagaatatataggaggagatgcttttattttattttaaatgttattttattagttttgagacaggatctcactctttcccatgctggaattcagtggctggatcatagctcactgcaaccttgaactcctgtgtttaagaatcctcctgcctttgcctcttgagcagctgtgactacaggttcatgacaccatacccatctatttttttggattttttgtagaaatgggctctcactatgttacccaggctgttcttaaatttctggcctgaggtgattcccttgcctcaggctctcaaacttttgggattacagaaatgatccaccaagcagacctgcaaatgcttttaaacccgaatagtaatcccagctacacaggaggctgaggcaggagaatctcttgaattcgcgaggcggaggctggggtgagccgagatcacaccgctacactccagtctgggcaacaggagtgaaactctgtctcaaacaaaaacaaaaagaaaaacagaacacaaatagagtatttactttctatttgctgttcacggtctgtgtagttgaacaagaacagttaagttactctgtacactgttcaatttcaatataaaagctaattaaattactttagtcatttattaatagcaaagctttattagaaaaagcatctggtcaaggtggtcaaactcctatgaagatggttttccatttcacaaatatgggagggcagccaagatggccaaataggaacagctccggtctacagctcccagcatgagcgacgcagaagacgggtgatttctgcatttccatctgaggtaccgggttcatctcactagggagtgccagacaatgggcgcaagacagtgggtgccgcgcacccgcaccatgtgcgagccgaagcagggcgaggcattgcctcactcgggaggcgcaaggggtcggggagttccctttcctagtcaaagaaaggggtgacagacggcacctggaaaatcgggtcactcccaccctaatactgcgcttttccgacgggcttaaaaaacggcgcaccaggagattatatctcgcacctggctgggagggtcctacgcccacggagtctcgctgattgctagcacagcagtctgagatcaaactgcaaggccgcagcgaggctgggggaggggcgcctgccattgcccaggctcgcttaggtaaacaaagcagctgggaagctggaactgggtggagcccaccacagctcaaggaggcctgcctgcctctgtaggctccacttctgggggcagggcacagacaaacaaaaagacagcagtaacctctgcagacttaaatgtccctgcctaacagctttgaagagagcagtggttctcccagcatgcagctggagatctgagaacgggcagactgcctcctgaagtgggtccctgacccctgacccccgagcagcctaactgggaggcaccccccagtaggggcagactgacacctcacatggctgggtacttctctgagacagaacttccagaggaacgatcagacagcagcattcacggttcacgaaaatccgctgttctgcagccaccgctgctgttacccaggcaaacagggtctggagtggaccgctagcaaactccaacagacctgcagctgagggtcctgtctgttagaaggcaaactaacaaacagaaaggacatccacaccaaaaacccatctgtacatcaccatcatcaaagaccaaaagtagataaaaccacaaagatggggaaaaaacagagcagaaaaactggaaactccaaaaagcagagcgcctctcctcctccaaaggaacgcagctcctcaccagcaacggaacaaagctggacggagaatgactttcacgagttgagagaagaaggcttcagacaatcaaactactccgagctacaggaggaaattcaaaccaaaggcaaagaagttaaaaactttgaaaaaaatttagacgaatgtataactagaataaccaatacagagaagtgcttaaaggagctgatggagctgaaagccaaggctcgagaactatgtgaagaatgcagaagcctcaggagctgacgtgatcaactggaagaaagggtatcagtgatggaagatgaaatgaatgaaatgaagtgagaagggaagtttagagaaaaaagaataaaaagaaacgaacaaagcctccaagaaatatgggactatgtgaaaagaccaaatctacgtctgattggtgtacctgaaattgacggggaaaatggaaccaagttggaaaacactctgcatgatagtatccaggagaacttccccaatctagcaaggcaggccaacattcagattcaggaaatacagagaacgccacaaagatactcctcgagaagagcaactccaagacacataattgtcagattcaccaaacttgaaatgaaggaaaaagtgttaagggcagccagagagaaaggtcgggttacccacaaagggaagcccatcagactaacagcagaactctcagcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctaaaagagctcctgaaggaagcactaaacatggaaaggaacaaccggtaccagccactgcaaaatcatgccaaattgtaaagaccatcgaggctaggaagaaactgcaactaacaagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagtgacacacataggctcaaaataaaaggatggaggaagatctaccaagcaaatggaaaacaaaaaaaaggcaggggttgcaatccatttcacaaatatgtaatggtatgtttattaaggaaaaccaaagcttcccacaaaatcataaatgaagtcaatgtgtataaaattttccttttaaaattgagcaggcttctttaaaagatcttttattccccattggaaaaaagaagggtgtgaacatttgtttcctacagagtttaattaatagcctattgtaataactttcacttaaagccattcacacatactcaccaaataagtttttttttttcatttttatggctggaagaacataattcaatgttacactttatattcggatcatgcagatcatatttacagaatattattttacattacttttctattaccttgcatttcgtcttgttttagaatatttaataccttcagcaacattgctgatacagatttatgcgatccttgatggttcactcaatgacggtacatgccctcaatttaaagccacttaaaaaaaaaaaaaagatttgtaataacttgctccgatattaccagtgtgaagatttttattgactcatccttttggaaatatgcacgtgcaaatgtttatactttgtgccaatatgtgtatatgaatttacatgacattgccttttccctgagtttatatcatatttcaggtaacggtgggttggtggtatagcatgtaaagaatgttatcaatgattaaatttaaatttacaagaaaaacatgattaatagcgataactataggtattgatgataaagctcccaagtaaattaaaaatgagtctttaaagaaaccacaatggtttttcagcatcattttgcatactatcctcttcaaagaaaattaagatgccttttatggaaagtcttgaaatttctcttcatttaatcctgtggatttaaattatttatttattacatcaattctagtactcaaaggcacatgaaataggaaaaatattttggaaaatttttcttcatgttgagtaaccagttacatctatacaaagcaggcattactaaactatggtctttcctcttctcttagatggtgtgtttccacctgcagaaagggtggtagagataaagcggggtgtgactttgacaagcgtattatatgaatatttgaaactctttgtatattcctcaaagagagataatagcaaagaaagtatataatgaacttccttttgcaatatatagtctttattctcctttattataattcatttgattatttattagttcttacattcaagaaacacctactcagtgatgattatgtctcagtggacactgaggacattacagtgaacaacacatacacagtgtctcttctagagctcacattctggtgatggtggcaggggaaaaagataaaactgtgtacggaaataagcgaaatactttcagatggtaataagtgctatgaaaaaataaatacaacagggtgatgaaagagaatcgtggaggcaatgactgtgtgggtcagggtagacttccctgggagggtagcatttgagtttgaacctgaatgacaagaaggaaccaaacaaaagtgtgggtagaggattccagatgaagtaaacacaatagaaaggcagtaaggtacggaaaagtttgacacattaaaagagacagaaaacatgaggccaggttggaatggttggtagaggcaatgtcatacatagggccctgtaagtagactgcttttctaagagatttcgagagcattagaggagtttaagttgagatgagacatgatctgatttatgttttatgagtagaaaaatggattccactaataatcttggaagaaaaattggattgtagagtagtgggagaaaaagggataccacttgggaagccatagcagtaatcgaagcaaaatataatggtggcttgtgccaagatggcagtgtgggagatgaaagaaatgtggtataatttggcagtgcatggattagatgtgggtgtgagagaaagataaattaggaatgacttgtatgtttttatgtaattaagtgaatggtggtaccattttctgagatggaaaaaagtgagatacttcatctttgagagtacaagacaagatttctgttctgacggtagatatacattcagatatatattcctgaaagctcaattgagagatgagaatgtggaggtagtgttctgctgactaaaccaggcataggggaaagattgatgaaagttgctctcttctaattaaagtagttgttttacatacatcagattaaatggcaaatttggatatttaacagatttcatagatatggatattcataaatattttcaattctttatgagaaatatttttagtaaactgaaaattccttcctattttatgcaaactaatattcttaaagcagcagttctgaaagtgtgatcagggacacttttaggggatccttgaggtcagaagtattttcataatagcactatcttttttgtcttcttctgtctcattttctcagtagtatacagtgaagttttttagaggccacatggtgtgtggtatagcagcagactgaatgcagaaacagagaatacagctgccttctgttaagctagacatcaattagatttctccaaagtgtaaaacaatggcatgctttgtattaacatttttgttttaaaaatgtagttaattttaattaaaatgtattatttaacatgtaatagatttattattatttttaagtgaataaatatttgaaacatttctccattttaatatcaaatagagtaaacatccatagaagtaacccacgtaatcaaaagcttcttaaggttttcactaatatttaatagcataaggaagtctggagactaagtttgagaaccatggccttaagccatatgacttgagggcatatatgaccatgtggttgtttgtttcagaaagtagaatgtgattagtttaaggttcaacatatcagatactgatgtttctcctccacatcacacatatctagaaccgtgttacaaaagaaatgtctcttaaatagtcttgataaattagaagcagaaaaatttctgtaaaggctaacatttaaatctagtgcaaatagccaacacagatcaacaataggcaagtcaattccattgaagtgcttattgttctgttaattacattccatttcacagtatgaaaggtatccttgatacattttgtgggttctgtttgtacactttctgatgttcaagatttgggaattggattggattccccaatgcttattctgagttagcgtcgcagaacattgaaattttatttttttgtagttagacttacagttctaaaggaataaaggaaaacagatattctttgaattcaaccagcattttggagagaggaaatggttttatactgtgcttatttttcacttaaaataatcttagaagatataacatttcatcttttgaagtctcagtacaataacttctctaataccataatgttttcaaattaaacaagataatacattactgtatacatggtcccagtgtagtactctctgtgtatatgtaaacctacattgtgagctaccgattggatgtctcttttaaagttttcttgctaagtaaatgtttgaaatgtctacatatttctcttgtgatgcattttgcaaagagctttttcatttgctagtacctttgcttgtttttgatatttcagcaccattagcattttcttgggataagttaaattttttaaaatgctgtttttacttctttttcttggaaaaacaactttcttctttcttctcttaaaaagacagctcttatgaggtaagcaacattggaagataaaaggcttactccaacacatacgacattatattgttatgagtaattaattttagggtttgttttctatgcaaattatatagttcagtgatgccttaggatggaagactacagtgaaatgaagagagctaggttttggaacttggcagacatgaacttgaattctgattctgccatataaccagctaagtaatcttgaggaaattatctaacctttttagtcattccttcctcatttgtcacataatatatgtcaagcatcaagtcctgtgtctggcacgtaggagtggccgttacccattgatctgccctgcttccctactagattctgcactcaccacttcatacttctggctcaacttcctcgaatgctcgcttgtctgtgtgccttgtaaattttcctctgcttggcatacatgctctgaagcactattgctcttcagagttgatgtagaagttggctcttctaagaagtctgctttgacaccttctgactgggctggactgttgtctctgaagttcctaacagcctctgtgttcctctctataagcacactggtcagattgggttttgttcatttcgtttctccaatttgttaattcatgaaatgcttattttgtataaaaatcgttccagacagaatacgaagtttctattaacatggtgcttatattttaatgaggaaaatacataacttaaaaagtaaacaaatatttatagtgtgttgatataatacagggaataaactcccatgatttatggctttcaggcttgtggtcatttctctgcaagacaattgggaccaaatagctaaattttataacactcaatcagtagttcacaactgattttttcaaatgtctgggtatacacacacacacacacacacacacacacacacaaccaggaggtaataatggctatgaaaaccaaagcatggcaaggggatagtgtgacatgtgggatggggaaggaattgctatgttctgtaaggtgctcagggaaggcctctgtaagttgagcattgagcagagacatgaatgaggtgacaatagatagtgctgatatttggggagaagagcattttatgcagagggaataaatgtgcaaagctctgagtcaggattatgattggcatgttcaacaagcagtatggaagccagtgtggcatgagtggggtgagtcattgcaggggtgggggggtgggggagttgggtaacaaaaccaattaaataactgagctctgatggtattgtagcccattctaagaatttttattattatttttaaaaatcaagatgggaatccacaggaggatttgagcaaaagagcaccatgctctaagctgtggctaataagggactttcttccagcgatgtagaataaactttctggtaccaagcacacatatcagctagaaagctattaaatagtcaaagaggcagataatgatgactcggactaaggtcattatccaaaaacattgaggtggtaagaaatggtcaaatttaggaactgttttgaaagctcagccaatagtatttgctaatggattggactggaaatggtatgtgagacacagtgaggagtgaaagatgactccaagtttttggcctaaacagttggagtaatggagtggccttttacagaaattgagaagactaactgacaaaactctcagggaatacctagggtacagtaataatcgtgtgcttatttattgtatcagggattggctaaattgtggtaacaaagagctctcaaaatatgatgattcaaataagatttaggtttctttctctactgtgcaatatcctggaagtgaatggaggaggctggtggagcagctgtacctcttgtagtcattcaggcacccaggtttattccgtcttatttgatctggtgtcactcagctgttgtcttttctacatggttgaagctggctcattaccttgttgatatttatcctatgggaagggaagaaagataaatgacagggcagatagcttcatgccctaagttgcacatttcacctgccttcatcctcctgtctagtacttacttacagaaaggctagaaaaagtaatctcgacaaaggcagcgatctgtccagtaaaaaatttgtggggatttctttattgaaatgaaggacagaatagattctaggggacatttttgccatatttgtttcactttcctaagcaacttaaggtcaggaactattatgttctctctaagcccactgttccagcacacagcacatgttcagtatatgctggtttccttaataataaattaattttatggaacagaaattgttttatacttgatagtgtgtttcctcctgtgtacttctgaattaattgcacaactcattttttatattttaggctatattttaatgtatcttcattactaatgaagaaaaagtgtagcatttcaattaccttttaagtcaatgtcttaaatttatttattatttgggatgaagtcatgatgagcaattgtttatgtttttcaaagggtatttacctaacacatttgcttccaaataacaattccagaaattatattcagtgatgaaataatgagtcactttcatataataaaattgcatcacctattccaaattgcctaactctcaaaatctcatctaacactctatttaagctgaatgctgctgctgtcttcgtagtactatttagcttaaaaattagagaaactgtattcgggtttaacatttttaaacaaaaggggcataagctatataacatttaagaattaatcttggaataaagactattttgaagataaaatttaataataaaacaaattgttaagacaataaagtattttttagtaaggcaactgagagttgacacacagaacatattatgaatcttttggaaagcttggatttgtgctatcaatatgaaaggaaagtacctactttttaataatacaccattttgaaaattggccctgtctttttttccaagatcaattgatctatctgtatacctatgtctgtctatgtatgtatgtatgtatgtatgtatgtatgtatgtatgtatgtatgtatctatctatctatctatctatctatctatctatctatctatctatctgtgtatattttgttaggtcatcatatgtgtggaaaactgcacactattttccaaataccttcaatgggaatgcttgaacttctgtgcacatcttcaggcctaggtctttgaatcaaatatacattcttaatttactaatacaaagaattaaatgaagacatggatattaaggaacatttttagtctaatgtattctaagttccatgtgggtagaaaccttgttggtgttccccgatgcctagccctgagctgacacatggatggtgttttattcacttaacaaataattagcatttgaatcttacttgaatgccaaatatacttcttgacactacaactccacaaatgatttgcagtttatttcagggactacatctgctcgtttttaaaaacatatcacatacacaaaactttatttaattcttttcacatctagaattatcttcttataattataataaacaatacagcttttgaaaacatttaagcaggatgttattaagcatctggcttattttgaatattatctacctgttttccctctatgaaatttttattcatttaattgtaaaaactcacacatttagtttgttaaggtttctaaaacttctgttgaagtataataagccagagctttaaaaaattatttgtttgacctaacataatatcacttggaccatgtaaattttcaattaagatcattagagttgggcagtgtgtgtgtgtgtgtatttgtgtgtgtgtgtggtgtgtgtaaattctcaactttttaaagatagtgaggagattcacaaaactatgtgtaaaactgtcatcaatgtggaagtatatgtcattatgctcaagagataatttattgagctaatcttcatcctaaggaaataaaagaaaattagaaaaaactttgaatagaaatgtttagctttcgatgtcttctaatcacttgcctgtaactaaaatgaaacttaaacttttatcatgcatgacaagtgtattccttcaattcctcataccaaatgtatttctttctaaaaaatacccatccatatcataaaattactagatttaaaaggagctaaaaaaataatcaaatttttcttgaggtttgtatttaaaatcaggctgtatgtcataaaaaatttgaaagaactggatttcataaaaccttttactattgagagtgtttttccttatgcttaaactaatacaacctaaaactctatttttaaattaaattatttttattgttaaaaaatagagaactggttacgacttctgttcaattatctttgttctcaagaatgagggagaaagaagtatccctcaagtatatttttgacttagggaggcaattaatgttactagtcaaaaatagatcttaaatgttttcaccacaaaaatataagtatgtgaggtaacggatatattaattaacttggtttagttattccaaaatgttcacatataataaaacatcatgttgggcactataagaatatatattttttcaattaagaaaagaataagcctttgttatttaacctttatgaacttatgcttcattctctgtaaaataattaataaataatgccttcctgcaagggtgcttgtgatcatgaatgaaatatttagaattcatttgtaacattgtaaacattttataaataaatactaaattctttttagcatggtaaatccaaatatttaactttcttctcatctccttacaatgtctatgtaatcaaatttttcattatatcagtctcaagaagtgagaacttaaaattaaatagggtgaatgtttgacaattggcttcgcaaagaagaaaaagaaagaaaaaagttttgatttttagtctttgcaagtttttatggtgtgaatattcccatcatggtcaatttcaaactaccaatatgatgcctgaaaatgcagagttgctgatgtttttgagtccgttgtggtgcacccctgggtatggtcttaaagaactgcttaatcatattgataatggcagaattggtatgtgaatttgcatatcacactttatttatgatccattaactgtattttccatcagacagtttattgattgtatttttgaagtcaattctgttcagctgtgaaatttcagatttcccttcaagtctcacctttgaagttgcaactgactcagaagctgcatttgccctacttgagaataacacatcaggtgtgttaaagttcatccagtcctcacagtaacatgctctgttatacacgtgcaacctttttatttatacgttgtgagtaatttttgtctttcaatgaaagacaatgtaaaaggatttgtgaattcccattcagtttaacttataaccagctagttttctattaacttatcaataattttgcagagaaaatatgtattttacaaattttctagaattaaaaaaacacacatactaacaacgtaatagctaaattactaagctgtagtcagtatgtgttccttagccagagtcagttattataatgtacattatttcatttaactcttctaattcatgcacatattagctataaattcaaatgttctttaattgatttcctccattctgtgtgtgtataagtatatatacacacaaatacacatatatacacacacatacacacacattagtttctaccaataaacctgtagcatgagttttttcacataagaaagctaccacttttgatatacgtttgccatttatttctatcaaacataattttatactttatcttcaatttattttcaattataagattatcaaattatctgttgtcaaattgattccaatatgattatttccacccggaagataaaaacataaaacctcattcaaatcctttcccacctttcaaggccagagtcaacaccatttcctccataaaattcctgagatatatatttaaaagtaatttcttccttctcaagtctctcacatcttcttgggtaaatatatcattatactctagttgactggttctcaaaatgtgagtcctggaccagcagcaacagtatctggtacaaatgaaaattatcggggctcaccttagacctacggaatgagaaattctagtgatgatggccagcaatctgtgctttatcaagtcttgagtctgatcctgtttctgaatgattaattgcataatttagctctttatttagttgtatgctctatgaggacaggatttatgagtaattgcatctttcatatagtaagtacccagaaaatatttattgaatgaagtaatatatcaagaaatagaagtacagtttaagaaagatgggacaattaactggaaggaaaaaggacaagatattttatttgaaagcctatcatttggagaagcgagagatgctcttaaaatatcagggctagaatcaagatatatgaatacaaactacgattgaaattttgatttcaaattattaaagttaggttatttttattacattatctcattaaatcctaacaactctatgaaatagatgttagactcatttcactaatgaaaaatagaggttcagagagtgtatatttctctctgtatcagggtcatataggcaggcaggtttcaaaccctgttctctttgatgcattttgcccgtcaggtgcagagggtcaaatttcaactctaagagatagctggttcagtcaatttattcaacagacatttagcatatataaatatgagccaggcaccatgctagatgcttaacatttaggaacaaagagccagtttcctcatctgttaaatgtggataataaatgtacctagtactgtgtggagctggtgtgatgattaaatgtaacagttatcaaagcaataaataagacaatcaaaaattgtgaaaagttcaaagatggaaagaaacacttacaatgaggagttaatagaaaggttcttgagttagattcagtgtcaggggaaatttttctaaagtggtgacagggatgctgatctagaatgactagtgtcatttggccaggtgacagactaagagaagagcacctcagacactgaacctgcatatgccaagctctaacacttggagtatgatggagatggaaagtcaccagtagaccaatgtgacactaaatgcactacatactatcaaattttatccattcctaagtctttgtgttctccagataagtctataaaatgttattgatatgacaataaagtatatataaatgttccactgggagcaaaagttcgtggtaaatgtggcatcaaataagtcatttttttaagagtgaagacataaaagaaaacagaaatctgaatattttagagtttggataagtcagtattttgagcaaacctgaatttagtacaatatcctctagtttttctttctaacattctaagaataactgaggatgccagatggcttggagcactttgtccatgattaatgtgttgaactatttcctaactggattacagtggcatttcttctagaaattctcagattacattccttcacaatcatacttaccatttgatataaagtctgcaatacatgtagaatggaaatgcagtggtttgaatcactgagcaaaatggatgaatttaaagtgaaaataagttgtaataaaaaccttatgtaagatctaagtaactctttggaagacactactaactacaaatgtaaatatttcaatttaattactttttttctgttaacaaactttgcttatttctgatatgactaagggtagtaaacagtggctgctatttgctctactctaaagactccaagcctttcaatgaccacatcacatcctctttttctgtttcctgaaactagcagaaaacttgacattaataaccaccactagtgtttgctgaatgaatggttgaatgaagtagatgttaacatgtccaaccaaataattgtgaattattgttattccaactctatggaaatggaatatcatatacaatgtatttaatttttattatagaaatcctaagactgacattaattcctgatgtatatgttatgcatatatatttatactataattaatttgggattaatgtattaaatttaacctaattaatgtgaatagtatcaatatgattacatttatatttaattatttttagaaattctgactgatattaattcctaatatatatgttatatgtatatacatatatactataaccatagtgcccacaaccatcaaaaatttactgtgtaagaaaagtaaaaaatgttgtaataagctaacattgctatattgctttaaaatgcaagtttaaaatcatttgcttgtatcatcattgagatatagtatcatttagattcacataaaatgaaatggcaagggaagacagttattttgaaaaagcaacactcaaatgtctgtctgctacacattcacagttgacaggagggagaaatgtttctacgtagatatattgagtgattaaaaaatatatttacatgttaaaaactggatattaaccttaagtctaaatatgcacattatcatacatatgtattataaatcttacaggtaacctctaagaaatagttgtaaatgaggaacaatgcaattgactacaattctataatatcctccacataatgcatacatttaaaaaatattgggctgggcgcggtggctcacacctccaatcctagcactttgggagaccaacgcaggcagatcacttgagctcaggacttagaccagcctggagaacatggcaaaccccatgtctacagaaaatacaaaaaattagccaggcatggtggtgggcacttataatcccagctactctggtggctgaggtgggaggattacctgagctcaggaggtcaaggctgcagtgagctttgattatgccactgcactccggcctggaagacagagtgagaaccctgtctcaaaaaataaaattggtattaaatgtaaatatcccaaatcctttctcctatttttcaacatgtttatactgtggtggaagttggcctgagacatatctcatatatcattagtctttgtaaaatacaaatttgctagaataagataattaattgaaaaaaatgacaagataacatatatgatgtaatgaaattattgatgatgtaactatagagaaaaaaagccttaaacatatcttccaaatacactgaccttctaataaccaatataacatttgtatgcataatattagtacactagactgaataagagagcttaatgcagtaaaatgaaaactgatgctctccatttttatattgttgaaatgtagtttttattatgtatgagcaaatatattttgttacttccataaagcacccagagaagctttcactacagcttcatgagatattgatgacttgcgcttaatgatgccaaatttcagtcaaccagggattatgaatatgtaaattggtgctcagaactcagttgtaaatactaagaggctactattatcaagaaatacatcaaaaagtaaattctttggactctgtagaacatgcactagctttatccagcatctatttcaagactagtcaagaagacatctcctgcatctaatgttttgctttcttaaaaagaagtttttaaaatggattatatagaatagtagctgcagacaaaacttaaatgaagctaaaagtgatgatttagagaaggttataggataatatgttgataggtcatagctaattatcggctttatccgtacatattcgtttaaagtggtcatctaactgatttgttcatatcttcttgtactttctgacagaatagaatatgacagttggaaagcgttagtagcctgaaacccgcagaaccactggaaggctgaaagtttttgattttattcagcacgctaatcatgtgataatagattggtcattcttcttgattcctccttcttaatcaggagttacggattatggacaaataacccttacctttcagtgctccagtccctcagacacctgttaccaaaaggtgttctaggtttcccttattcaaatgatagcagtggagaagtcattctcttaagggggacagccaaaagttccagtgcttgttctgcccattactagctgtgtgatctcaagtagattacttagctcccccaagaagctgtttctttatctgcaaaatgaaaataatcatagtccctactttgtattaatagtccctaccacaaaatcccctatgtaaagtttttaaggacattgcctataaagaaagccttccataaatgtccatcttttattattttgtttcattcctctgaactctgtgagctgtccacatatctgttcttttgatctaattcaaatgagaccatagtaattgacaaggttttaatgtgttatagtctcccctctgctccatggcatttgagtgaggaccttcaaatataatgcacggggcaaatactgcaggagttttcgacaccactcacggactgtctctctgagggtacgtttatgagaggggtggaatctgtcagcactcttcagatcatcctatggagacttattctctgtacatgtaagggctgcttggttggttatgtcacctgtgcctattgtctgattcttttttacttctaacctcagggctggcctaaaggcaaaaatagttaagtagacttagtttgcttttgctgtctgcttccctcccttttaacatactttcccatataccagcatcccaaagatccccatctttgaagtaaagacagctggtgtagaagatataaatcttatttagcagacaaagatacccattgaacatatatgaaaatgtaagtatgatattctgtcatataattgcaatctaattaaatgtaatgactagctgtgtttcctttgtaaacagtgatctaagccaaatgtgtgaatttcaccctgcctgcttgcgaagcagacccctattaagatgagcttgcatgattttggagtaagtaggtctgcatacaaacagctgctgcagaaatacatggcatctctcattagggttctttctggtagcaacagtgctcctagacaaactttacttctagtcttgctgcaaatagctctttcctatatttaaatggagagattgggggagagggttcaatttgtctatttcttagaatgtaaggcagattattttatgtgttcttaatttctgtaagtactcaaaaagtggtgaaaatgaactctttagggctctgatctctttgatacatctattttattatttggtctataaagattcatttaaatattttaacatcttaatcttatttaaaatataattcttatcaatgatagcatgtattactgttacaccttggatcagggagaaccatacaaaccgcactgaggagaagaaaggattctggggcaaatatggtctcatcccaacccattgcaaaaacaaaaacgaaatcttctggttccatttcctgaaacagcactttgcaaataaagctgaccaagattattatatagaattttttttttttttttttttttttttttgagacggagtctcgctctgtcgcccaggccgggctgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctagaatttttttaattgtaatattttcctgggagtttttcttattttagataagcaacaaaaagctgttcttagaacatacagtcagaactacatttagtgatactcaccatgtgccagacactgttcttagtatgtcacatgtattgtctcattttaccctcacagcatccctaaaagagataggttctattatattcatgttacaaatgaggaaattgaggatcaggttgtcttccactgcaatctattaaaggagaattcgacacaggtctgcatgaccatggagcttgttcttaatctccctatgacattgcctcttggaggtattttgcatgtatgaaagttggattgcaacagttttgtcagtttaacaattaatcaacatcatattttttactgaaaaactacttctgatgtggcagagtgcacagttggaacaacattttttgggaagtgtttgtaattccaatccacctttgtcttgaggctccaatttcccatgactgtatgcacagttgtcattttttttccaaaataactttttaattggataaacaaccaaaagaatatgacatacctctggtatataacaccagtcctttgagctggctacacaaaagtgcttctctttttcaagttgatggtattttgagttatgtttttgtgtgtggtgttgaagactttgggatgaagaatgaaaaatctgctatggaattgcttcattctaaagccagagttcttttttgaaattttatgcttgttttagctttattaagacaaatggattatgcctgagaatggatttagttgattttagagatatcatatcaacagttccaaaggccaacaggttcctgtatcccagggcagctatggtggtatccattttactgtagccacttccctttagcaatagatctttgcatcacgtttcagccaggtctgtttgtggccaaatacatggatgcaaaccctgtcatcctggtctggggcttactactgcccatatttataactgatagcatgtcacaggggttagagtgggtaatgagacccagcttgcctaggagtgcatgtgtgcaggcctccagtgggttatggcaggtaatatagatctagacaggtaatgggtcttaacaggattttaacaaaatctcaagtggcagatttgcatgcaagatccagcaaggctgtcaggtctagagtctataaggtctgatgtcagcatgcccagcaactttaaagtccaggggacaccactcagcttggattccaacagccttcaagaattgtcgaattcatacttaggcataagtctttttcttttagctttgttttatccttgctcctgggaatgggcagtcctggcatgaaagggttgaacctaggcccaatttcagtgggaaaaaagtagaatcacaataattctattgattttggacatatttaatattgattaaaaagaatgacttctggaaactatgttataagacaaaatctggtaagaaaaaaagactaataacagtttttctggtccttttacctccttaaagtgttgctagatggaaaggggctttttggtagaaatattcaagttattatcaagaaataaaataatagcacaaccaaaataataattatcctgctttgtatgtaatgacaatgccacccaaccctgcaggctctagtgaaatatgcagttagtgctgggttgtgggaaagcatagataaacagcgcaaaaagggattcattaccgagtgaagtgaatcattttgcttttccctgacataagctgttctgtgttgtactttgcagctgcaagccttgctaattagctagtaccctggatctcatgcattaagttccaatggagctcaccttaagcattcttcttgatgctaggcaagagttttgaacatctagcaccatttctgcatattataatagctaccatttattgcacgtggtcacatttggtcctctgagaaccctatgggatatgttgtattgttgcattttataaatgagtaaatttcaatgaagagaggtaaatctacttacccaagatcaaggttatgaagcttcaacatatcaagataaaccagggacactgacattccattgcatttccattgcattttttttctacttgcctatatttatatatctgtatattaatctgaacatgtcttttaaatatgtataaatacatacatattcttactcttaaaacatgtttagtgtttctttactgttctgatgctgattctagcagtgttttacttgtctgcctagttgttagttcagagatgggcaaatctgtagcatggatatcactccttgtttatccctttcctttggcagacatagccaatcagccaatcagtcttagcagtcttcactgagccagtttcaacctcattatcttttccacccatcactctagacaggcatgaccaatagattggttttggctctcaagttaaatctctttgttattcctgtacaaacatttatttttgtctcagccatgtcttatagcacaaggatgaacaacatttacctcagtctcctctctgatatccaactcatatgacatctttacttccaaagagcaatggtaacagtaaacaagtacatttcatggtgttttggattctctcccttattatattccattttaatttaacattcacaagataaaagtcgattcatctctagactttttccataaggaagcttttattttttgatggagcaatgttcatggagaatgctacatattcactgctataatttaacaatttgttcttaccagatttgagaaattttaacctcaatattgttgctttttgttccattaccaaagtaaaatattttgtaaatttatacatcaatcagcatcaccgtattttgtttccaaacatgctaaaggctatttatctttattctgcagtagccatggtaatttagaagaaaatgaacatgtaggaagttatctatataagttgttgcctttcatgtcatttagtaatggttgtggtgaaactaatgactaatgaagggttgtttttttctttttttcattttaggatgattagccagatccaaaaatatgattttatcagcaggttatatttttatgttttgattttactatttcatatctaatctaattaggcaatatcccttagctaatgctatagacttcttaattttaatttgtgcaactcttcgacccatcttttttgaacgtcaacaagaaaggaaagccatttgttgcgtacctcacccaggtcaagaggctgaccttcaccatttttcaggcacagaaatggagctctggcacttatatcccttgggagaaacctagtgacagcaggtatacgagaggccaattgatctctcagtgtccagagaccaccagtccctttatttaagcatttaggttattaactttacaggacagccactatcctctaaaattcattttgataattgtgacatctcacatcatcaagtggagatttgaccaatatttagcttattttatcattatgggtaacattacagaatagctaaacttgcagatatttcacagggtcaagtcttggatctgaaaaagttacttaacctctcttttatcatctgtaaaatgggacaataaaaatagaaacttcaatgggatgttgtgagaattaagataataaaaaagaaatatttataagaatctatggtgaatattaagtctgcaataagttataattattttcagtttagacaagatttttattttgtaccttgactttccatacacaatgccgttctatttataaaataacaccaagttgaaataggttccacattactgtattcaaatccatatgaattgaggtttacttaattttgatgttttctctctaattctaaaactttttaaattataaaagaaaggtgtttattttagaatatatgttaccaaaaagataaacttaaaatattttaaaattccatgtagaaagtcactattttgttttgtaacctttgagtcttctcctgtttgtatagaagaatatatgtatatacttttttaaaagtgtaattacacagttcatgatgttcaaatatattatgaacatctaagtctttaaacactattttacaacatagttttaatgattgcatagtattctatagtgtaaatataatggcatttaagttatccaatactgttggacatttggtatttgagttatttcttttttctatgtatccttctctctcattcatgattacaaactactctgcagtgaatacttcttatacttatgtcattgtacacattttaagtcatttccttaggataaaaattcataaacatagaattatttcatcaaagagtatatgcattttaatatcttaatgaaaagtgatttttaaaaaaaaatgttatagaacatgatctagtgtcattttttatttccaattttgttaacttccatatgcatgttttgcttgagtacctgaataaatctttttgtatcttagcaaggactattatttttcttattctacattttttcctttgaattatatttttacctacttgtaattttctggttgtcttccaggaataaataaattatacatatgcaggatattctttgcttgtcttttatatttatcattttctctcttatgcttcccaattctttttttaattttatttatttttatatttttctcatttaatctgtttctcttggtgttttttccaacacatttcatggtgttttggattctttcccttgttacattccatttttatttaacttctatgttctctttggttccttccatttttttcttcatttctttcaaggctttgttttattttaataattctttcctgacttctaccagatcacatttcatcatctccttttgtcttaccacttcatttctgaggtcttggatttctgctttgggcaaacagtgtctcagggtgagccaggaatcggggtggggagttgagggagtggagtaggagaagaggccaagttatgtttccagactttctaattttataccatagacagtgcttctacaaatgtgcttcctctgcttgactttgtgtgtgcatgtacatccccactacttctacggtcaattatattattttctcttccattaattagctgtatgtctgcattttagagcgtgcccctcactttcagggagaattttcaccttctgagatctcttggtgcaaggcacacttgccattgcagtttctatactttttacttcatcttttgtcactcttccctgatctcagtctttacacaaattttaaagtctgaagattgtttcctacttctgttaaaaatgagttttgcaaggccctgtgttatatatatatatatatatatatatatatgtatatatatattctctttattccttttgcttccttttggatgctttccagaaagaggaagtggaaattttaattaaattaaaatgtttatatgagaagtccaaactacttaatattgttctaattatttaatcagaattgctttgaaatagttgctagaaatcttgataatcttggcttggtatgaatcaaatcatatagaatatgattctgtattttaaaaatccaaatatatgaagttcactgttaaagttttagcaagggaagctcccatctggacctttcctggaaaatgtgtaaaaggaacttttaaaactggttccacctgtaaataagggcaatgaagtaagtcccatttaatttgaaaaacttggctatttcttgagaacaggatacctgcaagaaaatataattttactacaaaatgacaacgttaaaatcttaagttgtaaaaatagactagagttatttaaaagttgaccttttttccttgtattggtttctctcagacattcagattttaccatgtatttgcttgtcttaccacccaaattcctgaatttgtttctgagtgtttggctgttaagtgaatagcttgggcaaaccaaattcaaattatttaggtagaaattagaataatttattttcatgcctcagtgatgggtctaaaatgtggcccatcattcttctaataaattatcaatattgtgaatttcctattacagttctacagacatttgttgtttctcagaacataaggctacaatgcctaaatatcatagctgatataaagtttagaatgaacaataggaattctctcctcttttatgaaaagattatttttttatgtgcttcagttccactaggatggttaaaattacccaaaacttgttagatcttgcttgttttgatttcttgaatatatttgacctatgagacaaaagttactctgctgatagggaagaaaattatgtaattaagctttcatttgtgtcatggttcttattggcacaatgctttcatgtttctgtcctctgttgctcctaagtttagtacaatgtgaatggaaaattaggagtatagaattttcctagttgatttagtctgaggctctaaacacttaatgccattttgtggcactatacgatgaacactgacaaggaaatgaagggatgactgagacagctgtgtttattggctgccctcagtcttgtctttataaaggatcttttagttataactgacctcagctagccatgggctattttttgatgacacagattctaaggagaatagcacacgtgagtaactttagaaatacatgaggcttttcatgtactttttccatcttgacaaacaactatataccacaattataggctactttatttcagagtctcttttacattaataaaaactaaacaaagtagtttttcaatgtctatcttatgtgatatataagatcatatatcatgtttaatgatcatgtatcatgttttcattaaacatgatatatgttcaagtatatttcccatgtgtcagctttttattttttcaagatacaattgcaacaaattgatgaataaaaccacgacaagaagatccttcagaaaacaactcgagacacagtcacattttaaaatgacagaatatttagtacttgaaattgtgggagcctggtgttcctggttggggtatggctgacattctagagggtgactgtggtgggtatcctaagtgtacacaaattaaaagaccccagaggataagtttgtgtctaatcccaaagaaaactcaaggcaatggaacatagttaccacattccaagggcaaagacctgggccaaattcaggcaaattcaaggctcagaatctccaaaagaactgaaatgaaaaagagcaaaaagaaaatgcaataggatgccaaatcatttatgaaggaagcagagtgtctgcagtttagcttattaagtatctcccttttgtgggagagggttgggctgcactaatgtatcactggaaagtattactctggacccagcccattaagaaagtcataacctattgagggtctcagaataacagtgctatcatgaggtgacaaggccctttaggaaagggaaatttggcatctcaagctcttctttgaggagcatgccgagatccaggaaaaaaactctctttaggaaaagaggatgctcatcttttccaggcccgtatattctttatggtactcatagcaaactgaatttccaggttttaaaaaatatttccttagtcaaaataacttcttgctcttgaaagttttgagttttctgacttctataaaacaaacagaaacatatgttcttattaggaacaaagtaggtatataggtaagaaagacacagggaaccgaattaaagaaacagtaaggtttgtaggcagacatgcaggtattttagccattttgctttatggtactacaaaattcctatgagcaaataaggtggtggagaataaaactagttccctgtggcccatggagctcacccatattttgtttttaatattaaggctctaaaacccatatttataaacacaaaatgcagaagttgcataataaactcctgtgtcccagttgtttgtttattcattcaacaaatatttattgaatgcctattaaacacatggccccatttgaggacatagcctgaatcagatatcatttctgcatagttactaatatatctggaattaaattaaaatattatgaatgtagaattataattaaaaagagaacaagactaattatataaacaataaatgaatatgcatttagagcctaggtgttgaacactgtgctatatattttgtatttatttattagctcacgtcatccaaatgactctgtaagggtggcctactgtgcccattatgcagggagaaaactgaagattatagttgtggagtgccttacctaaggctacagaaataacaggcagggtccagattttaactcagatcttccgactctttgtccagtaacctactatacatgcgccttagaaatgtgaagtcaaagcagttggttatgtgtgtgagtggttatatgtgtgactaaacacttgagttcatacgtaacaacattgttgttgtcatatctatagtctagaagtagttcatcttttgttttttatatttcaacttttattagtaactgtacaactaattacatgattacttgtctgcaagtaaataataactaaataagtgagtaaaaagaagtaaacatagaatgtaatactaaatacctgaagctggcctacagatgatggattatgaaaattattgcactgaggtctataattgagcaaactgagcaaatgaatgcagcagtattatgataaaaatctagacaatcataaatggctgctgagaaactgatgcaagaaagagattagcaaggtagatgggtactaatgggagtgagaatgcaaacatagtatggactaaatgtgaataaacaactcatagggccagtgagagacatggtatagtggaagacaggaagataggctaaaaaaagacctaaagaaccagctgctctaggttgttcctttgcctgaaatgctggacaaatctgggaagacccaggagttctctttctttgtgctctctttcctttgttcttctgattttgatcttgattaatatttacatataggacagtggttgagatttatatttttattctgtggaatcacagagctgggtttgaatatgagttttgccactgatcgacagtgaagtgcagagcatgttatttaaatgttttgaacctccactttttctttgtaaaataaaagtacaaatccttcccatattgtcattgtgtaaatatgagaagaagaaatgaaacaaagggtgtaatgtctctactatggagccagacatgttatggatgaacaataatatgtggttgttacaattattatgctcaggtgatcacactgggttcccataccttcggtctttccctggttcactagaatgctttggctaatacagtacagcaggggctggaaaatagtaggctaaactgttataccttgatatattcctcctaagatttgtttatcagtttgagctcattgaatctctgaccatccagattattaacagaaaatattagtcctcaaactaaatataactctgagaaattaagaaatttctcagaaaataatactcagtgtggtttcctgagaaccagaaccacattgggtattgttctctgagaaatagtttaccatagtggagctaagattgcttttgtttgaatctccttttttctactcaccacctgcataactgtgggtaaattatataacttctaagcctcagtttctccatatgtaagaaaagtgaaatagtgcttaccttgtaggtttgtggtgaagaataaatgcgtgtaaataattggagcagtgtctggctcatagtaagcattcaaaatataattaggtgaagttaaacttaattttatcccttatttccatccattttgttttctaactgtcaaagtaatatggtgatgattattattatgatgataatttattgagacttattagtggccagatactgtgctaaatgctttttaatgccttatcttatttaatcctcataccaaacctggatgatattaccattatcctcattttatagaccatcaaactgaggcttagaggtattcagcaacttgaccaatctacgtaagtatcagagccactactagaacccagagtaagactacagtgccttaactcaatcttataaagaagattgcttatttgatgagttggggaaggtctattacatcccctaggcatagtgagtttttccagccttcctactagaattttggatctactttaatacaaaatgaacagcaaataaagtatcattctgtgggtcatactgaagagggccctccttaggtcagtggttttgaggttactaaaattccactgaatctgtagtgcagatgttattataagaatttctccacctgactgatgatgcctgtggactagagccatgcacatatgctgaaaaacttcccatttcctcctaattctagatttaaatactatccctcaagctattgtacttcattaaaaaaaaaaattacacatagagatgtccagtatttctatataagtaatgtagggtagaattatttctatcaagaaataaagcatgcatttccaaatcatcagctttatttgccattttgaaataaaatccataatatttaatgaaacagggaagaccacatgacctttggaagctttcttagcctctctgcatttcatttttcttatctgtaaaatagaatgggttgagatgggactctattaaactttgaaattctaaaactcttgacacaaaaagttgtgattcatatatgtgactattttagaataagaaatctcaacagaaaaaaatgtagtctggacttttatttaaaattccattctaaaatattcttcagacttatttaatgtcctaccgaaagattagaaatgttactggggagttaggaaagtgagcctgaagaggaaaataatctgattaaaacatttttattgcaataaaagaaaaaaaccatgagtattttacccagtaaagagattttcatcttaaaaaggaaatgtttattaacccaaattaacttctaaattaatggattatcagtcaatatgataaagagaagtaaaaaattgtggtcttggaaaaagggaccacttggaggcaggaggatttgtagagaggaagcctagtaacatcacgtagaatggccattcatatctggaagtctacctttcaagtcattcattcattcactcactcacccattcagtcttgtttatttattgagcatttgttggaaaaatctggtctctaccaattttgtagtttagtggaggaaaacagagaagtaaaccaatcattttaatatagctatttaaatgttagaataaagctaaagtcagggttctcagttagtaaaaggacatctaatttagctgagatcatggaatctttactagggaaattcatacttaaattaggtttgaaagatgaatgggagttgacattgactagtgctcagtaattattagttgaatgacagaaatggtagagaaggaagtcatgaagactaagcgagtatgacagtttggggaatgaaggtacttgaatatagctcgagcatagagtagcttttatcagtatgcctcagaaaccatctacatcaaaatcacctggaggtactgttgaatatgcagatttctgtgtcccaccctatatacactgattcagagtcaagagtagggtcaggggatcttgacctttttaataagcattgtatcacaaggtggattgttattatatatataataatgttaagaaccactgccgcagattttatattagaaattaatgaaactacattatttgcattttatcatgctgtccttcaaaactatagatcatctgcgccatcagtgccaacatcttttggacacctaactgtcaggagttgtggaagggagctcctgtatgaaatgtttgtttgtaaattaatataaattaggagtaaattagttgttttactttgtgagaaaaagactagccttcaaaaccaaacctccaactattgattcttatccctggatccaacttccctgttgctggtcatcagagatcataagccaaggagaaaaaggttaatgttctcaaaatgtgtagtaactttactctgtttgatccatccacccacaacttttctcagcccctaattcaagccagcaaatctgcacatttgtgcctataatcacaagacagaccagatgcgaaggaggacataaattgatgacatttcttaggaaagcaacaccctaaaacttcactgcaagactcttgctggggcaggtcaggaacactgtctttgtaaattgttcagaatgaaagcagaatgttttctccttagtagtcttaaattatgaccttctattaattcaaattcattaatttcaaattgtttttcatatctcttaactatgttatcactttttctcatatttcacccctttggtaatatgtgagattatgtttaaaaaaccacatctattattctacaaaatatggtgtattttggcacacagtagaagattagtatttagtatcaaggttcaactttttttttagtttttttttttttcaattatactttaagctctggggtacatgtgctgaatgagcaggtttgttacataggtatacatgtgccatggtggtttgctgcacctatcaacctgtcatctgcattaggtatttctcctaatgctatcccttccctagcacccaaccccctgacaggccccagtgtgtgatgttctgctacctgtgtccatgtgttctcataatgaagtttctgtgtacaaattttatgggagtaattatcctctgttgaatattgtaaaacttgccatcgtttattttacccatggcctgctttttaggtagaaatgagtttcaacagtcctagaactttttgtctctatctaggttacattgaatgaaaaaatttatttgtgttcagattgtcatattttagtagtttttcggtgtgtgtatcttagtttgttttgtgatgctataacagaatactacagacttggtaatttataataaacataaatttattgactcacggttctagaggctgagaagtcaaagatcgagggcccagcatcttgcaagagccttcttgttgcatcatctcatggtggaagagcaaagaaaggatgggagagagaaagcgggaaccaaaagttcttgtataaagaccccactctggtgacaatgaaatcactctccagataatggtattaatccactcatgagggcagagtcttcatggcctaataacctcttaaaagtctcacctcttgtcactgttgcattgggattaaatttccaacacgtgaactttggagggacacgttcaaaccgtagacttgtgctaaaaccaatgccatacatgtttgcccatgcaggaaacacatagccttcagtgaagctttagaaattgatggaaacttatttgagaaaagggtgttgtatttaaaaaacagtaagttcagttctaataaatccacatttgattcttaggctgattagccactgatgaggacatcttattcatcaatttatgcttattttagttatatttgtggtataatgaagtatctttgaattggacccgttcatccctgaggcaggttagtgttactggcacttgagttacctccttaattcagttcaaacgtcagttttcaattttttaattcttttgctgtttaaaataatcaaacaaattaaagatgaataattactggctccattcctatagtaacaagtgtcacattctgacaacttcagaaacaaggttggttattttcagctttcattgtttacactcttcaaaaataaggatgagaaatttattttattttctttttattagtcaataagttctacttaggaggcataaagttctctgaacgataagttagggctcagataagattgttttaatactgacttcaatgctaacttaaggaaaacagatgatatcttagctctccatttctttaagacttaagactatggttgttcgggtatacaatttattttatgtctcttagaaaattgtcataagtcttattttacttgaagaagataaatatgatgatagtaacagaacaatcagaagtggttattcttttatactaaatttcaactaatatctattaagtacttatggcatgccagaccctgtgatatgagctggagattccagttttatagagagatacagtgtttgtggatgactttatgtttaagtctgggttgggtagaacacattttccacttgagctgcagcaggattccaactgaaaacatacttcaatcttgtaaattctaagttctagtgtatacttgatgattgaagggaaaagaaagagaagggaggatccttgctataattatggtcaagaagtagaaaggagcaggagggatagtaggaaggagaggctatagattggtctttagtaggacaaggttggtgtttagcattattgcctttgcaggaggttaaaacctttctgtatcccagatgggagttagttttatcaactatgttgaaaactagtatatatgtgtatgtatgtgtgggggagagggaagaattgcatgtatttgaaggcttatatgaattagatttatttttatatacttttacaagtaatatgcacatatacattcaattctactatagcaaaacatgtacatttcttattaccaccatgttaggcaaaattgtacaaaaataatcacagtgcttataggaagaatgaaattagggacacaacactagaaacctttgtcagtgacagataataaagaaaggaacctaataaaaattgtaccaacttttatgcatgttaattgcttagaacatacataaatactacaataactgtgatactttaccttgaaaatgccttaagtttgataacagaagtgagcatgagaaatatttgggcttgtgaactgtgaagtaatagaagaaaaatgacctgaaattcagcagaaagtttaaacttcaggtgtggataggtgtgactcataacacactgaagcagatggtaaatatttgagttataaacatgtgtatattttttgtactcttaaacagctcagttcaagttggccactttctgcagatgaaattgtgcagaagcaaatataaaatttgttttatcctcaaattgtttcataatatatgaataacagtggaatgaatttgtgtttcataacaagcataatagtgtgtagagatatatttcccttctcttgcaaagtactcaacctgtcttgactttggcacttctgttctgcttgtgttctgattatttacacttatgccttttcctcaattaggtattaagcttttctagggcaaaggctgtctttggtatggctttaattggtacagtacctatttaagtgacttacccatttataaaaattattaacacctgtggaatgaatagctgtaattgaaaattgagacgtagatggacagatttcaaaaaagcaataaaggaaggtttcaaaaaggaaataaaatatctgttggtgtgttttgagatatcgtgtttatattttatttatttatttaaattgttttttgagatggagtctcactctgtctcccaggctggagagcagtgacatgatctcggctcaccgcaacctctttctcctgtgttcaagcgattctcctgcctcagcctcccaagtggctgggactacagtgcctgacaccaagcccagctaatttttgtatttttaatagaggcggggtttcaccaagttggccaggctgatctcaaaaactcctgacctcaggtgatctgcccacttcggcctcccaaagtgctgggattacagatgtaagccactgtgcctggccaacattgtgtttattgaaagtatgcagtgaaccagaaattctacaggactgaggtacacatatgtagcatatgtgtatatactagtatatacatagtatatacactcaagacaaatcattaaaaggctatctcctcctagaatacttttagccagggtcaaattaaataaggtgtgttttttttcagaggaaaatagttaacaaaggagcagcttagcaggtttaagaggtgctattaggctggtgcaaaagtaattgtggtttctgccattaaaagtaattgcagaaaccagaattacttttgcaccaccctaatatatcaccaaacttgccatattatcctttagacaaacattcgactttaaaagtgtttccataaagcccaagctgctttaaggaatcctctcaaatctgtggtgaaagagaagacaaaggtaagagcttttggtacccttaccttcatttcaaattttgattattttgcttttattattttgtttatgaaacatatgattccctggtcatcaaaaataaaaaaatgtttgcaagtcagtagtcacagttttgggcaggatagttggggtactggtgatggtggtattagatcttatttatatggatgtgagcttcttggctttcttagactcaactggagtttgtcatatcttctccccttccttttttccgcatgataatagaactccagcagcagaggtagcatctagagtgtatggctaggaggagctgcacatatctgtcatattatagcactagtggtctaagggaagatatttggactgcattgtgtaaagcctataaaacttctggcagtcttccattcgaataaatatccaatgaaattcacagtcggatgtaaaaacctgtgagagatttccccataaattagtgtaacttaatttaaaattttctgagcaccagtagaagaattctagatcttaaaaacagtgttgtatttctagagcagtgcttttatgtacaattgataaagtatctatgaaaattgcattaaagcattcatggaggaagactctataacatacactcagctcaaaatttcagcagctgattatcctgtttacaggttattggacctttcatttttcttatgccgtcagtctttgggccatttcccacattagctatttgacaagactatccgggtagaaagttagttagacctgagtttgtcaattaggttaacagttacagtttcatttaaaggtttgatagaaatggatgttgaaacccctaagtaagatttagttatccgtagatttaatcaatccatgatcttcctcttgcaaattaccacaaaaatatcaagaatcatttttttaagcacttttggaaatgcaactgaaatcttatgccttggagaaggaggtaaggtatagcttcatctttgataagaagtgatactgaaaaatcagaagtgcaaaaagggtgacgaacatctgattgttaaagcattgttttcttctcattcctttttctggggtaaaattgcaaacaaatgaattgtacatgaaactatttgccatagaaccaattagccaaatgtctacacatgttatcagtctgaaaaagttgggaggggaggtatcagtctagttttgctgaattaataaattcaataattagaatcttcactatgtataacttagcaagtagtggtacctgtgcatctgtatgcatgactctcagtcaaatataaccatgtgttcttctgaatgctagtatccctttaactgctcttatgatataacacccattaagaatacacttaataaacatgtactatgttctagatattgtcctaggttccaggtttatatgtgaattcagatccagactctagaaaattcagagtctggaaaaggagacatgtatgagtgtggccgatttcttctctctgcctctgcagatctattttctaccattatcggctgtgttaccagcacaatggcctgtatggactaccaaagggcttcctggccatcagaaagtgggattcaggctattacagggccaacccagcaatagataagaggaagttgaaagtgaggtcggggtatttcatctccctgtgacttttctgggcctggctttgtttcttcactgaatttcactgctcatctcaaggcagcctcctttgccagctctcttctttcaggtattggtaataattctctccctttgacgctttgggctagggctggtgacagctctgctgttacacatcctgggttacagtgctaaatcctgtgtctcccttatattctaccccaaattctgatgatagtcctttcctaaatgaacactcctcaagtgaccctaatgcaagagagctgtttcttcttggattctctacgtgttatttaacaatataagtcgggtaaaagaaagcctacaaaacactagggacatacaaaagaaagaaggatcgcctcttctgaatagtaagtatcaggacacacagctcaaagtggtggcatgtgggctaacacttgaaggatcagaaaatttatgaggtgaaaaatacgggaaaaagcatacagagtgggaggaaacacacttgccagaatcacagaggttgtaaattcaatagctagttctgggaatagttaaggatgtgtggttgaagcctaatatgtgtgaaaggaaaggatgggagacataaagatgacagcagcaaaactagtgtgtatcttttctaccaagatctctgtgcctagcacaaacatgatgttcaataacagtttgctaagaaaataggtaaatcaataaatacaaaagtagacaggaggcagattatgaagggtttgaatgctaaggaatttgtacttcacagctaaaatgatagagacatagaaaatgattttgaataggggcttgatgcattgtaatattcttcctttcagttatcagtacatttattgtctcccttaccagattgtaaccatgttgaaggcaggaaacaagtcttattgatctatatacccccattatctctgaatgaaaggattcatacattgttggcacccaaaatctgcttgctgaattattgcaagtataaattacatgcttggagttttcatagcatgtgcattttattttaaccatttttattagagcttttaaaatgaaaccatactgattttatctcaaacattgatttaaacatgatacaactgaaagcagaaacacaatgccactgatgggtttaatatgctgcctactgaaatatcatttgttcttttattaatcatcgatccacagaaggcctcaacttggaagatgattgactacagctcagagattctcttgagggttttagggaaagatttggctctttctgtaaatatttattgccataatcagtagtttgatggggccactaatgaacattctgtccttaagaatgaaaaggatcacttttcatcagaaatatccctcactattttcactaatctttatcttaaatctctaagagtgacaaactgttcaatttttccatgggtatgaattaatttaaaactaagtgtattggctcagacttgctaataagtataaaaaatattttaggacaggcatggtggctcatgcctgtaatcccagcactttgggaggccgaggtgggtggatcacctgagatcaggagttctagaccagcctggccaaactccatctcaactacaaatacataagttagccgggcgtggtggcagttgcctgtaatcccagctactcagggggccgaggcaggagaatcacttgaacctgggtggcggaggttgcagtgagccgagattgtgccgtcacactccagcctaggggacaagagtgagactttgactcaaaaaaataaaataaaaattaaagcaggaaaatgtaatatatcaaagccatgtatttttatttgtgtttgttcatttattaacctgtcattagtaaatgctatggaataaatgcctgtgtctctccaaaatttacatgctgaaatctaatctccaatatgatagtgcatagaggtggggtctttgagagctaattgggtcatgggagtggagcccttgtgaatggatttagtgaccttataagaagaggcaggggagccagcttgctctatttctgccatgtgaggatacaacagaagctgtgggtctgcaacctgcaagagtcctcaccagaacccaaccttgctggcaccctgatatcagacttccagcctccacaactgtgagaaataaatgtctgttgtgtataagctatccagtctacagtactttgttataataccccaaactgacagacagcaagtgaacaagtttctatttgtaagaatatactaatgtacttcaaagttatttccttatgtaggcaggtcttttttaacagctactgactgaacatctactgttttctgtgagctattagaggtgttatgagggattctgtagcagatgctattggtgccctccctggaccttctctactaggtgggtacacctgcctcccagctgttgtgggtgttgattgttaaaggttcacacctacactcttcctcaaagcgttatctatggccagtgggaggtgcccagcccagagatgcatgggaagttatactcctctacacagatgatccatgggcaatgactgactgatgtaatgtgtaacagcccagctttctcacacttgagagaaaatgtctaggtgcagtctatgctgtagagctctaatgggatcaggctgaatatagactcctcttgggcctcaatctttgcctgccatcctccaccattctatcctgctatcctccaccgttctatcctgcttttctcactccccagaagatttctcctgagaacactgcttcagtaaatctcctgcaagaattcctatctcaggctttgcctcaagaaaaccccattttagacagatatacacacacacaaaaaaagacatagactcttctaaaggaatgcgtagtctaacagtggaatatgtttgtaaataatttcaactagaatatagagtgagttaaaagaaatacaagggtagtttatggggtttaaacaaagaaattcttcacatagattatggataagatgagaaatccttgaagtaagatgatttgagattcgtttgagaattgcaagtaggccactttgtctgggaaagaagtggaaggttatgatggagccataatgtggcatgccttgaaagctaggataaggtgtttatttttaatttgaaagcaatggaaagccattgagtattttttgagcatcacattgattctgttggaactgggcttctgaagatatatctggctgactatatagaataaatattagtggcagaaaatgagagttggagagaccagtaagaaagctaatagacaaacgagaaacaatgatgtcaacggggtgagatataaatgtgagggacattttaggagtagaactcataagacttggcaagttattgaatacagagggagagagagagagagagaacagtgtctcaaggatcttgggcctacttaaatggtcacttattaatgccttccccaaagtggaattgttgcactgaaggatatacgtattaaacattctgttataaaatgcacacactgagttttgtcccttttcaaacattggtgacaatttaatggcaggaatgatattgttattttcattcattctgaaaattatgaataaaaggaaacacattaatgtgttttgttgactatacccatcatggcattccttctgttatattttcgtctctccttgagtaaattcttgctctacatggtttgatgctgtgttatgaggaccatgatgacttatgacagtttgagacccattcagactattttctgactaaaaaccaagaggaaatggaattcccaaatggaattttctaggcaattgagggcacagctggatgtgctgcaatgctaaacaaaagcctcccctgtaataccctcaaacagcactgtggaaaggctttgggtgaaaagacctgcgcttgaatcctggctccaccaacagagagttgcacacatttggacaaatatcttaagctctctaggcctcagttttcaaatctgtaaggcaatattttcttcaaagagttgttctgagggacaattgaaatgatgtgagtaattttctttaaacttacaaaatgaatgttagtagactttactcttgctgatatttcctcctcagggacaaaacctttctttttcttatatttcttttcttcagcatctttcctgttacacagtaactcttcattaaagtctctcatatggatggatgaatgaatttttgcctagggtgatataagtgacagtctgtatacttcattctcctttggcctttctgaaataagaaataggaaagaaaagatttattggaaagttttttgatatgaagaactattttcttcttctccatctgttttgactttagtacctagaaacttatgtatttcatttaggatgagtgaaattcatttccccctctttataaaggattgtattatttctgatgggcctctggattctattattgttatttaaacaacagtatcctgttgaggtagttgcagctggcttagcacatggaaaaactgttgttgcatcttttatttttactcttcggtatttcctgaaaatgatgggaagatgaaaagtgacctcctctttggtattttttttccattggaacagcttatttagattatttgagtagacctccgtgtgtgtgtgtgtgtgtgtgtgtgtgtgtgtgtacacatttcttgtgctcccattttttttcccatccttcaggaaaggattttgatgcttgattacattttccaaattctctagtatacttgttctatgctttttgtcaggccatttttaacaggatcttttcatagttagagaatctctctagcctcatagctaccctgctgccggtagactagacagttataattatttccgcaggtcaaaaacctgtggatattacggattgaaaaaattgccaggtgagtccagattagaaattgcctctctagcttcaaatgggggcttttcaccagaccccagatcccagggaactttattatgtggcaaaactccttaatagagtgtcatccattgtccttgaggcatagtgagatgtgaatgtgcttgtctttcagtttgattttatcagttcatgaaagcactgaatagatcattttggggcctgaagggattggagctgagtttctgtcacttgtagctaagaatattagcaaatgcactgtatgactcaatgttgtaaccaaaagaggctattgccatttctgagcatggtgtgtactttcccatgctgttggatttgcttagattattgcctttcctacattatacattctcatatttaacctgaaatcctaactatcctcaaaatatagctcagatattatcccctctattaaacctttctttgtttcataaggaagaattttcattttcttttcttttttttttttttttttttttttttttttgagacagagtcttgctctgttgcccaggcgggagtgcagtggtgcaatcttggctcgctaccacctctgcctcccaggttcaagcaattctcctgcctcagcttccagagtagctgagaccacaggcactgccaccatgcccagctaatttttccgtttttgtgagatggggtttcaccatctcggccaggctggtctcgaacccctgacctccagtgatctgtctgcctcggcctcccacagtgctgggattacatgtgtgacccaccgtgtccaccttgggaattttcattttcatctaggcttcatagcaatttccaccctgcctcctgacatttcgtatgacttttcacattttgtattgggtaatagggctttttttaaacttttatttcttgagatagagttttgctcgttgccctagctggagtgcagtggtacagtctcggctcactgccacctctgcctccagggttcaagtgattctcctgcctcagcctcctgagtagctgggactagaggcgctgccaccacactggcaaatttttgtatttttagtagagatggggtttcaccatgttggccaggctggtctcaagctcctggcctcaggtgatccacctgcctcagcctcccaaagtgctgggattacagggaattatagggttttatttttgcatttttaaaaacctgttagattataaatctagatttttctgtacccttctcacttaagtgagaattctctagtatacttgtaagggtatactaagtgagaaggataaacagcaaataggagactggtaaacatgtgtggatgggtggttaaattttctgcctgtaatgaaattacattcataatttacattcaaagtgttttaaacagaagcagcagggtaaacagtcaattttagtttttcaaagttctgttttctgacttttcttgtattcgttctggtgaaggtagcttacatgcttactttgtaattctgtttttaaacacatcataaactgtgaggggctacttgcctgtcaagaatggagccattaccggctgggcgcggtggttcacggctgtaatcccagcactttgggaggccgaggcgggtggatcacgaggtcaggagttcaagatcagcctggccaagatggtgaaaccccgtctctactaaaaatacaaaaaaaattagccaggcgtgggggtgggcgcctgtaatcccagctacttgggaggctgaggcatagaattgcttaaacccgggaggcggaggatgtagtgagccgagatcgctccactgcactccagcctgggtgacagagcaaaactccatctaaaaaaaaaaaaaaaagaatggagccaaaaaagtattttcagttttcttaagccagaatgaaaacttaaaaccaatcttaggccaaacatacacttccaaaagatcacacattgagctgtacaggattgtggaaactagaggccagcatagagctagcatctgtgcccactttttcttgggaaatagagatattgattcatctttgccttgatcactcttgtgtgactttttcaactcagatcattgttgcttaaattgagagcagctttttcagaaactgaaactcaactgcagttatagctttttggcaggactttactaattgggacagggaggcgatcacttgttacaacataaatagaatcagaaatcaagtgatagtagtgatagtatatcattcatatgatacattcagcctatatatatgtacatgccaggaaagtgtgaaatttcagttttcttattggaaaatgaatcgtatttgttagttttttttaaattgtagtttgcagtttttgagtaatatttttgactggctatttcttggtacattttatgaagaacttactattatatattctctttttggtaagtgaaacaatttctgatttcaattgccagagagcctgaagttgacaagtcaggctgggaattagccagggcatgataactggaagaagggattatgttctacatcattaatatctgcttccaggctttataatattatccaggctgccagttttcttaaaaggaaaaaaattatcttgattaactttcagctgtttcacccttccttacgttcaagactttggtttctctgagaagaagatttcaaaggaccactcttattcactaaatctcttattatgtacctgggtgaatagaatgaaaagacgagagtgtctaagtccttcaccagcatcccatcctgcactggctctgactgtctctcaagacatgcttcagcaaataacatttgtggttacctcgctggtgcctgccttattattatttttttttaattctctcgggcttgtggagttggttttcttatagccattccagagatctactggaatgcattcaactccactcaggcaccaggattcagctctgaaaagtgtacagcttcccattctcacaatatactgcccccatttcctctacttgtgatgatccaaacgttcctttagatttactttcctggcagattacaagtaagtggaagccaatggcaactttataacgtttttctactttctggaactcttaaagaaaatgtgtagggttctctctaattctactacttggttgttttcagtactgtcttatattcctacctccataaacctcagtcagaagtaatttctctcttctaataaatttactatttcttccttgcatgatagttacagtgtagacatcttatctgagtcctctcttcaaaggtaagtttttaaagggactatttcttattcatggtgttattattaactgaatgtctttgatgcagtagggactctgtctttgttgaatgcagtttaacttccattaaaacaaaacatgctcttccttttctttcactctgcccaaagtgtcaattacctaggtaaaaaatagtttaaatgtatgttattgtttcttccactaaagaagtagaaggtacagtctttgtccattaaaactccactggtagaaaaataagctaactgtggagtgtgtttatatggagtttttatatgtgtagatgatgaaagaataataagaacaaaatgttagcacaaaatgtgataccggttatgtaatatttggtaattccaatatggtaaaattgttatggtttaggaaagttgaggaaggaaccaggatactactaaggaagttcaggttctggggattcatactgcataatattctaatttttcccaagtagacctggactgaggattaggtaagcacagccccattgttaccagttggtatgtaggaatgcatgttcttagcaagacatgaagcttcctttctgtaatattaaggatgaaaagggttaggggagttcagaaatgagagagaagccacttatttccttggataatgggaaggggacttcaaaatgcaaaaggcttagtggagtttgatttgagaaggtaccaaaaagaaattgatcatgttcagagtacagaggatgaaagggaagaaaatcagggaaggtcctggagctgggccagtgggatttttgccatcacaattctggacatgttctgctggtgatgcctttgacatgtgttagtattttgacatgttgggaaatactcctaggattttagattctcactacctgcctcgaatggaataggactatcatgtagaaaattaggaagggattgtgtcttcattttgacattaaatgatggactttcccttttgtgttctcatcaatttatttctctcctgaaagcattttgtgacttataaacactgcagagtttactaggtatgggtgcaatgatgcaggcagatttataaaatgggtcttaaaaatcaactaactagaagcccctccagcaatggaaaattttggttttcttaagccacccatgatatattcactttcaggtttctgtgtttatgtggaagagagaaacagaaagatattgttttgactagtgttggcaaatggacaaaagctggtttttttttgtctgaaacgttttccttttctcctgtaaagtgtgcagaaatgtattcctttattggtgtaagagtgtacagatattcattgacctcataccgatcgcttaactgacaacctcatccagtccacactgtaattcctgtccccaggcatttatgggactgcccaggcttgaatccagtgaacagataagtatttggaataaaacatcatgacttaaactgaagcattagtttccacctggtaaaagtaaaataatataatgtgtaagaactgttcactcattaaggtagtttcagattgtatacacaaagacagtgttgattgtcctattttctttcttgttttagtagttactaacatgattgacaataaattaaaactatttttagtacttgaaaaagtaacatgggtttaatttttttattcatatcttatttttggaatattattcttgctgcattttgccattttactaggaagagataattatcacaaagagatggttgacattaataaggcatgaaagcaaaacacaaattagtatacaaaatttggggctagtgctatattgttctttctctgtattttcaaaaggaactgaagtgtttcctgagaacaattcccattgtgctcatattctctctggacatattcaggcacaattttcattaaacttgaaggcaattgaagtggtttttcatacctattacttttcctggacttaattgcttgagagcagtggaagtgtgttctgactttttcaaatcatactttctttctggcatagtgtttgaaaacctcttcccaaccctttttaatgtatcatgcaacaattttctcgcaataaaaaaatgagtagttaatagttggaagtaaagcactcctcagcaaatgtaaaagaacagaaattataacaaactgtctctcagaccacagtgcaatcaaactagaactcaggattaagaaactcactcaaaaccactcaactgcatggaaactgaacaacctgctcctgaatgactaccgggtacataacgaaatgaaggcagaaataaaggtgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacaattaaaggaactagagaagcaagagcaaacacattcaaaagctagcagaaggcaagaaataactaagatcagagcagaactgaaggaaatagagacacaaaaaacccttcaaaaaatcaatgaatccaggagctgattttttgaaaagatcaacaaacttgatagaccactagcaagactaatatagaagaaaagacagaagaatcaaatagacgcaataaaaaatgacaaaggggtatcatcactgatcccatagaaatacaaactaccatcagagaatactgtaaacacctctacgcaaataaactagaaaatctagaagaaatggataaattcctcgacacatacagtctcccaagactaaaccaggaagaagttgaatctctgaatagaccaataacaggtctgaaattgaggcaataattaatagcttaccaaccaaaaaaagtccaggaccagatggattcacagccgaattctaccagaggtacaaggaggagctggtaccattccttctgaaactattctaatcaatggaaaaagagggaatcctcccaaactcattttataaggccagcatcatcctgataccaaagcctggcagagacacaacaaaaaaaagagaattttagaccaatatccttgatgaacactgatgcaaaaatcctcaataaaatactggcaaaacgaatccagcaacacatcaaaaagcttatccaacatgatcaagtgggcttcatccctgggatgcaaggctggttcaacatacgaaaatcgataaacgtaatccagcatataaacagaaccaacgacaaaaaccacatgactatctcaatagatgcagaaaaggcctttgacaaaattcaacaacgcttcatgctaaatactctcaataaattaggtattgatgggacatatctcaaaatagtaagagctatctatgacaaacctacagccaatatcatactgaatggacaaaaactggaagcattccgtttgaaaactggcacaagacagggatgccctctctcaccactcctattcaacatagtgttggaagttctggacagggcagtcaggcaggagaagggaataaagggcattcaattaggaaaagaggaagtcaaattgtccctgtttgcagatgacatgattgtatatctagaaaaccccatcgtctcagcctaaaatctccttaagctgataagcaactttagcaaagtctcaggatacaaaatcaatgtacaaaaatcacaagcattcttatacaccaataacagacaaacagagagccaaatcatgagtgagctcccattcacaattgcttcaaagagaataaaatacctaggaatccaacttacgagggatgtgaaggacctcttcaaggagaattacaaaccactgttcaatgaaataaaagaggatacaaacaaatggaagaacatttcatgctcatggataggaagaatcaatatcgtgaaaatggccatactgcccaaggtaatttatagattcaatgccatccccatcaagctaacaatgactttcttcacagaatttaaaaaactactttaaagttcatatggaaccaaaaaagagcctgcattgccaagtcaatcctaagccaaaagaacaaagctggaggcatcacactacctgacttcaaactatactacaaggctacagtaaccaaaacagcatgatactggtaccaaaacagagatatagaccaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttacatgttagacctaaaaccataaaaaccctagaagaaaacttaggcaataccattcaggacataagcatgggcaaggacttcatatctaaaacaccaaaagcaatggcaacaaaagccaaaattgacaaatgggatctaattaaactaaagagcttctgcacagcaaaagaaaccaccatcagagtgaacaggcaacctagagaatgggagaaaatttttgcaacctactcatctgacaaagggctaatatccagaatctacaatgaaccccaacaaatttacaagacaaaaacaaacaaccccatcaaaaagtgggcaaaggatatgaacagacacttgtcaaaagaagacatttatgcagccaaaaaacacatgaaaaaatactcatcatcactggccatcagagaagtgcaaatcaaaaccacagtgagataccatctcacaccagttagaatggcgatcattaacaagtcaggaaacaacaggtgctggagaggatgtgaagaaataggaacacttttactgttggtgggactgtaaactagttcaaccattgtggaagtcagtgtggcgattcctcagggatctagaactagaaataccatttgacccagccatgccattactgggtatatacccaaaggattataaatcatgctgctataaagacacatgcacacgtatgtttattgcggcactattcacaatagcaaagacttggaaccaagccaaatgtccaacagtgatagactggattaagaaaatgtggcacatatacaccatggaatactatgcagccataaaaaaggattagttcatgtcctttgtagggacatggatgaagctggaaaccatcattctctagcaagctatcgcaaggacaaaaaaccaaacaccgcatgttttcactcataagtgggaattgaacaatgagaacacatggacacaggaaggggaacatcacacaccggggactgttgtggggttgggggaggggggaggtatagcattaggagatatacctaatgctaaatgaccagttaatgggtgcagcacaccgacatggcacatgtatacatatgtaacaaacctgcacgttgtgcacatgtaccctaaaacttaaagtataataataaaaaaaatgagtagttatatatgtctttctagcagtgagattttgcaaaagacaactgaagtatctcacatggagtgaccactcatttggaattgctcattgcctgggcagatgttagaagaatttgcattatattcaatagccatgcctggtgaagtcattgttgtaatttggctgaaactaatgcaatattactttaaaatattattttcctaaagataatataacttattttaaaaaagacttaaactgaatctttggttcttctgaatattgcattttatgaagtgtgtgggtgtgtgtgtttatgtgtgtgtgcaggggtgagagagcaagagagaagtaattttttaagaaactgaaagaatatgttacagaatgggaagttgttttattcatgtgttatttgatgagatatttctagcatcttgaagatttatccataagatttagaggcaaaagaatggccttttgtttatagttctcgtttggaatcagattcatcattcttacttaaacaaaaagaaaaaaacatatttacatattttccaaagtgtaatattatagtgaaaaactttacaactgagttcaaaaattttgttagagaacctaaagcacctagagttatttctaatattagaagaatggaatgttagtcttatgattcccctaaaagcccttttaaagatatacaataggtgatattatatatatgtcacctatgtacacatatgtacatacacatgtatgattccttaatagcctctttaaaaggtctcaggttgtcaaaggagcacatgaaaaggtgttacactatggtttcataatccacatgaagtttgtcccttcaatgatatttgtcccctgacatttctgtagcatgattgaaatatctatgttaggttaccagggcatggagtcagcagtatgaattatctgtactttgtatgggtacagatcttaccttgctacttaatcagtcaggatggaccaagtgttgccacagaaaaagaaaaactctttttttttttgacagggtattgctcttttgcccaggctggagcgcagtggcatgatcactgctcattgaggcctctcctgcctgggctcaaatgattctcccacctctacttcctatctggggccagagtcgcttgccacacccccagctatatttttttttattttgtagagacggtgtctcattatgttgcccagtctgatctcaaaccgctgagctcaagcagtcctcccgcttggcctgccaaagtgctgggattacaggtttgaaccaccacaatcaggcccggagaacagctgtcaaatatcaatgaactaacagcaaagctttgtttttacaatcactttacatgagcacgtggattggcaggggacctctgcccaatatctttacacagaaacccacagaagactcactcttgacacatgtttgcaaatcaccactgaacggaaaatgaaagattgtcacttgctctttgaaattttcttttaagtgaccttgtcacttctaccctcaactcattggctgaagcaagttacagcgtgggcggctaacttcaaaaggtcagggacagcaatcctatcatgtttccaaaaagagaaaacaatgcgaatcatctaatgccaatcagaactaccataaatgattagactgatcccaggagggaaagggttagtgtaaattcattactgttgtttaaaaagatgctcgacagcacatttgctgctaattaatggtgtcatgtttgaagaaagaatccgcaaatgcttatttttaataattgaaaaataaggagagctttttctttgatcgtgaattagtctgtgcagttggatgataaattacaagtgattacaactaccacttatgctgctaaattatagctcttcagcattgttagaaacaaaaaggaaagctggtctccatggaggtcatatacatattttcttaggaggagtgagaacaggtgttgaaatttaaatggtaagaaccttaagttcatagggaagacagctgaatagaaactgaggggcaagcttggggagccctgtgggatttttgcagggggcatggaggaggaagggagtagaagaatgctggcatttgtttattcatggtaagaggtgctttggtcaagaagggatgaaaatgttttcatgtttataaaacagtcattgatcaacattctttgtctctccctctccatccctctcttcttcccttccaccttccacttctttctttcaccagtatgacaaaaacttggtagcctaccattctggattctgtctatagaactggaaattcctctatatacagaacttacattctagtagttataacagtgataggtgtatgtagaaaacctaaagcagagtaagaaatacagagccctgaaaagcactactttttagaagtgttcatggaaggtgtctttgaagacataacattagaggagagagaataaagtgaggaaacaagccttgaaatgacatagaaaatagctttccaaatggagcaaatattaagtgccaaggccctgaggtagaactgtgtttgtctgctattagtgctgggccttcagagatgagtgcttgcaggacttggtataggacctggcccacaggagtggctcattgaatatttgtgggatgaatgaatgagcagatgaatgaatgtaaaccccatccccaaagaattcccactgtagcagaggatggaagtctgactaaagataactacttggtagcaataacaacattcagcattgctcttcattgggtagggcactaagatctttacataagttatcttacataattcacaaagcaatactatggacacatgttattgctcccattttgtaaacagaaagtcaacagagattctgttataatgtttaagtgtttggactccggagccagactgccttgatttgagtaacagtacttccacttgccatctttatgaccttaaacaagttacttaacttctctgtgcctgggtttcctcactggttttaaaaaacccgaatataaccgtttcaggacattggtgtgaggattgtgtgaattaacatatgcaaaatacttaagacagtaactggcactatataacttttcttataataaatgctgtcatcatcattttcaagattatgtaggaaaatagggatgctaactgcttgagaattccacagaggtcttcataaataagatgtttgaactaagatttgaatggaaaggtaggaattctaaaatgtattcaagtggtatgggtgtgtgtaaatatttcagctaattcagcattgattttttcagggggatttaaaaagtatatttggtagtaaattgtctcctttttgctgaatatcaggctactataatataaattccaccttgttcccccaaatgcttctagacttacaacttgtatacatgagaataaaatcattgtcattttccatcttataagacaaaacataaatctagcctggtttagcctccattgtcattaaataaaaaataagaaaatgatctcctgtgcagatagtcaaattgaaaagctcatgggtgatagttaaagtttaatacccactgaggccattttaggaatagcaataatttggctgtgtataattgtgtgtttatgtatgtgtacctttatatgcatttctacaacacaagctgttactgaatcagagatgtgtgaccttctttcatagatataaaaattacacctggaaatattctctgagtttacatgagagaagggaatggcttattttacacatataaaattatacatatcttcacagcatcttaatccatttttttctttagccgtgtctaaatggtttaagaacgcattacctaataagtttggtgtggggaaaaatgccttagaaaggagtaaagcaaaatctatcaccatctctcttttaataataaatatgcaagtggatgattacaaaagaagagatctggagatgactgaaaaagaacattgtgagggtgttggattatcgaaatttttatacattagaattcagtgtttattttgagaatgaaacacattttttctatttacatttacacaaataaagtgcctctgcccacaaacagtccttctatgagttaggaataattttcctgtggtataaattggtacttctgtttctggccttagttctgggctcacacagatggcctttataaacataatctattatttacataaatcagttctctctttaccccttgtaaacactcctgtgcagttatttgaattcagatctgattatggatggcaaatgtatagcaagaaaaatggaaaagctaattattttactatttggatttatttttgtaaaataatttccaaggatttctttagagtttctctgcaagggtaacaaattcctcctttctttcagttccctccttcatctgaatctcaggtcttacaagtgattaacatctcataattcactatggcttcagcacttgtacatttcaagggccattttagcaatagcactaattcatgtttacatactttgtaatgtaaatgaactgtgatacttatgtcgttaactgttatttaacaacataattttgtaaaaatttgaaaggcatgtattttctaatgaggtaaatacagtatctgttataacaatgactaggtctaaatgtttttaaacattgcattggaggccctgagcagaaagatgcaatatatttgagtatgactttgttttgtaacaaaaacgttgctctaaggcacagatatttgttttggtgaagttgaagtcactataaacatgtgtggcttccttattcccaccatctgtggttcatacactatcctcaactatgagatcacagttgggcaagatggaatttccttgtttaaattttctcatcggtttttcccacagaaagttactaatgactagcatattttgaagtctactttcattatagttcatctatcttcatatatatatatatatatatatatatatatatatatatataaaatgtgtgtatttggcatttatatatatgtatttggcatatatatatgtatttggcatttacataaaaacaagatcagtgatgggtaattttaaatgcatattaaatataaacaccaatgcatagaaatattattttatgaggtaatgtcttgatattttgttcgtgttaagtgctatgaatacatatgataaagatattatttctagaaacaaacaaaaaaagattgggacccaagtttattgattgataacggttagcccaatgcctacacataattaatatcaataaatatcaaagaaaggaaggagagagggagggagtggaagaaggagagaagaaggggaggaaggaaggaagaagatagcatagcagtcagaatgttcagatactatggtggcttcactaactttgtagtcactttaccttgggcaagttatttaacctctcaaagtctcagtttcctcatctctaaaatggaattgttttgattaaatgagatgaagcagttagtgcagcagcaattaatacattttagaaatactttcaaattatttttaatgaatatgaaattttaattaaatgagtagtatcagctgataattttacctatgaatacagattactcattttcaaaaattagtggtgaacacacttcaatactacagtttacaccgaacataacttatgtttttcattgaccttaaaggtacatatatataaattgttaaacatatgtttatcaggtgagcatctattatgttgattcgcactggtctaaattctggggttacatagttaagtcttctcagactagtagacaagcagtgtactgtagtgtgatgaatgctttaatctaggtacacagtgggatgctgtagaagtaaaggaggagcggccgggcgcagtggctcacacctgtaatcccagcacttcgggaggctgtggcgggtggatcacaaggtcaggggtttgagaccagcctggccaacatagtgaaaccccgtctctactaaaaatacaaaaaaattacccgggtgtggtggcaggtgcctgtaatcccagctactcaggaggctgagacacgagaatcacttgaacccaggaggcagaggttgcagtgagccaagatcacaccactgcactaaagcctgggccacagtgcgagactccatctcaaaaaaaaaataataataaaatttaaaaaaaaggcaagaaggagcatctgtttaaatttcaaatagagaggaagtgaaggattggcaggagaagttaatgagtggatatctaaggtttcctgtcagtggtgaaatttgagttagatttctgtgataggcagaatttctaggaatgacccccaagattccacgtgtcctgatcctatgaatatgatgtgatctcgctcccctgattgtattctgttatatggaccagctgaccttaaaataggaagattatctggttgggccttataagcagagaactttaccagctcctggcagaaaaggaaggcagaagaggagggcagaagaggaagtcagagagatttgtagtacaagaaggatttgatgtgctgttgcttggttgaagattcagggaacaatacaagaagaaatataaacaaccttacagagtttggagaggccactggctgacaatcttccaggacacaaggaccacagtcctatagccacaaggaaccaaattctgtcaacagcctgaaagagcttagaagtggattattcatcagagagccttcagataagaacccagccaaacccacctgatttctgacctaaagaaactaagagattataagtgagtgttgttttaagccactaggtttccatgaatttgttacaaaggaataaaaagataatataattttgaagggtgtgttttaaacagccaggaaaagaaacaaagaccaaaaggctacttaaaaagcagatggaaaaatctaacagagaattcacagtcacgagggtgtaaaaaatgcacaaaatcatagtataggacaccagtattagtgacagcaattaccattataccaagagtatggagctataaataaacatctagtatctggatcaacagcattttattcattgtttgccatggttgagtgataaagtagctaacattaaaaggtaagaatactttttcacttatatctatctaaggatcttgtgtttgtatgtatagggaagtttatttttggagatgtgggaataatatacattgaataaaacattattaaaagtaggcataaattaaaatatataagcaatttcaatttggagaagagggaatgaggtgtactaaaatttataaagaattaaataaagaggataaagacaaattggaaattgaaaaggaataagaaacatttttctgtgttgggattgtagtatgtagaaatctaatcttatagtataatatttgtaattaagatgcttagttccaatatgtttcattcagcactgggttattgtttagtacatttgtgcaataattagataaaatatattttaatgaaagtagattttgtgagttggaaaatacacttgctttagcaaagtaaactaaagttaatgtattttcaccaaatatagttttcttttaatttttttaaattttgtaaaaatgtaagacatatttagagtaactccctagttagttctttactaattgatgctttgaaaagacaatgacttttttatctgatgtatttttaataaaatagtctctcacatcacatttctaatgaatgcattaaaattctcaagtgactaaagggagtttaaattatctctgtattattatgtcagccatctagatctatgatatcaaaatatatatatttaagatgtgcacaaattaattaaaatgataagtttctaaatctctctttgtataagttccaagaattataaaaatagcactattttctgatcaaacagttaacactaaattttacaatgtttgtaaatgtggcttagaggccagtctttttacatggttccttggtttacaacagcagccaccatgataatttcagcaagtcaatacaatgtgttctaaaaaaaaaaaaaaaaagattggcaaactttttttttcctaaccatgttctgcattatttaactttaaagtagagctcatctttctaaagaggaaaatagtgagcagtaaataaatctcttttgataagataacaatgaaaggtagttatctagtccaaccagcagtgcctcaacaaaggctaagcatcagaggcagaaaataataaaagaggagcatttttcttcccctttatatttttgtttcatatttttcttttctttctttttttttttttttttgagagggagtttcactcgtcgcccaggctggagtacaatggcaccatcttggctcactgtaacttctgtatcccgggttcaagcaattctcctgccttggcctcccgagtagctgagattacaggtgcccaccaccacgcctggctaatttttttgtatttgtattagacacggggtttcaccactttggccaggctgttcttgaacttctggcctcacgtgatccgcgcccccccccgaccccagcctcccaaagtgttgggattacaggcatgagccaccgcgcccagcctgtttcatatttttctatggaaaaattggattgtagtggagaaagagaggaactgttcctcccaccttcacttgtctactctaagaccaaagttacttcaaaataagggttttgttgaggaaagcagtctgcctcattttctttttccacagacctaaatataaaacttgatttccaagtagaacattaatcaatgttgtctctgctcatcttggtggtttaattggttcaaacactctggcattaactgtctagggattttctaatttgcctatggtcagaaatgcttaattgatttctgttctgatcttttcatagaagttctgaccctttctttagcaaaaccgccttacttcatttctttaataaggttgagaagtttgcttagtctatttgtttcataaataactctcgcccaaagtttaagtaatggatttagaggtaacactgagaaattcagagaaggaagtctcatggctttatggttctagatataagaattatagcacaggggtagtttatatttctttatattagggtggccaccataagtatgagtacttcatgagaagaggccctgacggtaggaattacggtattcctgcccacaacaccccctctaagttttctgaattctgcagttttttccaggtgtatggaaatataattgataaacaaaaaatgtatatatgtaaggtatacatatgtatacattctacttgtatacattataaaagtacatatgtatacaatgtgaaatgattaccataatcaaactaaataacatatccatcactgtaatttgttactcagtgtgtttgtgtgtggcggggggtggtgcgggggagggtaagggcacttaaaatctactcacttcacaaaatacaagtaaacaatagaggaatattaactgtaatcaccacgctgtatattatagccccagaacttactcattttatacctggaagtttgtacccattgatctacatatcctcacttcccccaccctctgtagctcctggaaatcacctaaattctgattgtggattgtgtttcaagcaatctaggaaaagagagaacatttttatagttataaaaaagttcaaaattattattttaatatcacaagcaatatgtgccaggcaaaaagaaccaagaaaaagatataaaccccatgaagacagaaatttttgtctgctgacttaagttaatgtctgtatttgagcccacatgtatacttcatataagtagaggccatatgtgttcttgtttacaaagtgctttgcactatgcctagtgcatacatacacacatacacgagtgaatatctatataaatgtattctctataggattctactatccattaaaaaatttgtccttttacttagtatatcataaatatcttaccacataagatgtatatttctacagacataaatttaatggctgtataagatataatttactaatttcttctttttattcttttggcctatttccatttttaaatttattattataaaaacaattcttcgagaaagacatcaccattttattctgcacatataattattttctaatgataaagccttaaaagtagacttgacagataaaagtatgttggctcacaaatataatgcaaatactgtgctgaagaataaattgaagcagtcactcattcttagctctggattaaatatagttcatttcattgttttactttgaatacattgctgaaatgactggctctaagggaaagtgtgctttgattaggagcaggtttttataattctcttctacatgcccatcctgtaaatggtatctttgtgtaaaaaagaagcaagcataaggacacatagaccagaatagagaggaaccatggagtgggaaaataggaaaagaggcactgctggaagacagaagataaactgtattttgtggttttgtgtaagcctgccattgccttcatctagacctgccaagtgtgacagatttggacacactggaaaagttaacgttttcagtgggaagttctgggtttcagttccttctgtcagtttaggtatcatcagcatcatcattagaatcactaaggagtcagagaaaggtgtgtccacctaattcaagggcctgagtgccaggcagatttttccatggtagcatgttccatcctaacgatctcttcagccttgttcccatcctattctctttaataagaagttgtcattgtctagcaatgaatatttattgctcagagatttagcagatagtgaatattttcagacatcaaactaatttgcatttgtgcttgagaaatttttcccaggtggcacaatattttatatcctgttgtaactgagaaagttatcacatacataagaacacatttactttcattttatttttctcctacagtatatcctgttgtaactgagaaagttattacatacataagaacacatttactttcattttatttttctcctacagagcgtcctatatttctgtaaactggattacagggtacttagaagaacgagcttgcttgtcactgaagtatgcagcctcttaagtaaaatccaagccctatttcatcatcatgtttattctgagaatagaattgaagaggaccacatatggttgaaattatagggagggttgaggtgggcagaatctggcccagtggaatcatccaatttggaaataatccatgaaaactgtttggcagttttagccatgcccctgcttcccatcgcctaccccctgccccaacttccaaagagcatataaatttagtgttggtgatgaaaataggaagagagaactttgatttgcagttaacatgaaaggaaatatacactgttttagtccatctgggctgttattacgaaatactacaaactgtgtagcttataaacaacagaaatttatttttcacagttctggagtttggaagattctgtgtctggaggcgctggcgtatttagtgtctggtgaaggccccctttcacatacgtgttgcctcctctctgtgtcctcatgtggtagaagaagctagctagttcactgggctctcttttataagggccctcatctcatccatgagggatctacccttacttatgaactaattacctcccgaagaccctgcctcctaatcccatccccttaagggttaggattccagcatatgcattttgaggagacgtaggtattcagtccattgtgcacaccaaattatgaattaatgtattaatatataattgtatccaaagaaaggtctaccaggaacccatatttgtttgctgatttgcttgtttaatatgcttcatttcctcaaaacaaagggaagcatattttagcttattttcctttttaatcttttgttttgagaatctctgccattgctaaagtagaaaattatgttttcttaactttttgtttattatacgtaaatacattattattaataatataaattcagtgtgtatgtatttctctatagtgaaggtgttgctttttaagtgaatgtggctataaactgagactttaaaaaatctcattgtcattaaaaaaatactgatttagaaaagttctagattcactgtatagaactcacagaatatagaatagttgctagagcacagaaactagtactcttttaacttctaagaaaaagtctgggaataatgtagatcccctcatctttatttaagtaatcaaaattgattctgtgctgggcgcgatggctcatgtttgtaatcctagcactttgggaggccaaggtgaatggattgtctgagctcaggagtttgagatcagcctgggcaacacggtgaaacaccgcctctactaaaatacaaaaagttagccaggtgtggtggcaggcacctgtagtcccagctactcagaaggctgaggcatgagaattacttgaacccgggattcagaggttgcagtgacccaagatcactccacagcactctagtctgggggacagagtgagactctgtctgcaaaaacaaacgaacaaacagaaaaatgattctgcataatgtggggcagattatttatttacaaaattattttttaggaaagaaaaagttgattactaagatttagctagattcactatgatcaagtcatggagtcaaactttacgttgttgttgtttgcatgagttaattggctgatagattactggaaagtcatggatgttgtgtatctggtttttagcaagatgtgcatcagtgttccctataatgtctttatcaatgagtatgagggctgtaagctgagtgataattttgttaggcagatctttggctgtttgaataatcaactgtagcaatgttattcattaatgccaatttgatgaaaactttggtctggttcaatatgtttattaataaattcacagagaagcttaatagcatactaatacaatttgaggatattagaaactaggagggttagttcctatcttgaataagaaggcagatccaagaactccacagaaataaactatggagaataacagttatttaattttttcaaattatggatgtggaggaagaaatgaattaactctgaaatgagagcaagacataggactaacagatggaagtttcaggaaaatatattttggctcagtaaaagaaataaattactaagatttatagtagtctgaaactgaaattgagaatttttcaggagatactcaactattgatgtgaataggtgtcccagcaacaattggacaagcccaccgaccacttggtgacattttccactaggcattcagcatcagattccacagcgcttttgaggtggaggataagtagataatatgtctccattatttagaggaaatctctcacctttgaactcttacagaactttaagtcatttaataattattcctgtgtaatgtacaggaataattatatatattataaatatatatgttttatatatggtacatatatttatatatatatatgtgtctatatcctatccctttaagttcttttgatagagacatgtcagtcatcataggcttatagtgcctagcataatatcttgcacatcaaaagagaaaatagtgaatgaatgaatgaatgatttctataacaatatattttcttccctaggtgaaggacatcctaaattcttgaggatactgtgtatgccctgtgttataatagcatggtgcacaccacactagcccttcaggtgttcttgttctctttttgaatgctggtaccctcaatttattattcttgtttggatatatccaatttaccttgttgaacattatttactaacagcaatctgttagccactaggaatgtaaagacacatcataatatgaccttctgagggacaaaaattgaggcctatttatctttgtatcccaaatgcctggtgtacagctggttctcataaaatgttgaattgctcccggaccagactttagagtttggttttaaaagaaaagccagagttcagcaacagcgaagggaatttaatgtggagaaagaaacatgaaccaagaggcacagcttagtgttgctgagatcaggtaaagcatccctgtgactggggcataaggtgtggcagggatgagagggcaagaaagagtggcacaaaagtgcttgcaatcacagcagggactatcaagtaagggccttgagtgttgtgccaaacgactgtggaggttgaatttaatctcatggacatctctagactattctactttagagcaactctaacctgtatgaacatcttccagttgctggatcattttctttagggatttttggagggggtggggagaatctcagggaagcattcatatgtcaagcaaagtgacctagacttcagatttacactggaggcttcacggtaccaggtgttgaaatcacacattctttggcacagaagctagcattctcatttgtgcatacagtttatgtctcgattattctttcagttgtttaaaggtctgggatagatgcatttagccaacgagttatgttattgtgtctgccctttggaaactttactttgtaggaaagccttactgcttagaatgttcagagaagctgaggttatggggcaagtgacaggtctcttttctgaggcagctgccacactctcttagtctaagtggattcttcctgaaatttgcttccccaagtgactacttgtactggttatgcagttggttaattttaaattgatgtcagcatttgcagctaagttgatttggaaagctctctaatttaactcttcatatgtaatcctgtccccagatcatgatggtgataatttttactgcatctttagatttaaggtcatttaagtaaattgctttttgttgtcttcctacttatgggagaaagagagagagaggggagaccaagagagcactagtgagcatcaggtgtggtttttaggcatgtggagtttcttcttagaaaagttgctgctttcaattgcatgtacgatgtacatttaatatactgaagagttttgctttaggaattaagtaatcattttcctctgtgctgccacagtgatttacaccttcctgttaacctttcaatgcctcccactttgccgaagataatactccttccccagactaataaagccctacgtggcctggatcctgcttacattttctctatccctgttgtataaccacgctttgccctgtccagtctctggaacttgcactgtttctttccatcatgaccgttatgcagactgttcctttacctggagtgaaatgcacttttctacctttttccactactcactcccacctttcctttggatttcaactcaattagcattacctccaggaatcctaaccttgtctgtgtcaaatcctcttataagctcagatatcagtgacatgtttgtactggttggctataattttacattaatttttatgatgattttgttaatatgtctctcctccactaaaatgtagaaacctgtcaattttgttcagcaagggtctccatggtaaagcaccatacctggcagagaggaggtactcaaacattattttataaatgagtgaataaatgatatatttaaacccctttggaaactcatttcccagataagaaggtattggtcaatagtttgtctcacactgaataaatgttccgttgtccatgccagtaccaaactgactacttcttccagaaatttaaggactactattaggctgagagtcactttaaggttttaagaagtcaggtgacaagggtggaagtggtgaagctcagagctagataaccttaatttcagatcctcactctacaagtttgcttatgagcttttgtgaccactgaaatgtatcttagtctctccaagactcagtttccctaacacataaaaatgggactaaaagcttcagttcagaaatttagtaatgggccaggtgtggtggctcatgcctacaatcccagcaatttaggaggctgaggcaggtggatggtttgagcccaggagttcaagtctgacctgggaaacgtggcaaaactctttctctacaaaaaataaaaattagcctaacatggtggcatgcttctgtagtcccagctacttgggaagctgaggttggaggattgctggagcccaggaagtcgaggctgcagtgagccgtgtttgtgccactgcttctgtcagcctgggttacagggtgaggcgatctcaaaaaaaaaaaaaaaaaaaaaagaaaaagaaaaaagaaagaaaaagaaatttagcagtgtctatcaaaatttaaaatattcctaattttaactaagcaatatcacttgtaagtgctatttttcaacacgtacaaggatattctttacagcattattagtaataataaaaactagaaactaaatgttcagaaaactaactaagtaaatgaaagaacatttattcagtggccactaaagagaataaaaatgaattagttgtgggaaattagatatgggaacatgaattcgatataggtaaatgttcaagataccatgtgaaataaaatagtttcagaagggtatatgcacaaagagacatgcatagaggctttctgggagatactcaaagcattggcactaatgggtacctctgggaattttgatgagtgattcatatatgtgtgcataggggtagaagtatttacttttcacattatacttttacttactgttggtatttttaccaaaaagatgtagcactaatataattttttaaaaacctcatgaaatacaatattaccctcttatgtggttgtaagaattagatacactcgtgtgaaaaatgtctggtccatactaaagagttaaattcagttgtcccttagtatccatgggagataggttccaggacttcttacggatactgaaatccaaggatgctcaagtctttgacataaaatggcataaaatagtatttgcatataacttatgcacatcctaccatatactttaaatcatctctaaattacttataataatgaatgcaagtaaatgctatgtaaatagttgttatactgtattgcttaggaaatagtgactagaaaaaaaaaaagcctgcacatgttcagtacagatgcaatttttttttcaaatatatttgatccatgattggttaaatccacgaatgcagaacccatgaatgtggagggctggttgtaggcactttaaaggaaaaatatggtcatttttaagtgcacttgcagagagcttccaatttgaagcctcatgagtttcagctgtccccagtgccctggttactgtaaaccattaagtctggaattcacctctgcatgtcctagtcagctaggttggcttcagcccttcttgctgggagtgaaaagggagggagaagccctcgtttacttcaggaggtaaaaagactctaggctgagtctccaaagcctagattacagcaaacatgttttacgttaaaaattggggaagttaaattttagggggcaatccctggttactttcttactaaagttgtataatttcctacttaaaattaaaactcggaaacattactggcagtaagggaaggtaacatgagttttcaaaccaggtactgagcacattaaaatagacccagtcaaagctgcatacagcttcaatattcatgcaatattcagggtgtatattgccatgtcagagtgagcagccaaattgtgcgtttcagtctcatggctgtcccctgaggaggaggcctaacttttagtctcctcaaaacacagaccctctccactacaaagtgaatggtcattcctttgctgcttgaatctgggattctttttcttgtacttagggtgtacggaatttacctttctttggaatcatccttttttatggagttctgcatctgaacatgacctggccacgcatatgcacactgagtagttccatttcaaactagacgttctgttgagctcagaccattctggaattatttggcaacatctgaaacattttttttttttttttacctacaacacttctagatgtgacgttttctggagaattgataaactgatctggtagctgttagtggctaccaagccaagttttacattgcaatctaaatatattgttccttgtcatgtaatgacatttattagagaatctggcaaaagcccaaataaaaatacaggttttcacactgtttaacaatctgaggttttatgtctttttggtgaggtcattgaataccagtctcatttttactgcctctatttttgaaaacagtaaacagtcatatttttattgtcctacgtggttgcacaaactgacacattgccaagtggttctgactgaatgcttttcacttggcaaactaaaggtactaaaaagaggttcacagtggagacttatgcatgtaggggagcaatttctgtgggcatgtgtatgtacaaaataaatctgtgaattccagtagagccagtatccaggactctaaaagtagaacagactgatttatttgtgacaatgtacttcagctgaacctctgtgctagtttgttggcaaaacctaacatatggccttttaatgagagacagattaataattgcagatatgaataataaagcagaaagattggctgtgccatcttttattctaataaggaattagatttggttactgaaggagcagctgtttgccaggtatggtatgctactgtttgagatagacactttgatgcaaaatgggacgcttgatggtgatggacttgaaaaaatggatatgcgatgtgtgtttaaatttctcaagccctataacaataaacattttacaccccaatgattattattctataccgtcattcaaaaacctacaaaaaagacacagtgacaatgttttctgtcttgttgttctttgagagaaaagacctatgatggtacctcagtgcaatggaaaaaaaaattcttgacaaaaggatcaaatagaagtggtggcacagtttctggaatatatgacattatgtttaaaattgagtgcaaattcttgtcctcccctgtgctagacacgtttctttgcctgcttgaatccacagctccttcaatagaatcaacctgcccctaccttggctcctagaagtgtcagctgcacttatcaggtgacccatttccatttctagctatgattagttagtcagggatggagcctaatcaaaagggagctaacctattcattcaacagaggtaaagcagattatttctctcaagaatttgaacaaagtgggctcaaagactcaagatattcagtgatgagccccaaaactgcagtgcagtgtacaaaatgggctgtgtaggtgaccatgctgagaatatgcaagatacatatgcgcaagaatgtgaatggtagagatggaaagagcaggcaaagataagaacctggtggagaatgtagaagtagaattgagagagagctagaaggagcaatgttaggattgacattgtcactccggtttctctgagaccacgtttgacattgttgtattcacataataaccatctgtttacctaagctactttgagtgaattctattcctgtaaccaaaaaagtcttcatgagaacaccccattttacaatataatcctgtgtgcataactatgacttgagatctatttctacactgaaatctgcaatatgagattgttctaaggaaagcctctaaataaccaaaaagactagacaaccttcagtattagggtttaataaaaatagttagcattctgatatgggaaatgtattccagatggaatgttattaaggcttatcagtctagagtaaacatggatgtgtacaccaaattcttcagtatcagaaccagatggcactcaaaaaggtttaatttcattcaaataagcaatgccactttaccaactagaaaggggataaatgaaactcattacctcagtgtatggcttaggactcagataaatgcatgtgagagagatccttaataggtgattgagataaattagggaaatttaagaaatcttcttatacctttaagggagactagtgagaaagattttgctgtctaacaaaacattttcttgatgttagtattcgattccacaataagcggtatcttttattctagtgttctctgtgggtagtaggtatgaatttgccctgtgactctcaggtgtcttgttacattcttcttatgaatcagattattttctcaagagtctggagatcttatgtcatcctgaaaatgtagggaacggtctctttagcttatcagagttagaattgaaatgcatattttccaaattcatatggaccatatcaagttgggagcctgtttagtgcccaatctgaccttggaacactttgccccactatgtgactttaaataagcttcttaacttctcagggtcttggtgctaaggtcagtctttctgaattcatcaaaggttttcaaagatcctctcgccttttgagattctgcatggtagtaaaacccacttcctcactatggaacccacccgtctttctgtgtcagacaattttcttctgcttatggttggggccactcctcacctttaactaatgaattccttttctgctttgtgatgagctagtcttttctgcccagattgcactgaaagatagaagctgctgcttcgttgtaaggagagctcaacctgttcacaaagatatctacctccctacaaattttttttagaacaaatattgcttgaatacatttaaggcaaaaataaaccaataaaaatcagccttagatttgatagctgggttggaattgaacctttaggttttcttaccaaacaggatttatctctgcttcattaatacatagcattaatttggcatttttattctccactttaaatagaacacgggaagacaaaataattttctttcagcaacaagaaagtaaagcagtagcaggaaatctagaaaaaaaaatccttctaaataggaattaatattttgcatcctttttttgtatttttttcctcaattagagtcctagccaataaacattcaagtcaaccaaaagtattatttctgaatggaaaagaaaaaaaataaaaatatttcaccgaaaacaaacaacacagtataataacttacgatttttgctaaattgatgatcaaatatattggacacactattttttctaacaatttataggctgtgaatagacacattttacctaagagtatatactatctgtaagtagcttgaaataaaatcattaatgtttttgattttctatttccaaagaaccagaatatgtcctggtcatggacattcaagccagtactttccgcaatacctaactatggcaagagtgttagagagcaaattattcttcctaagaacgatattccatgcaggaagccagagttaccttccatagaaacacaattgctcaaagaagaagagctttcaactccctggccaagccttctttgaaatgattctgtttttctgttacttattgtggtatctgggaaaggcagatatttgcttacttgtttctcaaatttaagattaaatattactattttgttcctctttggacacaatggcagattttctttcaccaaatatttatagagccccgttaggtttaagtcactgtcaggcaatttgttctaaatcacgttacatcttgcagaaaaacaaacaaacaaacaaaacttcttttctttgaaaatactaataattgccattctgcatatcatcttgtacattactgtctgcctttgctgaaagttcttttggtttttgtcacttaatgctcgggagatggattttataaagacccactgctgaagccattcctccacaagacctcttccaaaatcttatgatgactttttaatttatgatgaattttaaaatacaattctagatgcttacttttctgtttttgttacacagagattttctgatagaacaagtgacagggagagatgaaaatgaaaaggataaaaccatttaaaaattaaaaactaagtcatcaaaatggtgaaaattggttaaattatatacacatacctctaagaaaccaggaaagtatgtaaagcaatttagaaaaaactccatcagaaatggttaaaaatgaaaaataaaaaaaaagagagaaccaattaatatttggaggggagagaaatttgcaagatttctttcttcccaaggtcagtggttctcaaattttgaatgtatcagaatcacctggagggcttgttaaaacagattgctggtcccgcccttagagtttctggtgtagctgctttggggtggaactgagaatttgcagtctaacaagatcccagatggtactgatgctctttgagaaccactgttctaagaataagaacagttaattttagttccagagtatgacttttcagaagtcatttgacctcttagcctcactttctttatctgtacaatagggaaaatacctagatggctacctcattgacaggggagagccaattaatcaataaatttgataacccttaactgctgaccttaactctgcaatgataacctgttatactgataattcaaatgccattttatattatttttatacacagtgtagaaatgtttatttcctgtggtatcatgtgtctttgttgtcagtatttgtcagctttcatgtgatatttttcccacctccctgtgaactcagaaatgaggaaagtagtttgcattccgaatatgcatttgggcaatagtatagatgttcatctatccaataaaccaggttcttttttttttttttaatggagtcttgctctgtcgcccaggctggagtgcagtggcatgatcttggctcactgcaacctctacctcctaggtttaagcgattctcctggctcagcctcccgagcagctgagactacaggtgtgcgccaccatgcccagctaatttttgtatttttagtagagactacggggtttcaccatattgaccaggctggtctcgaactcctgacctcatgatccacccacctcagcctcccaaagtgctgggattacaggtatgagccaccacgctcagccatgaaccaggttctttccagttttgtgagatgccagtataacccatttgaattaattaacctacataaagaagcaacagaggcagtcataaagggtagttagacagtctttatcccagtagagttctggtcacaaggctcttcctgatgtgaagacagatgtggaaggttttggctaaggtaatcagacttcctgttttgctcaggactgttctggttcatgcctgttggggcagaactattaacagtgcccttcttattttcaggactgcacctgctcagataacaaagttcatacactttctaactctaggcagtggacattgaatatttccattcttatgggcaagtcatccctgtaattcaactgtctttgcctgatgacattaaataatgttttaccttaccaaagtatcttgttctgatttcatttttaccaaatgatattctgatctccacattcatattttggtattctcagggcgttggtagctactggcgccaaagagttgctctaaaatgtgtgtagaatgaaagcgcagggctctagggacacatgctccgggaacacacagagatttgctgggaatatccatgggccccagggcacatttgcatatccagtgggatctgtcatttaggaaagattaaaaattttagttatcccttaatgttggaacagatagaccaacttcagtggtctgagagagtatggagctcactcccaaaggaatccttactatgtgtcccagatgacatacacagcattgactggcacccacgctcagagcagtcttctccaaaagataaaggacacatccaaattgaagtccttcgatctttgagaataattaaataactaactaaaggaaaatgttttgataaaatgcttgccacagtacctccctaaatatctataaagacagaagattctgattataaaacacttctgacaaagtgatagtaaatattctcatgtatttctgaaaaaaaaagaaagcactgatatccttctcttgacttcagtgtttcaggcccttgatccctgacaagttgaagtccctgggacttccaagtagatggttagatgtagccttagacagtaatattggtacaaatgaattctagatttatctcacttaacgatatctatagtatgtttacatactgttaagtattttctatgtggaaatggtaagattgtcattgaaactgttcattgctaatctgtaaggtagacaattacatattcttctattaaaaaaaattgaatctactattaatactggaaaataagaattgttataaactaattttccaaatcatgctgcttaagttagaagcatgattctttttcactgtagccaggaaagcactatttcacttataagtagtagtagaataaacagaatcataaaatgttggtgggcatcgaactttcatcgttgtactttattgagttgctatagaccattttgtgcctatttaaaagtattggcccggcgagatggctcacgcctataatcccagcactttgagaggccgaagcaggcaggtcacctgaggtcaggagtttgagaccagcctggtcaacatggtaaaactccgcctctactaaaagtacaaaacaattagctgggcgtggtggcgggccccgttatcccagctactcaggaggctgaggcaggagaatctcttaaacctgggaggaggaggttgcagtgagccaagatggtgccactgcactccagccttggcaacaagagtgagactctaccttaaaaaaaataaaaaaataaaaaaagtcaaaattagctgggtgtggtggtgcgcccgtaatctcagcttctcaggaggctgaggcaggagaatctcttaaacctgggaggacgaggttgcagtgagccaagatggttccactgcactccagcctgggagacagagggagactctatctcaaaaaaaaaaaaaaaagtatttttcatacagttttaacataggcccttcacatttagaatataaagagctgctgtgaaaattctagaatatagtcctaaagtttaaatatttacatttgtaattagagaaattggtttttattatacaataatttttattttttttttaattttggtatgtttagacctaaagttaaatggtaaagtcaacaggaatatagtaagcttaagataaccaatggataaaaatctaattaaagaatttgaggttataacaactaaaaaaaatctttttggaaaataactatgattttgaaaacatgctaaataatattacaagattggagttcggacagctgctctgtagaagtaaattaaaatagaagttctgttcttagctaaatatcagttcacacccttctctaaccttgcaaaaagaaactggttcttaaatagcatccgtaacccagaaaccagaagtaaataatagaagtattggaacatacgaaaacaatgcaggaaaaggccagatttcacgatattattttttctaagaaagtaaaaaaataactagcaggagaagaattttaacactctctgaccctaagtatcacactaacaagtgtatacaaaagttcaaactggggcttcccagatatttcttttataatggagcctgtgtaaggaggttatgaaaaacacagttagccaaatggctaaatagaggtattaggcatttaggtttttttgcacatttaataatgtgtgaaattattcccaactttaaaaatatctttacatgttcctaatgctgagagtgaggatgagacctcggcgcacccccctcaacactagacagatctgcagtggagaaacaaggagctaagggtgaaattcttgcattatttctacttttctgtaatgaaatggtttgagtacgtgggctgaggaagtggttacaagaaagcaggtaacatagtagttgaaagcttgaaccagatcgacctgggttggaattccagctccaagattttctggtggtataacctcaggcaggttgttttacatgtaggagactcagctctccagttgtaaagtgggataatagtgcccacctttatagggccaatatgggagtaaatctaattatttttgcaaaacatgtaacacaatttctggcatatagcaacttccaataaatactggctatcagtaattgaagacccaaggaaggtacagaatgtgtttctgaggcaaagggcccacatggctcccaggctttctcatctgagcaggtattaatttaggtgtgatcacaaacatttctagttatatattaaagactctaccttgccagccacatcataagtaactaatatattctgcagaatgagtggactgtggtttaattgttaaataaaaaatagatattacctttgcccatctcagatagtatcctctagtgctcaagaacattcattgtttctcagttgtctgctctgatagacccaacatatccaaattgaatatctattttcctctcagcatttctatgttttttatagacatacctttgtttgtgagatccagtcttctcaaccagctctttcttaccaattttgcctgagaaaagattactaattcttcaagattaatttcagatgccccttcctacactgtagcctttttagcctcatagcattatgtattttaaatatgtcttctcttactatccttgtacaaagtcagttattttatatatttttgtctcatcagtagttctgaaggtcaggaactctctctttcaaattatgcctctttaatatctagaaatgtattcacaggacaaatgttttgtatttatgtatctaattgaagaaatacttccagatcaaacaaaatcctgcagggacctgtaaaatatcaaaaggactatcaccttgaacaccaagaggggcctcctctgtgtagcctggatggaaaatgcctaaacatccttggtagtcaatggaagaaaactccctacttaaaggaataaaaggctgggacaataaaagtactgacctcttagggatctaaggaaaagattctggaccagaatgggcctaggcttgaagtggatctcttccaaaagaatagtgaatagtttttatcttttctaaaagatggattgaatggaattcttccatttgtagtagttcttgtaagtttaattaattttgtaacatcttttgagaatttaccacatgccactccttgagctgggtgcttactatgtgtttattattttaaccctcacaacaacctcaacaccctcatgaagtaggtcctattaggatccctgttttgaagatgaactgaggctcatgtttagcccaagttcactgagctagtaactggcaaagttagaatctgaaatgaaatctgcctgatgtcagaatgatgttgttcattcataggctgatattcttaaggctctaccccaagacaatagtcacggcgtcatggcacaggcagcctgtggagctagctcatttgctccaatccaaaaaaaaaaaagccaaagaacctcctttagctaattgcttctctttcagggaatcatcgaattatcagagttgggagagatgttagcaaacatttattcacatatttgaagaggaaagataatcacacaatttaagacgaggaagctcatcttaatttaagccgagggaggtaaagtaataccctgctttaagtcagtgaattagcagcagaattagaatctgaactctgatatccttatattagcctactgctaattcctcctaaggcaagaataaacagctttacagattaggcctgcaaacccaaacctataaagtgacagcatatgtcacaattcacataacagatgttgttttaggttgcaattgttgtcaactactctttctgccaaagtctctcttttttagatcatcagagcccatctgacaacctgtagaacttcagaggcagagaaaagaattatttctccctgtcctgtgctgtccttaaacctgagagggtcatgcctgacctgatgaaaacacccttaaaaaatcaaccatccagtagtccaaagccaatttcaaaactgctttatttgcataagcaatatttagaaccctggataccaaagatccacatcattgccagtggagaatggcttttttgccctctatgctggaacaataaaaaaaaaaaaaagatgaataatgtaacagtctggcttgaaacaaaaagattgctgaataaggtgggaagctcccagaactgaaattcaaatagaataatagcatggattgtgatgaggaaggcaagggaagtcgtcctatatataaatgactgggtgagaaattctctaatgagcacatacaggataaaagacaggaggctgggagaagagcccaataaccaagcgcaagtgtcagaagcctgtagaatgtgtcaaagggagaaaatgccaaagatgagaaaagtttataagtatgttcagaacaagaagatagaaggtgattggatgagtcaaccaaaagcccctctaggataacaagtcctactttgtcttcccccaacacataacagtttctctatcaaaggaaataaatattagattggatagggtataatactagtgagaagaagctgaagcccaaagatatgaggaaattttaaaccactacattggtgcagtaaattcaattcagcaaacagttattgtgcatctgtaataccctgacattttcctaggtaccagcaatgatgtccatttcgaggtgagtaagatacaatccctgccctcaaggctcgcagtctaggggtaaaacaaacattagacaagttagttatgtaacactgggataaatgcaattgctatgttgatctttgttactttatagagttacaaagaatgggagaggagcaggaagattgtaattgaccagaggttgatataatttttgaaaagaagctcaatcccccaatttttagattaattagcttggtgggatgatgccaatcatgagcaaaaatctggaatcaattagtgaaaatatagtgaacactaagacaggttgcaggtgatcactgagaatcatcttgagtttactaagacagattataccaaagtgatttaatttctctcttggaaaaaagtgaattagatttggagggaggctggagacccggtgtagacatactggatttctgtgaatgtttcactaggtcttcaatggcatgcttgtgaataataagaattgatatggtgctaatacattgagatggacttggaaatgccccttaattagtagatatcagttagaaggaaggctttttggtgggggattgtaagccccttagccttagtgtgactgtgttcatcctttctttcctgacttggatgatgtatcagtgagagagcccacaggacacagacagctgacttaagcagggaaatttgaggagagtttattaaaaggactatttacatgtggacatgttttaaaggaactgataaagagtagtgcagagtctcaggtctgttcaccaccactggcctaatgggaaaagctcagtccctggaatagctgtgaagccagagcagtcagcagaaggctcttgccctggtcagggtgtaggatcaccatttcctggcattgctctggcggaccttatgtttttccctgctgtggtgtatgtgcaggtgcctacctagttccccatgttcttcctcctccctggactcatcgtctgtacagagacctaaagaaattgttttcccttttctggacatcagccatttttctgtgttgatttgttgcttctgaagaccttcattagatagatctttcctgatgtaatccatcatggcatgggcagtttcattccccatagtgctggtgagcatttggcaaggtctcttttcatatacctgtgaacaaggactatgggcctgatgccaagacttaaatgcacctggaaatgctaattaattggtagatatcagtagatatactcctagagaagcagggctggaaacggaacaattacatttgcaggagagtattacttgacttcttatattgccttctgccattttcctggttaatttctaaagactcttcttactgctttggtaaataaattattcttagaccaatgatgctcagagtgtgcagtaattatccctaacaaatgtaacaaacgagttttgaattttgttctattgtgttgatgttgtcatgttttgtttcttttgcaagcaatagaatctttcttggcccaatgttcaaataacctttttcttatttgagcacatataaacacacaatcaataaaatttcccaagaaggaacaacataaatattttaaaaatatatcatagatactttacataaaatgtaatacctatgggactatttaaaacttattagttatttgattagattttcatttatttatgtggcaaattgaaattaaggaaactaagcatttgaattgagtgtaggaatattccctttcttcctttttttttttttttttaccatttatattgtcaaggtgaatccaagataatgatttgttgcaggtagcctgaaatctcaatatcatttctgaggtcaccctcatgtctagggggatatgtagagtagatcatatttatttatagaacattcagtggttctttctcacacacacacactctgcctcctcctcccaattccccctgctgtggagtctctattgcaaagaatccaaaggccccgttttaattgctctttacctctaaatgccttaagggatccctagagggatgaaacacagtaaggtttttgttttctttcctaacttttaaacttatgtattttcaaattactggaaaaaaagactacattttagcatgtttgtaatgaaaaccttcttaacataaaaaattatcctactatccttttaaaagagattgataccttgtcataatttttccgttttatagctgttttatagtcacttactggaaaaaaatgtctgtgagctcctcagctgcttgaggttaccttatcattttttttttttctacaaccgagattgtatctttttaactgcaaacttcacagtggaagcgttttcctttgtgaatactgggactacattcctgagcctttggatataccaatgcagactgctgcctttccttctctagaaagtcagccaagcataacaccaagagttgattagaattttactgcccctgattcacagaccttcgcttttcctcttctccctagcttccctttgcttagcaacaggaatgtggcaagcactgtactgccaacagatttctcttttgctctcctattgaaaagaacttaaggatataagacagcccataagacatcacacattttactaaattagattttttttactctgaatatgagaggcttcctctggccacaagattttcacaatatttctagttgaaactgacttaatcatataacaacatctgggtccctgttatctagtgaaattagcagaatgtcagcagccagcaaagtgccaatgcatctttcaactacaactctgccccctttcccccaaaccctggcactatttttataaatttaagtaatctaggtcaggaattaaggccttccttgcagtagttaaaagtaatttagagatgtgcacactatcttccttactctgttaatactgaagatgttgtaaattcagtgtgtcaattcaatacttctcttctttgagcaaggtgttgtgttagacaccaggcatgtagcaagatgaatgagatgcagtctctgcctttgaggagtggaacagacatgtatataatttattgatataatcttaagcagaatatatatattaggttgccaatatttgacctaaaagtgtaacaacctcatatgatacaacctagtaaaaagtgttctcattgtgctaagagaacactgagactgaagaccttaactgtaactgttggaatttgagaaggcttcatgggaagcatatcattttagtaaggcttcataatatgggtggaactggattccccttaaaccaacctccttctgtactagagagtaggaagcttgatcaaagaaatgaagagcaaaagctaggagttatacttagataatagcaaacaatccagaatggcttgagcaaataattcataggtggggcaagggaggacaaatatggctgagacagtacattggtatcagactccattgtattattaggctatagagaagcctcaaaggttttgaggaagggagcagcaaattcatagctatgcacctaccattccactgtccttgagatttgcacttgctgctccgcaagatggactgactttctctgacccagaaagttaatagacaaatttgacattatcttataacagccattttgaaacaaatatcaacatttataaacgagtccaaagtgaggtggaaaaggaactaataaaaagttgttttgatagaaactgaagctgaaaagaaatgggagcagaggttgcaaacccacatgcccacaggatccagacagcatagatagagagatagcactccacaaactctggcccaaatccagcccacctcctgtttttgtaaatgaagttttattggaacacaggcctattttttttcacatattgtctgtgactacttccatgctgcactgcaatagcagagtttagtatagacactgacagtatggccaggtaagcccaaaatgtttactttccagccctttgcagaatgtttctaacccctggcattaaacagcaacagaaaaaaaagaaaaaaaaaaaacaatgaggtgatttatctatcatttttcaacttttctgacagatgttggtacaggaaaatatttccaacaatgaaacagtagtagaaagaaacatgatgataaatgtcaactggcagaaccttggcctcagactcaggcatgaataggagaattggggactgtggcgaattggagagctcttgttcactgctattcagccccttattgataccctgtgaccaaatcttcccagttttcagaagaacatgtaccttgggaaaggtatgttatatcttccagttcttaaacactggcagctaacaaaatgaaacatttttaaaacttggggacccaaaagcaacatttctgtggtctggatttgtttcatgaccatgcatttgtggattctggatttgggaccaagacataattcgaaaagagaagggaaaaggtatgagaaggtaaattgtacaagaagatgaatggagtaataaatgtatggttctcacgtggctggtaagactgtgaaagagacaagaatagtagtcaagaagatgaaaaaacccctgcttcttcctataggtcaactttgtgtgttagagctcaattagtttttggtgcactgggaaaatgattcaagtatactgacagtttttattattatgtttattgagccaattttccctccatactcatcatttgttactcaaaaatgcaagagaagaaaggaattaattgtgcatctgaaacttagatatctatttaaatcagaaaataaaggagattaaagaattacatgagcaaaacacatttcttggtccttttcatatgcatatgaggagaaggaaatattcaaggaaaaaattcagagtaaacattactttccatgagatattaagtttaagtaaatatccagcaaaatttacacccttaacaattaaatatataaaacaaaaattgtttgccttttcagctaattaccctgaggacaggacgttgtttaacttgtttattcccaaatcctcaggggccagcatagtgcatccccatagaaggcacctgctaaatttgtagaatgaatgatacatcaatgaatgagcaaatggagccccacctatatcccatattgctgtgtcttttctttcatttctggcctctaaatttgctctgatggcgttcttttctctctcttctgtttctcttgtcttcctctcccattcttttaaaaactaaattgattttttcctacttttggccaagtcatttactgatttccattttctacctgtgcatgaaggtcacttcagcttggactctttctcaactctctcatgtaatcttcagtttgtgtctgcctgcttacattgctataacttgaattactgtgtctgttaacaacaacaataaaggtaacggcaaagtggtaggggaaatgttaaacaacaatcgtaaaagggagtaaatgaacccttaggtagaaagttagaaggactgaatttatctgtggctgttgaaaaactaaactacatacattgttaagctttaagggttgctcttgaaaatgttctcaggctgcccaggacagttattgacctatagggcacactcaatacatattaattctctgctcaatgtagtatgacaaagtcaggatcaaatattcatacatccagatcttccagagataagatggattgtaatatctatgtttcttctaggtcttgtttcaagtgcatatcaaaatattggtaatatttgggttggaagagaatagtttgcatattattattaatgttttattaaaaaaatcgctcttttagacctgcaattcaaaatggtctgtgcatttgtaaccatgatattatattcaacttcacattttctcatctaagtacatttgcagttgtcgaaaagtcagcattaaatcaggtttgtacaattatggtatcttatggttaaaattaacagaatccatttagttcattctcttaatttttatgatgagaaaactctgatcacagaaatggtctctatggcaaactttattgaactgcatttatatatttaaagaagtgctaactgaaatagtgcaatttaaagtttcatataaaagtgcatggaaaattgtaaaatttattctctattgcaactacagtataacaaattctatgtcatgtagatggctacatagaaattacaaaaaaaaacaactaatgaacattacaactaaggtaaaatgctttaattacattatatcaaataaaatttattcttcttataaaaagcatccctcatattctaaagatgttgtaaatgttaattggcctgagaaattggtgattgagtaatcaagaccccggtcagattacagacaaaattaagtacaaccgaaggtgaaattttatctggctcatggagattaaaagcaatataaggtttaatgcaaatttatcatttataaaatttttaaaaacatgataaatttttttaagaggcgaggaagacagttaatgctgtattaaaatagcagccatggttaacttacgttttaaaatcattctctacaaaaaactaggggcaaaaaaattttagtttaaaaagttgtaatatatagtttgaaagaatagcttataagaaaatgttagtaatggggtcatccccatggacccaaatcactggacattaagcaacgcatatattatagaattatcaacattagaaaatgcactgaatattaacttgaaaagtttttgacatacagaacatgtgagaacatgtgaatgccataggaatttttaaaatatgtagaaaatataaatctggaaactgtcatttcttatttgctgtttataaatggctgtatatgttgttcctattctcttggctatttaaagtaaattaaatttaattgatatattctaatcagacatattttaggtgatattttgaatgctaatagtgttagactcaggttttgtaattttatttgcaaaacaattcaactttccctagaaaggagacagaacataaatgaaaaaaatgaccatttattaaaataatcgcaagtagcagcatattataaattgttatgtttaacaaaggacactatacaatttttcattcaacagtactgattgagcatctactatgtgtgaggcactgttccagtgtttctgcagcccagtgaacatgacaaacactactatcattgtgaagtgtgcattctaatagccgggcatatttgtcatctttgtattccaggtgacacatttgtaattatgaactctaaaatgtcatattgtgcttaagtgcctttaaaagcgtaagtaatatgttagatgatgcttcatagcttagaacatatccacatgcatttatgtaattcttatcatctagggtactttgtttattagaggagaaaactgagaccctggaagtcttactgacatcatgagcctacagttactgaatggaaaagtgaggcttgtccctctcattgcagggttgctgtggtttaactccccaacctaccctaaacagccttttggcaaaagaccaatttattcagtataccttgggagaaggcagatatctaaatttatcttgcttttggcaagaaaatgaatatttggtggcataaaaatgatcacagtttgagaaatactaggaaacattctatgagaaactaatgtttagcaacgtatcaatttatgacatttgaaagaactaagagtgaatgattgcttgaaacctgaattggactgctgatcatagaacaagtttaacccatgggaaagtgggaagtatgtttcagaatgatggaataacctgtcatgcaaaagcaaagacctttcatggagactggtgaattcccagtctcagactttgatggatgattttgtcagctgttttctctctgaatgtgttgtgtctcccagcttactactgaagcaaggaggttcactggaattcacttttccaaaagcagtcagggacacaccatcctttctttctaaagtttgtgcctttttcagcttagaaaagcacttgcctttctatctctgacaagtgactgtgcaaaactccatctatgacaaaatggaattgtgcaagagtaatgaagggatgagaaatgcatctcctttgacaggccatgcaaacccctttactcacattattacagtgatagttgtaaaaggaggaggaagtagaagaactggtattgagctcctagtgtatgtgaagccctctctatgccttccagccctacaccctgtgttggtagtgttactgttattcctgttttatagataagaaagctgaggtgctgggagaatacagaactagagctgcgatgttttcccctcctttttatgttattgtgtattgcctcctgcccaactctacagacagattttacttcctgaatgtttattgtgatattatgtcttaaataagggatagtttttctgactgcttcactgatacacatgaacccatgtgttccaccttttataataggtttcccataataacacatggtaaacaacaaattgcattgcttccttttcctattttaatatagagtcatgtcatgttttcctttaaggcagaccaggcacctgtttcataaattggcaaggacatctgcaagttgcgtctttagtctgacagaatcaagtcttggcaggaagttgtaaatttctctttctctacaaggtgtcagtcctcttaaaagcattttttagccatgaactctttgtgagcatggattgacctacaagaggaaataccacttggaaggatatgtgtaattcatttccatttggaacagcttattgtatctgccaggcactcagctgaatgtgcagtgttcctttatatctgcatattttaaataaaattgtgattaaggtcattaaagaccctcatattagaagtgatcaaatggtaattgaataaagttcaacttatatgaagaaatctttaggaacacagaaaaaaaatggtcattttctactatataatctaaaaggtattttttaccccataaagttcttaagaactcactccttgggaagaggtaacatactagctaattggtatacttctgatatagaattctgctaagaatcaacctctggctcttaaatacttggaataaaagacataactctactcaaaatgtgtacggaagttttgtggttcacaaatgcaacagcttctcctagatcttgagttaatcagctaccgaatgctgaaagttctctccagtcctgttatgtattggccataaacatgagacattgatataatcataatttactgctgctagtaataaatgaagactcaagcaataagtagcatattacttgcatatttatgttgcagataatatgcagtatattgcatactattgcatatatacgttattagtctaatgtaattcatgtgtgtgtgtgtgcacatgcatgagtgtcttctcttttgaggaaaactccagctatgtcagatcagaccatatactggcacaatgagccgcacagatgacagaagcaaaacaaaaacaaaaacaaaaaacaaagtctggaatctgagtgctctattgtatagtatttgtcttctaatagactaggaattgcaagtcttcaggtgataacacttttgttatttggaataaatttcattgattttttaaatgtctttactataaatacataccaacacagagataagtacttatcaaacacttggtgcttatttttaagcccaaatataaaatgcatgttttttataatagagagctcaaagttacattactagaaaattattttataaactttatcaaattcttcagaaaacagataaactctatttcatttgagcagagacttcttactttattgcactgatggtaatgcaaaacaaaaaaaaatccttagtaagttctgttctttttttcatgaaatagtgagagtttggattatcattctctcaactctacataataattgcccttattgacttgaacacttcttatagtagtgtagtgttaggagaaacatgaaattttgaaccagacagaccagagtttaaatctaaatccaacctcttagctgctttatattgaatagttctgaatggcagtttcttcattctttaaatggaaatagaaatgtactgtaatgttgtcttcaaggttaaaaagaaaacatattaagctcctggtgtaaggtctggaataaagtaaaagcttgaaactggcaatcattgttgtttggatcagaagcaagaaaaaacagaggaggggaatgattttgataaaatgaaaggcattctggcaggagatgagccatgtgtgattatcaaaccaacccaccagtgagaaccattcataattaaaatcattggcagagatttttacagtccctctacaccagttgagtatatttcacttgcaaattctgccctttttaggttttcaattcatcggagagctacagttgtcaatattagtatggcaaagcagggaaactatagaaatcatgaaagtattctcatttagatttgtgcaggaaacagcattatattgctaatgaagataaaaaggcaaatcaatcatttcagaaataattcacctaatcagtccaccattttttggaaaggaagaactacttcaccaaatgttaccagaggttagaaaactacaaatcaagatcagtgttattccttgtaaaccttctgtgctgatgaagttcaaatgtagctgttttataaggttgattttataagattacaagtttcccttccctggcttaatttggggaaaagaactcatctttccccccaatagacatccccttctaccacaaggtatccagtctgattttgagattaaagagttttatttaaactctgagttggatgttacatatttcattcatctccaagccagttatgttcaaattctactttctgaatccgatcagcaagtctcagagaagtcagggttggcaagagaaggggaagaattttgactttcctctgctgtattgtacttcatgttcactttgaaggcttcagaaccattgcttcgacttagtattttatcagcgaggtgcagaggaggccagaacatagaagtgcccatcaggatggaaagactttagaacttttcatccctttaatctttgtaaatgcaaaatgtgttgtgtcaaaggaacgtagatcttatactattatcatcaaaagatttgaagttatttttcttctcaaaaggaatctgtgatatcaacagttgcatattgtttttctgttgtaaatcaaacagcttggaagaaaaatgttgccatgttttttgaaagggcagcacaaactatgatcattatggataaatttgagagttcatcctcatgaacttttaatgtttcaactgagtggcagttgcaaataaaagcgatgtaagatcaaagtgtttaatattatacacacatacacacacactatattcaagattttaccatttgtattggaatagattgtttaaagaaattttatagttgaagcattgattgatttttccaagagtttcttttgatttacaagcttgtaagtattctaacataattttcctaggaaaatttagctcttttagtattttgtacacctataaagtgttctaattttcatgtctcgctcatattgttatccaatgtatacatttttgcatgttattgtgaaaatattagattattagattttttgcattagtcataagggaaattattgtactgcaggctaagtactctcagtctgatccaaaccttcctatagggctccaaattagccattctgttcaaccttttcaccaggcaattcagtaaggggaaacaagtcaatctaaggggtgaattttgtaatcacagactagtaaaacaataacaacaccttacatagcagcaaagaaagctatggaatgcaaaattaattaattccttgcttttccttagagaatttggatttatacttaattgagctaaagtacctgactagcctgggatgtgctcatttgtattcatagtgattttagatgttgtataaagatggaaagcaactaagtcattatttatttctttagactgaaattataatttataaagagacttgggaagaaaaactgagattttcattgaaaccaaatttgtgttacctgagggacaggtagcagtcaaaaatagatctatggtatgctctttggcccagattaataatatgacaaacatttggattctgttccctttgatgaactgaaggaaatgtaattcaggacagaatgccccaaataataacgtcgattttgttagtcagaattagagtgatttctgttttctcaactatggatgtaagtgatgattttaaaataaaaacatgataaaataatttgttcaataatgcagtggccttccagcatatatgaatgctttacattgaattaaatcaatattaagtgccaagtataagcagtaataataatttatataaacatacagaattttaagaatataaataatttgtggaattcaatttctacatatgttttgactatgaagagctgggaattacctcattcattcacttcacttggcaaacagatgtcttaatttctaggtttaagcaattgatttcatggctcatatctttgtagtaaaagaaatcatttaaacatgtagaaacacagaattttagaactgcaagggcttgtgtagtccaggctctctcaagaatcagccaggatgcttttgggagcagataacagaaaactctgctcgaactatctcaaactggcttaaacaacgacatttatttatcatctcacataaggatttttgaggtaggctggactctgggtgtagtatgaaagtttccctgatgttcttgggatttggatttggtctctacaaagcattgctttttctgctgagattgtcaataagatggatgcagtagccatgcctttgatgttcagtgaaagctgtgagagagtcgttctttcctgcactgttttttcgggaggaagtaacttcccaggtgcttcccagctgaggcacttttattaaatggttaggctttatgccagagatgagcaaatactgtgatttatataaagagatcctgaccatctttgggactgggaataagggtctactttcctgagtcacatgatggtgaacgtcaacttactaaagctggggtttcatttgagaggaggaaaaggagacatacatgttctgtagataatcatccgtcatagccacctccttttgcagatgagggaaataagggcccagagaagacttctaatgggtccagatcacaaacatagatccatttagtccagtgttattttccaccttatttacaaaatgtccccagtgcttttttattaaatgtcattctgctcctacttgtacttgcaagtgaagataaattttacccaatagagtgtcttcagttgaaaaacagctgaaacaaaccactttgattttctcctttctcagggaagagatctctgtcttcccaagagcccccacagacctctgcttcttagaacttttcacagaggagttttaaattactatgattacttgattacaagtttttccttttagtaaatattatgagataaagcccacttttttttagtactcaacaaaagaataagcaaataaatcctgagatttttcattcccaaagctataaaacttgtttaagcattgtcgtgtgttccaagatgaatgtactgtacttctaggtaacatgtagacatggtctggtcccatgtactgagatagcgtggtagaaaggctacataaaggataggcaaacagaagaatatgaggtagtctgtgtcatatgccagatgagcactacaaataataaatgccctcagacttcaggaaagttcagtgaagagggccatgatgtttggagactacttcatagagaaaggaaaacttggactgggaattgaaggaggagtagaacatagacaaatagaaagacacagatccaatccaggaagatgcactaagaaagaaaagttagatttactctaggagtgatagattagtttgatgaggcattctctcagtgggagtagaaaaaatgaaatcggggaactagaaagtgagggagatggtagagactgtccagtctgggataagacgttggactatgggggaagctattgaaactctatgggcaggattttgacataaaaaaatcaatgtttataaagattaattttcaaaccatgtgtagaatgggatgtgagagagaaaaagtagtcaagcagtaaagtagcctaagtataaataaaaattcaaaattaaaattaaaaaaattcacatgaagagaagaaagcgataaattttgaagaattgacaggacaagataactcattggacacaggggctcagatagcttaaagcaaaattcctaggtgtcgagctttaaaaaaatgatggcatcattaactgaaatagcaaagttcagagaagggttttttttttttttttgagagaagatgattagttttgtgttacatggttttggtttgcagcatcagtgggatgcttagagatgcccatcagacagctggagacgtgcaaatgcattttaagtttagcagagctagtgttacagattagagaggatggcatgtgcgggtgagaggcaaaatcatgtgtgggtcagagatttacagctcttagcaaaatgcctggcacatgtttatctcaatacatatttatcgaatgaaaacaaaatttttaaccagaatactttgggttggaagtgacagaaatgcatcagaaactgacttaaagtttgaatgtattgggtcatgtaacaaagaaatccaggaacagcgctggctttaggcatgactggatcaatatacttacagggttagggatttctaactctcaactctgctttgttgtgtgttagctcttgttctttgtgagctccctgcttttctgacacattctaccagcttagccaactctgcagaaagaaagctcatttttttttttccaccaagttctgagtaactaccaggattcagtctgccaggaaaaacttgaaacattccaccattcctgaaccattcgctgtgattctgatgaactaggctcttccctagaatcaggggcagtgagcatagtgctcaccagcatacacttaaacaaaacctaaggggataaggaggaggttagattcaaagaaaatcagggttcttttgccaaaagagaggagtatggatgctaggctggtaaatttaatatatgtcccctattggaattaggaggaaggctaacgagctaaagcctggacctagagtatactcacatttccaaggcaggaagaaggtggggacagtgaaggggaaacaaatgaatccacagggaaggcttatggatgaccacgaagcacagacgggagctaatcgggtccatttcttgatatgtgacttctgtgtaaggcttctccagacacgacaggaccccaaaatggcatgttcccttggataaaatgtaacaatatctccatccctgcagggtaggttctttttcagtaatttagacatacagcaaaacattcaaaagtcgagactgtagtaaaataatagctacttttaccattcttatgtctttggttaccagattcaaagcatgtgatttcgacattttaagaagagacaacatcctaaataaatgattttctttctggcttttatagctcagggttttcaaagggaagtggacacatgtcagtacctaatgattcaaagcttctatttctttattttctttatatattttaaggcctacccagtcattgcttagcttcagcccagcaaaagctggccttgctctattgtcactctgcctttcagcttccactgtgcattctgcttccacctctgtgaggtgtaagtcctgccacagtctagtcagtggaggatgggtcagtactcctgcttcagtgactgtgtggccacagtcagaaaatattttgtttggtcatcagagctctcaggaccattactggcatatagtaagtgctcaacaaatatatgtggttattaatattactgtcatgattcttattacaaatctacccacttggcaaatgccagctatcagtgcattactccatgaaggaaaccactcctttgtgatcttatttttctccaggagatgcattgtggatctcaagaaagagtgagtccctttagtgctagccagatcactgttctttgatgtgaacctcacgttcaatattttactttttgaatattccttcttgtttctgcttttagtcatttcaatgcattttggtttggttccacattttatagtttttagggctatatggtgccccctgccaagtgcttgtatgtttggcttatttcttaagacacatttactatatgaaaagtgtaaaatttaaaatacagcatatttttgtacatgggtgtgtttctatatatgtgtgtacctatatatatacacacatatacgtatatgcatatactcacatatgtacaaccatcagttgttacctaaagctttcatgagaatgaggttttaggcatgccatttcttgtgaagaaaatcgtttagcagatatctcaaggatgtattttttcttgaaaaatatactcataacaacagctgtgattattcccgtttattttgtccttaccatgtgctgagaactgtgctaagtaatttacatacattgtcttatttcatttcacctctacagtaaccctatgggttggtatcaacccttttgtctttttgtttttgtttttttgagatggagtttcactcttgttgcccaggctggagtgcagtagcacaatcttggctcactgcaacctctgcctcctgggttcaagcaattctcctgcttcagcctcctgagtagctgggattataggcgtgtgtcaccacgcccgtctaatttttgtattttttcagtagtgacagggtttcaccatgttggccaggctggtctcgaactcctaacctcagatgacccacccaccttggcctcccaaagtgctgcgattacaggcatgagccaccgcgcctggccctcatcccttttttatatgtgtgggtgctgagaagctgagatgtgaattatagccaggccccatatggaggtgtatctgtataaactataaaaacatgttataggttttagggctatgtagtcacccctcctaagtgcttatatgcttgacttatttattatgacccatttagtttatgcaaattgtgaaatctaaaatatagtacatttctgtacattggtgtttttctatatatgtatacatatgtatatacacacacatatgcatacactcacatgtgtgcaaccaccagttcttacctaacattttaattagagtgaggttgtgatcatgctcttactgattgcgtgaactgctgcctgccaattccattgctcttcactccattggaaacagctccatacttcaattaaagcaccatatgagccagaaaaccactattaataaaaaatattccgtggaatagaaagcatttattaaattgctattctgatttagttttgtgatgcttggatattagaatatgagatcaatagccatttatatgaaaggggtttgtaaaacatttttatatacattttttattttttctgacgattttttagcatgcatgttttactctcctagatgattattttttcatgttgtgctacaatttaaaaaaaaattttttattcttttgggtaataccaatggtctctctagggaatttaaaaagagtctggatatattgcataaatggtgtatttctagactagcactaatgactgggaaatacagtgactttgagagcatgccctgcaaaaatgcttgtggtgaaatgcagattgctccaatttcctgctgaaatgtccatctctgcagggagtgctactttccagggttataccatcagaaatcaattctgctcatggagattattaaagactcagagcaaataccaagtccgaaatcaatgtgatgtgattatacttatctgtataagtaccgacaatttttggtcaccaagaaattatatgaattttaaaaaatggtttaggtgagacttagccatcagaaactaatttgatttctaagagagaatatttagaatgtagattttagcaagcaccataatatataagacaagtacactatatgtctgtttcttatttgataagaactgtgctgttctttctttaaaactgcagtttacaaaatatgtcgtaacttaaactggcatatataagcgtgatgtggcaaatgttcctcagcaaattttcaagggattggaacatttcccaaccttttccaagcaaagatataaagtatattcttttggaatcccaaaggaagatattattaaatacaaatggagagaattttgaaattattgaacaggctgtttatatttcttcccgatccaaagttttagtattattattttcaatgggtcatcagattttacagagaaagattaattttttaaaaaacttttgttacatttggaaaattttggattgcaacacttctagattcagagatattcctagagcctaaaatcaaatatctgtatttctccagattaattttgtttggggtattatgatatagttgcaaggaaaaaagtactcatcacatcctttcactgtattttcttttccaaaaatgaacccaaatagttgaaatctaagatagtgaatagaatttgaaccatttcagtgataaacaatataactgttgaaacaaagctaacatgtacatatccaagaaaaatttccaggcacatgtctattttcagtcttgtctaggtttatcccatttatgccaggtaaagatcaagttttgtttttgttgtttttggtctaatgcaaagaatatcttaagaacgcattctttggcagcttattatacactgtacattagccccaatattttattttattctcatcattctctgaagcagaggtttcgaacaaatgtctccagggcttgaggggaagtatgtgactgaaggtggggattgttgcaaactgattccctgtttgaaatgatcagcagctactcagcttcagcagagtgtcggtagatggaaatttaaagccagcgtggttaggattttctaatttttttttttttttttttttgagatggagtctggctctgtcgcccaggctggaatgcagtggtgcaatcgctcggctcactgcaagctctgcctcccgggttcacgccactctcctgcctcagcctcccgagtagctgggactacaggcgcccgccactatgcccggctaaatttttgtgtttttagtagagacggggtttcactgtgttagccaggatggtctcgatctcctgacctcgtgatccgcccgcctcggcctcccaaagtgctgggattacaggcttgagccactgtgcccggccaggactttctaattttttaaaaggaaatataaattcctttattattatgattaatgtgaaatattctgatttctatatgctatggactaattaaatttttaaaaataatgcatagactgataaaacatatctgtgagccacatgtgacccgaggatcaccgatcatcaaattcttgactaaagcatgacaccatatgacatccttatcaaataatatttattgagatcttgagtgttctctggcaggtcttctgatgtttgttagcagtggcttgctctgcctggttctttgctcctgaatctccatttcccttaattaattccattttattgcctaaggatgaaattcttgaattaaaaagaaatagtttgacatcgtataaagcccatgtattagtccattctctcgctgctattaaaaactacctgaggctgggtcgtttataaagaaaagaggtttaattgactcacagttccacaggcttaacaggaagcatggcttggaggcctccggaaacttacgatcatggcagaaggggaaggagaagcaaagcatgtcttctcatggcaacagaaaagagagagagagaagggggaagtgcccacactttgaagccatcagatctcatgaaaactcactcacaatcactaaaataacaagggggcaatctggccccatgatccaatcgcctcccatcaatcccctccctgacacatggagattacaatttgacatgagatttggatggggacacagaactaaactctatcagcccacataagagtccttgatcttattattaatctagtgctgttatcaaggattctttcttcttcctgagaaaagtctttatcttatattccacttttagagatttgtactctgtcttatttactgttcctaaaaaatcacacccagaacacaagcctttataggattggggcttccattgataaacttggtgtggttagggtttaatgttcacccctttttctgcaagcttatagtttgagcccttcagttatttaacaggcctcattgatgccaatttcctgacttcctcaatcttcattgtctctttctaaaatttcttgattttcaagtctctttgtttcatgttgatatcaacgatatcccagtgacttgcctttccagtttttgtttgtttgtttgtttgttttttctggattctgggttctacatgcctggctggacttttagttacagctctttccgcctcagtggtgaagttgcttcttggctgtctcagcttccagacattgctctaattaacccattcatatctgtggtagcatcaggcaaaactccttgggaaggtattacttatagaactgcttttattatggaaacactgtaaacaaaaacaaggaggaataaaaccttgctctctttatgtcctcatgcaattcaaatggacttaattgttcttatccgaaagttactgtgcatgtaacgtatatgataaagtagattggtggttatttcattagtatagtccattgatacaagaaaaggagtgatattttttaaatttcctgctgatttatgaaagaataaatgctagtgctagttgaataaggtaacaacctattaaaatgctcttgtagagttgaaagagaagagttagaggttattagaatgattaggatattaactgttaaaattcccttttagagtgtcacatcactttgggattattctcaaatatggtaatccataatatattataatttgaatcagtgaacttgaagaacagccccaaagaactgaacattgatatggaaattttctttgaaaactaggttttaaattccaaattccagaaagcttaaactgattttcatggaacttccatcaatcatgtcatgttgattcattttgtttttgaggaaagacgaatattatcaatgaattgtttcatccttcttttgtcttttctttgcccacctgtatgagattgaaaagagtgaacagtaaattgccaaaaagctttgaacctgatgtatgtcaagagcataagtaaattctccattaaagatatttgaaggttgcatccaaaatgttgattgagtatgctccaggaactttaattacaatgatgtagcaaacaaaattctcgaattgttgattgtaaattgagccttctctggcttcatatattgtgtaccatgtcctgtaaaagcttggttcagaagatagagaagttcctatttcaaagtatgtcaaagagatacataaacatacaaataataatatgtgtatgtatggaagtacaatgtgaaaaatatacatggacatgtattagtattcacatatgtatcacggtattctgtggcaaatgggctacacattagttggtttgactgtgtgtcctctttttattgcttatctctggaaatctttggtaagattccatagcacttgggctttggtttgtaagaacttaatgtttgatggcatggggatatggcatgggtgtatgtttggaatcttcaagtaatagtgattataaggaaatatgactttaaacaaaatcaaagagaaccagacatgagacatgtctttgaatgttgtcttcatagtaataccttggaagctatgcatttaatccagagggctttcatgaacagttttgcatatatttgggaattgtccttttaagttgtaagtatgtcttaaaattattttcagtggtggcaattattcaccctttcaagataaatgtgatcttcaaaaagagtaaaatgatacaggacgtcaatgctgaaaaataagataagctataaaaacagataatatggcttgtgaatttttttaaacacacaggtttcagataatgaggctacttttcttatataaccagtaagagagttgtgcatgcaattctttttttaaaaaaaaagaaattcaaacatgttctgggcaacatcagtgtcaatgaataagtacatgtttttccaaagtgattttttaaggtaaaacacttatttgggtatataagttaattaatttttatttttctgcttcctggagacagtagtagtagtgaggagataaatatgaatagagacaacataacatacaaagactactgctagggttgccagataaagggttggatgcccagttgaattagaatttcagagagacaacaaataatttttagtctaattttgtaagtatgttcaattcaatatttggacatactgatgctaaaaaaattctttgttgaaattcaggtttaatgggaatctcttattttaagttgctaaatctggcaacccccttaatgtttatcagtagttacatttattttattttattttattattttattttatgtttggagaaacacctgtagaatatcttctatgtaacgatgtgaccctatgtcttgtggaagttacagagtacatgccttcctcagagtctacactttagcagagaaaataagaaatgtgtggttaaccatgttttgagagaaattgaagtgagtgctccaggagaagtacaatgaccattcagagataaagaggttacttctggttgagaaaaccatggaagggacaattgagttggtattaacattagcccgaaaggattaacaggtttttacccacctggagatagggaggaaagggcacatccaggtaagagagcagcactggaaaactcattcatttggaaaatgattgggtgtatttaaggaactacagtttgtttagagcagtggtcctcaaacttcagcacacatcagagtcatctagaagacttgttaaaaatacaagtttttgggacccctaactagactttctggctcagtaggtccctatggggaaataatgtgcatttttaacaagttctcaggtgatgctgatgctgccagtatgtggaccacagttagggaaccatgaaatagaatgcagctctgggaactagtggaagatgaggttgggaagttggttggggtcctgagggccttgtctgtcttgctcaggagcttgagttttgtttaataggcagtggggagccattaaaggctggtgatcaaggtgacgtaaaagagttgtacttcagaaatatttatctggtggtagtgtatgggattgattgaaaggagtagcaacagactagagaaaaaaggctaggtaagtagctattacattagacagaacaggaagtcaaaagcccaaactggagaggtaatatcagaatggacggatgcttctaagaactacttgttatctgtataagtgttagagaatcagacagtagattttctttagcagactctttcttcctgagaagccagtttcaaaattgataagaatttggttttccaagattgcttaaagttttgagaaaatagttactgaagtttttaaattaaataagcagcttttgcctgtttggttacaacagaactttctcattaaacagtaatcagttaaagtacgggctgttttttattaaaacagaatggaatacttgcacgcagcacaaaggtcaatgcataaagctgaacagaaaaattgatagacacacaatgtggtttcacagattgtgtcattgacatcttatttcaattcacaaggaatacatcctgtgtctttaagacgtatttctgagggcagctctattttctatactcaattatttatttaactcctatttagttataacatttcttataggccaatatctgccagaacctatcataggatctgatttagatatataaacaaagtaaaacattcctttcttaggagcgacatttaaatgagctaaaaactgatatggaaggggtgttgaagaatcacaatcaatgctcgtcaccaactccactaaccatgattagcattgctgaaaattagctctgttgctgccgacatgaaacttactaattttcacccctgtttcttagtaaattttaattagtttttttctgtgaaaattctatgtgtatttccaaaaacaacatgggaaagatataaagaataacataatgatcacacgtaattacataatcttaccaatcagagaaacattaaacactttggtgtatatgcctccctatagtatatatgattttgtgacccgatttttgttaacatcatataaactttcttatgccaattattattctttgaaaacacagtttatatagtgtcatataaaatataataagttactacataagtaaaaatattaggtgtctttcagtttttactatgttaaatatttctgcaaaatatatctttatatctgaatctttctgctcttctttgacggtttatttctatcagataatttcatatactaagctggtttactacagaaacataaagtggaaaaaagacaccttattcaacatatggtgctgggataacagcaagccacatgtagaagaatgaaactggtcctcatctctcaccttatataaaaatcaactcaagatggttcaaagacttaaatctaaggcctgaaaccctaaaaattctggaagataacatcgggaaaactcttctaattggtgtagtcaaagaattcatgaccaagaacccaaaagcaaatgcaaacataaatgattgggacctaattaaaataaaaagcttctgctcagtaaaagaaataatcgtcagacaacacacagagtgggagaaaatatttgcaaactatgcatctgacaaacgactaacatccagaattatcgggggaaattcagccagatatcgggcaaaattcacccccaatatttcacataggttcttttctattttccctaagtgttgaacagtctgagaaataaagggacagagtacaaaagagagaaatttttaagctgggtgtccaggggagacatcacatgtcagcaggttccgtgatgccccacaagccacaaaaccagcaagtttttttagtgattttcaaaaggggagggagtgtacgaatagagtgtgggtcacagagatcacaaggcaaatggaggcagggcgagatcacaggaccacaggaccagggcgaaattaaaattgctaatgaagtttggggcacgcattgtcattgataacatcttatcaggagacagggtttgagagcaactggtctgaccacaatttattaggtgggaatttcctcatcctaataagcctgggagtgctatgggagactggggcttatttcatccctacagctgcaaccataaaagacggctgcccctgaagcggccatttcagaggcctaccctcagggatgcattctctttctcagggatgttccttgctgagaaaaagaattcagggatatttctcccatttgcttttgaaagaagagaaatatggctctgttctgcccggctcagcagtcagagtttataaggttatctctcttgttccctgtacattgctgttatcctgttcttttttcaaggtgcccagatttcatattgtttaaacacacatgctctacaaacaatttgtacagttaacacaatcatcacagggtcctgaggcgacatacatcctcctcagcttacgaaaatgacgggattaagagattaaagtaaagacaggcataggaaatcacaagggtattgactggggaagtgatagttgtccatgaaatcttcacaatttatgttcagagattcagtaaagacaggcgtaagacattataaaagtattaatttggggaactaataaatgtccttgaaatcttcaccatccacgttcttctgccatggcttcagccggtccttccattcggggtccctgacttcctacaacacagaatcttcaaggaactcaaagaaatcagcaaggaaaaaacaatcctatcaaaaagtgggcaaagggcatgaatgaacaattctcaaaagaagatatacaaatagccaacaaacatatgaaaaaatcctcaacatcactaattatcagggaaatgcaaattaaaaccacaatgagataccaccttacttctgtaagagtggcaacaatttaaaaaaattaaaaatattattaaatgttggcatggatgtggtaaaaagggaatacttttacactgctagtgggaatgtaaactagtataatcactgtggaaaacactatggagattccttaaataactaaaaatagaataccatttaatccactactgggtatctacccaaaggaaaaaatgtcattgtataaaaaaggcacatgcacatgcatgtttatagcagcacaacttgcaattgcagaagtatggaaccaacttaaatacccatcaaccaacgaatggataaagaaaatatattatgtatacaacatggaatactactcagccataaaatggaatgaaataatggcatttgcagcaacttggatggagttggagaccattattctaagtgaagtaactcagggatggaaagccaaatatcatatattctcacttacaagtggaagctaaactatgagggtacaaaggcataagaatgatataagggactttagggactcaggcggaagtgttggagggggatgaggactaaaagactacgtgttgggtacagtacacactgctagagtgacaggtccaccaaaatctcagaaatcaccactaatgaacttatccatgtaaacagaaaccaactcttccccaaaaactattgaaataaaaaaggaatcaaatgctatctttaaaaagataaatgaataatttattgttagatacaacattttaatgcagtttggatcagggctttccaacatgtttcacttcagtgcacatagaaaaccacagagattgctcacagcttgaggtgaaggaggtcagtattttgactgtctgtaaccaataactacatactcaggctgaggccagattatcaaggttttttattctgtccttggcattcttgtttgttgatagcttatgcttgtagaaggggagactaatttcacagtattaattattaatatatcattacatctagatttgtaaaatgtattcatgccttactttgtatcaaatggacataggttatgattgaaatatttagggtggctaaaatattgatttgttagcctatttaatggcaaaattaatgcactgatttttaaaaggtagattatctttgtgacagcaagctctgatcattcattttggattttttaagagtaatttggtggaggatcatctaaattacttagatttttggacatcttatgccttcaaatacctttccatagttaaataccccctttgaagttattatgcttataaaatttccaagccattcactaaaatcaagttcataacatgaattggagggatttaatgggtggatcatatagtgagttactcctggatcactcaacagattggaaactgtgagtagatcacaaagattcatgcaagcaggatttaaatctttctggttttcactgttgtatgcttttctctcagaaaaaaatcagttttttaaaaataactgataaaaatcaaccctttccatgacttgtgagcttcccatccgatctgcaccaattccactcctttgtcaatttggttggtgtccacaaccctccactccctagttgtcatgaaactgagaaaaccgagttgcctcttttgagggaaaatataagggaatctagactaggaagttacaagcagcagaaaaatgtgatagtttattgatccaattctatcaaacattatataacaggcagaaaaaggagagcacattctaatgactacttagatctgagaattattggctttgcaaagattttagagatcctccttcttaacctaattgttttgtcagtgagaaatctaaaaccttgagtcattcaactcatttaggatcatccaatagctttaggatcatccaagagctgaggacctacatctcctatgtggccatacagctgtgaagaaaggaatgtctacacttgtaataaatgtctgtggtatgaagagaagctatatatgactagatggttgggggggagtaaaaaagttcgcttattggctattttatcctattgaagaagaaatatgattttttttttttttacaattcttttcagcctggtcatcatctaaattctttccttgccaaaagtgtttagttccatctgtttcatctagtttcccatggatacagagctctaattgtataacaaaatccaaagggaaattgggtttgcttacggaaaatctctttgtgacaaactttgcaaaaagttttgtcctataaattgagatgtgcttatattagtaatattatggatataagatgtatcacttagacactgagcctttaaagtaatttaaagtgattaactttaaatggggttttcagatctagatggcttttactctcacagaatattttcaaaatattttaaatctatggtctaatgtgattgggaaaatctgaatattactttcatgtgttcttctgcatacttccttaaagtagtctgggttagtttgctgagaatgatggtttccagcttcatccatgtccctgcaaagggcatgaactcaccctttttatggctgcatagtattccatggtgtatatgtaccacattttctttatccagtctatcactgatgggcatttgggttggttacaagtctttgctattgtgaatagtgctgtaataaacatacatgtgcatgtgtctttatagtagaatgatttataattctttgggtgtatacccagtaatgggattgctgggtcaaatggtatatctgattctagatccttgaagaatggccacactgtcctccacaatggttgaacaaatttacactcccacgaacagtgtaaaagggttcctatttctccacatcttctccagtatctgttgtttcctgactttttaatgatctccattctaactggtgtgaaatggtatctcattgtggttttgatttgcatttctctaatgaccagtgatgattagctttttttcatatgtttgttggctgcataaatgtcttcttttgaaaagtgtctgttcatttcctttgcccactttttgatggggttgttgaaaaccaaacaccacatgttctcattcatgttgaacaatgagaacacgtggacacagggaggggaacatcacacactgggcttatcgtggggtggggggctaggggagggatagcattaggagaaatgcctaatgtagatgatgggttgatgggtgcagcaagccaccatggcatgtgtatacctatgtaacaaacctgcacattctgcacatgtatcccagaacttaaagttttgtttttttttttaagtagtttgggttagccagaggctcttctccactttaaggttataaagaaatgtagttagagtcaaaaattagtagaaagggaggatgagaagtgaacaggacaaatggttgcatgctttatgttctagggctccttggccttttcccagctgggtgaacatctgcagcagcatggtcaggaaatttgtcttagtcttggaaatctcaaaggatgcagcccagcctctgtgcgggtgatccatattttaattagctgggattgtttccagtgtctccctggggaatctcctcccttttaataaggctagcttagcataaataggatccatctgagaatgaaccagaagtcttggctttgctctgagcccaactgcaataatataataatactgtcatggcttgtattagaatcctaagttcaccctcttctaagctgaaagtagccatatcaaaattagcctgtagtgttagaagagtcaggcaggaagtacacaactactattcactttttccattgacagacataaagttgaatttatatattttttgttgtatcaaaaaagtgcccttgcctctgcatcactgggcatggagtcttcttaagcattaagagttcacatttgatgtttgtagaagtgttgcatgaaatccctgctatctttcttcctgcagaacagccaaatttgatatgaatgaccatcaaaatcagaaggctaggcatcgtggctcatacctgtaaacccagccctttggaaagctgaggaaggaggattgctggagcccaggaatttgagattaacctgggcaacatgacaaaactccatctcttccaaaaaaaaaaaaaaaaggcaaaaattagcttgttgtggtggcatgcacctgtagtcccagctacctgagaggctgagaggtgggaggatcgctggagtccaggaggtcgaggctacagtgagccatgatcgcgccactgggttcccacctgggtgacagagagagaccctgtctctaaataaataaataataaaataaaatcagaagcagtaatctggcagtttttaaacctagtccagctcaaagatgggctcagtggccagctcagtcaaatgtaactagttgccaacatttaaacactgggacatctcacataagaagacagatttctaacttctaaaatttgcagagtgtggcaacccttggcccacatttctacatgacaatatctggctggggaagagaaactggaacttcctcatcagatgaatcctgtacactttcatacaccacagttccccatctggctgctttggatgtttataccacccaccttatgctttcggcaccggatctcaggatataagcattagtttcctgagtagacagcatgaggcgcctgcgcaggttagatctacgttaaatcccagatcctctcttttccaaagatggaatgtgtacaaatctccaagcctccatgagctttggcatttgcatctattaataatgcaggtttcttcccaagtttgttgtgagctttaaataaaataccattcatgtagagcccaaatttatgtcctcctcatattaaatgctcagtgaatatttatgacaccttcctggtgtcataattttttttctggctatttatattgaagtgagagtatttgctgctgttaactttgaaaatttgctttggaactactacctcaaagtaatcaccactttcaatgataaaacactatggtcatccttgaaaaccattgctgttctttcctttcctagatcctgtagacttctgagaacttgttatatatcaccttataactttcatgtccactgaaagttgcaatttggctttgatttggattccgctgaagtttgattactgcacactaaaaaattgccctgaaatgaaaatgagaagaatcaagtaataattgttctaagtgcaattgaaacattgtatctcctagtcattctctctgagccttagtttccccagccatgaaattgggatgacagtgttttacaaagtagtaaatagagtaatgctagctccaatagggcataaatcccaaaatgaccgtgctcaacactatagaaagttattgatcgatcctgttagagtggtgagtgtttgaagacagagcagggctgctcttcttcatgcagtggctgatgccatcttacaacacatcttaaaaagttaaaaatccattcctagttcctaaagggaaacagacaatggagaaaaattatgtgagaaattattatgggtcaagtttggaagagttgcactttatttcactcatacttaactgcaaaaaagtgggcagtatagtccctctctatggacaggggagtacaaacacatggaggatggatagttgtctctgccacaacaagcaatgctgtgagagttgaaactccaccatacctgcttcctggaggctttcagcaagtggtggctactcttgctttgctgctattgcaatggtgttattgtcattattaggccttaaagtgccgtgaatgactcagtctttctaacaggaaaattgaaattaaattcgatagccagtggcctggaatttgaggttctctaagagtggaaagggtaaagtattggacatgacatccttatttatctgaggaccacacttgtcaaaataaagtcctatgttttttcccacattataaagttgtctttattgtctaccatcatctttcccagctcttatgtgttataattttaattgcctatgcagtttagagttcaagataaaagccagaatgtgaaaatgatctttatgtcactaatatactggtaaatcacacttcttttgttcataaaacttttttctattaaaaatgatttcaactgaaagcagtgaaattgggaaaatcctaatttttctttggaaaatgtctttgcacatcatttcataatgtatttcctcatagcgtggtgagttgggtgcaaagggagtgcgtttaaggctggtaagtcaagtttgaaagtgctataaatgcattgacatgatacaaatatgtttatttctaaattaaattcagtttaagaatataatttaattttataggttcctgtgaatttcacttaacgagcacatatcaataagctgctgtggcaggagctgatgagacaagaaaaaggtacattccctgtatatacaatcttagagaagtaaactttcaaaaacaaccagagtgacaaatggcccccaaaaaagagacctgtgacactgtaggcaagacgttactctatcttgggttgactgggatatatcaggaaaggcttcttgttgctaaagaaaaggcaagtaaaagtggcccagaaaggaaagaaagaatattttaatcagaggaagcagcatataacaaaggtattacgggaagaagaaaaaagcctaaagcaaagaagatgaaattttctttttttttttttattgcactttaagttctagggtacatgtgcacaacgtgcaggtttgttacatatgtatacatgtgccatgttggtgtgctgcacccactaactcatcatttatattaggtatatctcttaatgctatccctcccctctcccccaaccccacgacaggccccagtgtgtgatgttccccttcctgtgtccaagcattctcattgtacaattcccacctatgagtgagaaaatgcggtgtttggtttttcgtccttgtgatagtttgctgagaatgatggtttgcagcttcatccatgtccctacaaaggacacgaactcatccttttttatggctgcatagtattccatggtgtatatgtgccgcattttcttaatacagtccatcattgttggacatttgggttggttccaagtctttactattgtgaatagtgccgcaataaacatacatgtgcatgtgtctttatagcagcatgacttataatcctttgggtatatacccagtaatgggatggctgggtcaaatggtatttctagttctagatccttgaggaatcaccacactgtcttccacaatggttgaactagtttacagtcccaccaacagtgtaaaagtgttcctatttctccacatcctctccagcacctgttgtttcctgactttttaatgattgccattctaactggtgtgagatggtatctcactgtggttttgatttgcatttctctgatgaccagtgatgatgagcattttttcatgtgtctgtcgactgcataaatgtcttcttttgagaagtgtctgttcatatccttcgcccactttttgatggggttgtttttttctcgtaaatttgtttgatttcattgtagattctggatattagccctttgtcagatgagcagatcacaaaaattttctcccattctgtaggttgcctgttcactctgatggtagtttcttttgctgtgcagaagctccttagtttaattagatcccatttgtcatttttggcttttgttgccattgcttttggtgttttagacatgaagttcttgcccatgcctatgtcctgaatggtattgactaagttttcttctagggtttttatggttttaggtctaacgtttaagtctttaatccatattgaattaatttttgtataaggtgtaaggtagggatccagtttcagctttctgtatatgggtagccagttttcccagtaccatttattaaataggcaatcctttccccatttcttgtttttgtcaggtttgtcaaagatcagatggttgtagatgtgtggtattatttctgagggctgtgttctgttccattggtctatagctctgttttggtaccagtaccatgctgttttggttactgtagccttgtagtatagtttgaagtcaggtagcatgatccctccggctttgttcttttggcttaggattgtcttggcaatgtgggctcttttttggttccatatgaactttaaagtagttttttccaattctgtgaagaaagtctttcgtagcttgatgggaatggcattgaatctataaattaccttggacggtatggccattttcacaatattgattcttcctatccatgagcatggaatgttcttccatttgtttgtgtcctcttttattgagcagtggtttgtagttctccttgaagaggtccttcacatcccttgtaagttggattcctaggtattttattctctttgaagcaattgtgaatgggagttcactcaagatttggctctctgcctgttattggtgtatagcaatgcttgtgatttttgcacattgattttgtatcctgagactttgctgaagttgcttatcagcttaaggagattttgggctgagatgatggggttttctaaatatacaatcatgtcatctgcaaacagggacaatttgacttcctcttttcctaattgaataccctttctttctttctcctgcctgattgccctggctagaacttccaacactatgttgaataggagtggtgagagagggcatccctgtcttgtgccagttttcaaagggaatgcttccagtttttgcccattcattatgatattggctgtgggtttgtcataaatagctcttatcatttggagatacgtcccatcaatacctaatttattgagagtttttagcatgaagggctgttgaattttgtcaaaggccttttctgcatctattgagataatcatgtggtttttgtcgttggttctgtttgtatgttggattacgtttatcgattttcgtatgttgaaccagccttgcatcccagggatgaagcccacttgatcatgttggataagctttttgatgtgttgctggattcagtttgcccgtattctgttgaggatttttgcatcagtgttcatcagggatattggtctaaaattctctttttttgttgtgtctctgctaggctttggtattaggatgatgctggcctcataaaatgagtttgggaggattccctctttttctattgattagaatagtttcagaaggaatggtaccagctcctccttgtacctctggtagaattcggctgtgaatccatctggtcctggactttttttggttggtaggctattaactattgcctcaatttcagacctgttattggtctattcagggattcaacttcttcctggtttagtcttgggagggtgtatgtgtccaggaatttatccgtttcttctagattttctagtttatttgcatagaggtgtttatagtattctctgatggtagtttgtatttctgtgggatcagtggtgatatcccctttatcattttttattgcgtctatttgattcttctctcttttcttctttattagtattgctagcggtcaatcaattttattgatcttttcaaaaaaccagctcctggattcattgatttttttgaagggttttttgtgtctctatttccttcatttctgctctgatcttagttatttcttgccttctgctagcttttgaatgtgtttgctcttgcttctctagttcttttaattgcaatgttagggtgtcaattttagatctttcctgctttcttttatggacatttagtgctataagtttccctctacacactgctttaaatgtgccccagagattctggtatgttgtgtctttgttctcattggcctcaaagaacatctttatttctgccttcattttgttatgtacccaatagtcattcagaagcaggttgttcagtttccatgtagttgagaggttttgagtgagtttcttaatcctgagttctagtttgattgcactgtggtctgagagacagtttgttataatttctgttctttttcatttactgaggactgctttatttccaattatgtggtcaattttggaataagtgtgatgtgatgcttagaattcctggatatccttgttaactttctgtcttgtggatctgtctaatgttgacagtggggtgttaaagtctcccattattattgtgtgggagtctaagtctctttgtaggtctctaaggacttgctttatgaatctgggtgcccctgtattgggtgcatatatatttaggatagttagctcttcttattgaattgattcctttaccattatgtaatggccttctttgtctcttttgatctttgttggtttacagtctgttttatcagagactaggattgcaacccctgcctttgttttccatttgctgggtagatcttcctccatccctttattttgagcctatgtgtgtctctgcatttgagatgcgtctcctgaatacagcacactgatgggtcttgactctttatccaatttgccagtctgtgtcttttaattggagcatttagcccatttacatttaagtttaatattgttatgtgtgaatttgatcctgtcattatgatgttagctggttattttgctcgttagttgatgcagtttcttcctagcatcgatggcctttacagtttggcatgcttttgcagtggctggtactggttgtttctttccatgtttagtgcttccttcaggagctcttgtagggcaggcctggtggtgacagaatctctcagcatttgcttgtctgtaaaggattttatttctccttcacttatgaagcttagtttggctggatatgaaattctgggttgaaaattcttttaagaatgttgaatattggcccccactctctactggcttgtagagtttctgctgagagttctgcttttagtctgatgggcttcccttcgtgggtaacctgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttggggaagttctcctggataatatcctgcagactgttttccaacttggttccattctgcccgtcactttcaggtacaccaatcagatgtaggtttggtcttttcacatagtcccatatttcttggaggctttgttcatttctttttactcttttttctctaaacttctcgcttcatttcattcatttgatcttccatcactgataccctttcttccagttgatccaattggctactgaaacttgtgcattcgtcaagtagttcttgtgccatggttttcagctgcatcaggtcatttaaggacttctctacactggttattctagttagccattcttctaatcttttttcaaggtttttagcttctttgcgatgggttcgaacttcctcctttagctcagagaagtttgatcatctgaagccttctaatctcacctagttaaagtcattctccatccagcattgttccattgctggcgaggagctgccttcctttggagggggagaggtgctctgatttttagaattttcagcttttctgctgtttttcccccatctttgttgttttatctacttttgctctttgatgattgtgacgtacagatggggttttggtgtggatgtcctttctgtttgttagttttccttctaacagtcaggaccctcagctgcaggtctgttggagtttgctggacgtccactccgaccctgtttgcctgggtatcagcagcagaggctgcagaacagcggatattggtgaacagcaaatgttgctgcctgatcgttcctctggaagcttcatctcagaggggtacctggccatgtgaggtatcagtctgcccctactggggggtgcctcccagttaggctactagggggtcagggacccagttgaggaggcagtctgtccattctcagatatcaaactccatactgggagaaccactactctctcaagggtcttagcaaatggcacaggaggagattatatcctgcacctggctcagagggtcccatgcccacagagcctcgctcattgctagcacagcagtctgagatggaactgcaaggctgggggaggggtgcccgccattgctcaggcttgagtaggtaaacaaagcggcctggaagctcgaactgggtggagcccactgcagctcaaggaggcctgccttcctctgtagactccacctctgggggcggggcatagccaaacaaaaggcagcagaaacctctgcagacttaagtgtccctgtctgttagaagatgaaattttcttatggcctatcatttagggcctccatggtaaggggtaggggcagtgacaagcagggatgctgcagaaatgttatggaccagattgtgaaggggcttcttaatttggaaactaaacttgggctttctcctgagggaagggggtagcttcaaaagcagtgattctctgctcattagagtcacctgtgaaactttataagcactctctatccctgagcccatctcagactaatgaaatcagcatttttcatagtggtgctggggtattaatatgtttaacaatctccccagataatttctaatgtatggctagttgcaaactattcttctaaatgttagtaagcagagtgtaaagtgatgcaatgccaacactttgaactggaggctcataaaaactgaggcaatgtgaagatgcaaacctgacatgctttgacgttggaggacaaagagagtaaaacaggtaggatgttccttaagtttccagttttttgagcttggaatagatgttggttaagttcaacagagtagaaaatatgacaggaatatggcttaatgaggaagacagaattttgtcccattgagcctgaaattctgtgagacacatctagaaggctcttagctatacatgtctgaagctcaagaaacattttggttatatatatatatagagagagagatgtagagtcaccagcatataatgagaactgaagtctcaggagtaagcaacaatgcttacagaatttgtggtgtgagaattgggataattactgagtcctgaaaatcatcaacatttaagaaccagggagaggagttcacgaaggaaagcaaacaactggagacaaaaggcattcactgtctgtttaaatgctgggaatctatagtttgttccatgggagaccttttaaataatacagaagttttaaacagcaaaatttacttgacactgcaaattttaaaaactagtttatatccttttactaaatatttcccaatggaaacagcgttcacatttcacaagtttcacttgattactttcagattttgtatgagtataaagtgcattagttttacaaattatacaaaaaaaaactacccagggtacccatcttgctgattaaacttttttgaatttttatttatttatgtttataatatcaacttttattttagatttggggggtacatgtgcaggtttgttacatgggtatgttgtgtgattgatgttgaggtttgggctgactaaacttttaaacccaagaatttctccctttatttgctttatggctgaattatgaggacagatgcaccttctctcttagcaaagagaaaaaccaaaatctttttacttacacatgacccatattataaacagcttctcatgccctgttcaacatttctatatctctgtcccccaaaagcaaacaaaaagttccaattgccagaaccattgctactgccactttaggagatgttattaagaaacaaggaaaatcgtggagaagcatagaaactataaggaaaaaaaaacaaaaacaaaaactaaccttagggagatagattcctaggcaaggcttacctgctgtgagatgaaaaaaagcctactagttacttggaaatgtttttcccaataaggaaaaaaatcccttctcttgtgttacattgcctgcaattctagataactactttagctagttatctagaatagataactagataattactttagctgagcaggcatactatttgaaagcagtaaaacatgtgtcctagagctattgggccattatatttttttgtgcttttaatcaatttcactgagatcaatggcagtaaggcagtgagtatgtgtgtgagtaaattaaagattgctagtttgagactattgagcctttagggtggtgggacaagactggagggggtacctcagttgaagaggtagtggagaagacactgagagtatcttacactgaagtacactgggaatcatgaaagatcttgatggtgtccacaaataaagaaaaaattatgcaaagaataaaccagctactttaaaattgtgttatagctaagtgaaatcaaagagttgataaaactgatttaccacactctgttatgaaccactcttgcaccatccactcgagaccccaactccaggctaaaacccaattttatcagtaaatatttatgctataaatgtgaatctaactgattttaagtagtcaataaagaagtgaattcttgcttctaatcaaccaatttacaaacatagtttagaatgtagtttatctgtaaacagaactgtctgctatacatatataaaaatactgagacatgaagaaagagatttgactgtgatgctggactataatatgaagaatttggaaataaaatatttataaagtttctattccaggtagcaagaaacaaggagaatttttcaaattgctcacattaaatcaagggctacaaaataaaatccggtgaaaagtatatgaaataacattattttttgtaaagcaagaaaagccttaaaagaaaaaagacatatttgtggctcataaagggaactagtatttattgcatatctacagggatgagtcctccaacagccacattgtaaagacattattattagccccactttacgtactaggaagctgaggctcagaatggttacataactagcccaaggacacaaaactagtacttgacatggcccaagctaaaactcagggccgattttcctctacgttacactgatttgcaaattattaaaataggtttgttctgttttgcaaatgtatttcaagaaaattctttctaatacatgtattgtcaatgctttatattttttgttattaaaggatatgtttgaagacacttcctgcaaataaaaaagtctatagtgcttatgcatttttaaaggtgttttgtaaaggttattactgttagcttggaagcaaaaatacaaatcaatatcttacttctatcccaacaatttccttacttaaactgcaggcttactaggttttctgtccacagagttcatgctgcagggccatgtttatatatatattttttgtaaccatgcagttgaatatctgagatagataaaataatgccttatattgtgttctgggtgtggctccagtgttgtgggtacttttttttttttttttttttttaagctattctttttttttttattatactttaagttttagggtacatgtgcacattgtgcaggttagttacatatgtatacatgtgccatgctggtgcgctgcacccactaactcgtcatctagcattaggtatatctcccaatgctacccctcccgccctccccccaccccaccacagtccccagagtgtatattccccttcctgtgaccatgtgatctcattgttcaattcccacctatgagtgagaatatgcggtgtttggttttttgttcttgcgatagtttactgagaatgatggttttttttaaaagtcttattttgttagacatttcctaagttttcattgcactgaacaatgggtttctagttgaaggatgtattctttcaataaatgttttccctatactataaaacattattgttttttagcacaagaagcagtagaattcatatagtatgtttacttaggttcacaacttttttctgtttctcttctttttagtgaaaaatgaagctaaaaattggctcagccctcattaatacaaattttatgactttggcttcaatattttattcaggacctttgcacaggtgctttatctctaagaagatatcgcccacaggcaaaagcaacatgatctgttaaaacagtatattttcctttagacaagagagggtaatgtgtaggttgtaggagacgacttgattctgtcctgcaatgagtgagaccaataagctctaggaactgagattctgagaagggaagactaggacaaaattgtaggagactaaggggacaaatgagaggatggggagtgtattggtttacatgttagaaaagttaccactagcagtacaaatagtgggagatgaaagggctgaggcaaagtgatatgcacagaggtgaagagttctgaagccgtcccccgcttatgaaactgacagtaactgttcatgaaacaggcacagcaaatgaagcaggtgcagccgtaattctaggaggaacctaaggacccagacccactggaaatgagttaatggggcttgtgaggtagggacagcaggtgcctttatttatttattatttatttatttattttgagatggagtcttgctctgtcatccagactggagtgcagtggtgcaatcttggctcactgcaacctctgcctcccagtttcaagcaattcttggatctcagccacccgagtagctgggattacaggcctgccccaccatgcctggttaatttttgtatttttagtagcaatggggttttgccatgttggccaagctggtcttgaactcccggcctcaggtaatctgcctgcctcggcctcccaaagtgctgggattacggacatgagccactgcacctggcccagcaggaatctttcaaaggcatcctttcatgtttacaataatgtggttttggcaaagaaagtgagtacagcatggacaattatgtatgattgacttcccatcacaacatccctgactatgaatcgtccctttttcttttccattttataccttttcccttcttataacatttatttcttgcaccactttttgtttttgttcctttagaaaatattatatattctaacttgaatttcctctctttattgcttttcctctcttagctgtatgttcactctttgacttattttataatttaatttaacttaaatttttaactgacatatacagttattataattgtacttatttatgaggtaaatgatcagataactgtagttagtatattcatcatttcaaacatttgtcatttctttgtcctgggaacattcaacatccccctttagctatttgaaactacataatatattattgttgactataatcctacagtggtatagaacactagaacttattcctcctatctagctgagagctaagaatgtggttcagttcagtaagatacagagagagattgttcaaagccatagtgttttcttttgtttgtattgttttgtcttgttgagacagggtctcactctgtcgcccaggctggagttcagtggcataatcatgactcactggagccttgacttttcgggtttaaagtgatcctcccacctcagcctcccaagtagctgtgtctacaggcatatgccaccacgctttgctaactttaatattttttgtagagatgggattttttctgttgcccaggctggttttgaactccttgtctcaagtggtcttcctaccttggactcccaaagtgctggtattacacgtataagccactgcgcctggccctatttacatagccttacacaatctttacaaggtctggattccaccatttattcatttgttcattcatttgctcaggtttgtagagtatttactgagggccaggtggtatatagacactcactatcatggccctcagcctgaggtccttgatttggcttcagagaatatgggaattcactgaaataatttgagaagatacctgtgtgtagtaggatttttggctctcaataatttcttcccatcatgttggttaagtgtccactgcttcaactcacattaggatcatgtcctggggacagagctacgggcagttcagatgaaggtcctgttcacatggagcgtaaattctagtagagtgaagagaggaaatgatattattaaggttaaaaaggaaacaaaccaacaataaacaagataatttcagattttaataaatctataaagggaatgtcctggataggactgccttagagaaggtggtcagggaaaggttttctgggaagacctttaagacaagatttaaatggggagaagggggtgattttgtaggtctgggccaggctgagatacatatatatctaaacagttatcctccacagttattaaactaagagattttattatacattttctcatttatttgccttttatttttgcaattattgttaagagctttaaaaaattatattgtcactttttaagatttgttctttactcctacagcataagataattgggccagatgatgtctataataccaggcttttataaaagaaatgcagtatgccataagatagagttctggatcctatgtattttgtacccacagataattaaaatagcatgtgttgatttgttattcttcatctgttcttttttatttcaatcataatttaactgttccaattacactgctagaggatttttttcttcctatttttttattttttaaattttttaatttttatttttttattattatactttaagttttagggtacatgtgcacaatgtgcaggttagttacatatgtatacatgtgccatgccgatgagtgtgcttttcgggagtcacatggagaggctaaaatgctacttttttgtggggattttaaacttctattgttatgcactgaaagagagtataaatgtgttactgaacaatgtatttgcaaatattaggtgctgcagtaaaatgtaaagaaatttccaaggcctgattttatgcatttagattaattattgatgtttctcctaattctgctacttgaaaatgggtgtgaagaacaaacttgttttcaatgcagttttaaagggactgagtctttggtagctttatggacccacagtcatcaaatttctcatcatttgaggttgttaatcattatgatagttcaaggagattctgagtgaataagaaatgaaattctattattatcttatctttgactgtgaagatatttgaccacaaaatatttaactgcttatacatctcaacatactccattgactagaataataatgagtttaataagctgaaaagattacaaaaatgaataatactacttagcagcagtactttctgaaagaaggaatgacagaggggagcaaagaggtatgtgtagttattctgtacatcttgtatgtggttgtgtggtttaaatgcctttagttttatttagaagtagatttttttacttcagcactaatttctggggtgtttctatattcatgtgttgcatgcatgattatgtatgatatgtaaaattatatattaattaataaagggcttagtgcataaaatagatttgcatgtttaattagactcttattatctagaatggaaaggctaggaaaatgacaatcagggaatatcataaatgtgaacaagaaagttccactagataactaactttaaaaacataataaaaagaaacatgtagtacacttgcacagtccaaaacaacccatgaatgtgtcctaacaagtccatgagcaagtccaggcagccaactttgccaccatgttgctccttctggttgttcatcaacattaatgggcatcagtggttttttgcttaggaccgcctctcttactgggcaccactgtctgttaccatgaatactgggagccatcacctctgggtagcattgctattgcttctcctaaggctactattgctactagtactgtcatttgctgtgacattatccagtcactgctgatgcttcccagtgaagcttgacaacagtggactagagcctccaagtgctataacttccaacggtctgtggctgaatagaagctaccacttctcttccctgagtgcactttaatacctttaaggagtatctctgtccaaattaagagattgtactagatgtatcatttttaaccctgtaggcagcagagtcacctaggatacttgggaaacacagtttcttgactctacctaagactttctgagtactaatctctggtggtagattccatgagagagagagagagagagagtttgtggggtgtgtgtctgggtggtggatgggtgggtgtgggtggttaggtgggtttttgtgtgtgtaatatttgtaaccagatactccaagaaacattcacacagacaacccaacattgttctcagaccaaatttgagaaacacaagtctagatggccttaagggtgctttaacttcgagactgcatttcactctgcagctttaaagtgaagttgtggtagtctcattcacctttgaatttatatgatgtccatgcctcctttttggatggtattctcttttgcaggttcagtttttgacttagacacctttgaaactacttgaattagggattattctttgataatttgctgtcatcaagtgaattgagataaatatacattcagagcatcattatcaactttgaggaaatgtaggcacttgtgtgttcatgttggacacaggaggctgagatgagaggatcatttgaacccaggagttcaaggctaaagcgaactatgattgtgctactgcactgcagcctggaacacagagcgagatgctgtctcaaaaaacaaacaaaaaaaaagacgagtaacaaagaattatacaaaatttgtttataatatttgataccattaaatttacaggtgcatctgcataaatgctgcattttgtgctcagataaccaaggacatggcaaaagctaatcagcctaggaggcaggaggattacttgagcccaggatttccaaaaatatatatcactatgatatatcaattttttattctatttttcttttagagactatttttgtaatggtctgacttcttacatcacaatatgtagagatccacttagctctcaaatctatgatagtgtgattcgtttaaataattgtatgcttcaggatgtgatagaattggagtttctcttattcctgagtaaaggaaagaaaaatattcatttgagttaaaataaattaagattgtgtaatctatgtctccttaggccaccccaccccggtaaatgtgggattatgtgggcagtctaccaaagacatttccctagcccgcatatctacctaccacctgtggactttctgatctttttggagtctctctgacttattttggggagggtatagggtgtgtttcaactgtgtgctcctgaacaagtccctgtgttctcttagtcactgccagacgaagaagtgaagagtaaaattccatatttttccatttacctattgcattcttgtttttatagattttacttcaatatatactataagctatactacatgtagttaatatttttactttaaacagtcaatagtctttgtatacgtaataaaaatacagtcttcagtgaagtgagccttttctggtgtttcttttacacttatttcttcatagaacacagaagacaactgagtaatagttatcaaaatgactcttctcttccaaaaactgaagcattgttatgaaagttaatgcccctgacctttttgcaagagggtttcttggtcagttggtattctgttggagacagatgaaagaaaacccagcctgtattgactgaagccaaaagttaatttagtggttttcctacctgtagaatatgaggacaagctggcttcagacataacttagtctagaggcttgacagttatcaagaggaagtagtttctctgtctctgggccccactcggatcttcttttctcatttatctcattatggtaacaagataacggtaactgtagacataaccagagtctgctgcttaggtccagttgaaaagagacagtgtctctcttcagcatcaaaccaaagttctggtctgagtctccttgctcagattctatcatgtgcccataactaaatcattcactgtaaccaatgagaatggctaccttgcaatcaatcaccgctgaagccctgaaaactgacccacctaagccgcaaaacttaagaggaatgggtgccccccttaaaagaaagagtgttctgtaaaaagaggtgaatggatgttagctaaaacagatggccattagagtgtttatgaaaatacagcttcttagtagctcataacattagtaccttaaaaatgttcagatgtgtttagattctagtgtattttttcatttagatattatttttcttactcttatttttgctttactacccctgactataaagttgaagtccttgagacagtgaattgcctttaagtgttttaaaatcaccctttaacagtcttggagtacttctgagtctaaaacctaaaacactttgataatttgtggaaactcttcttttgtgcaaagcctttgtttaacgttgttagagtcgatctctttttttagggggagccttaaaaagacagagctgcaacatagcagttattcaattctgttttgaattatctgccatattgtgaaacagtgggaaatgaacacaatctagaaccacagctagcattgctcccagaccttcttagttactctgaccctaaagttgtttgtttatcaagcttgagggaacacttctgaattctagctggcattactctgggtttaacatcttccataaattaggaagaacactgtccacaatctcactctgcataacctcaagtcttcattttctcaaagctcactcctctttctccttgcttcattgcagctcacagaatgggtgagacttgtccgattttttaggacaagtgacataggcctgctatttaaatgaacaaagaaaggacgtattttctacatggtaatttgtttaacagaactattcacctcattgctattttggggaattaagagtacaaaatacctttgaatcttgttcaatattaagtcatgtttatttttaaagtgagagtcattattctaagtggaataggatttggtttttctgcattggccaatagctcaaaatgctattttataattatattggttccttccaactgaccttgtctatagatttgcaaacacatatagacattttacgttttatgtttttcagctatagcaaaatattttccttttctaggtctgcctatgggtgtctacgcaccttatatcaacatttatatctataaacatacacgttttagcacctatactattctatatttttaaattttgtaccaaactcctctgagacttattatggtttacacccaatcccattttatctacttaatgattggagccacttttttattcttatttatttctctaatgaactttggaggattgcaatttgctaagttctagggtacaactgtgctcaagacagacccaatctctgccctcacagtatcttggttggttacatatttgctcttacttctttcttccccccagctttattgaggtatgattgaaaaacgaaaaaattatatatttaaattatacaacttgaagttttgatatacatatacattgtgaaataatcaccacaatcagactaattaacatatccctgtcacctgacagagttaccattttttctttcttttttgtatcaagaacactttaattctacactcttaacatatatcaagtacacaatacattattgttaattaaagcacattataactaactataattacattagctatccatatcatatgcatcttgcataactaaaattttgtatgccctggccaataacacttcatttccccctgttaaccagctcctggcaaccaccattctactctcatctctatgagttcatctatttaagatttcattctattcaaggtgagatcatgcaatagttgtctttctatgtttggcttatttcacttaacttaatgtcctccaggttcatctttgttgtcacaaatgactggatttctttcttttttaaggctgaatagtattctattgtgtacctataccgcattttctttatctgttcatccactgacagacatttagattacttccatgtcttagctattgtaaacaatgatgccatgaatatgagagtgcagatatctcttcaacatactgattttttttggggtgggggatacctagaagtgggattgctgaatcatagttctgtttttacctttctgaggaacttccatgctgtttttcacaatggctataccagtttacattcccaccaacaaaagttccattctgtataagagttccgttttcttcacaacctcaccaacatttctgtctttttgataataatcattccaagaggtgtgagctcatatctcattgtggttttgatttggattttcctgatggtcagtgatgttgagcattttttcatatggctgttggacatttttatgtcttctgttgagaactgtctattcataccttttacctaagttttaatagagtttctttttttacttattgagttgtatgagttcttatgtattttggatattaattccttatcaggtatatagattgccaatattttctcccattataggttgactttttattctattgattgttgtcgttgctcttcatgagctttttaatttgatgcattctcacttgtatattattactttttttcttgtgctttggtatcatatccaaaaatatcatgatccaaattaatttcaagaagcttgtttcttatgttttcttctagtagttttatggtttcaggccttatgcttaagtctttagttcattttgagttgatttttgtatgtggtataagttgagttcaatttcattcttctgtggttggacatactgttttcccaacataatttatttaggagaccatcctttccccagtgtgtgttcttggaacactgttaaagatcagttgatggtaatgggtggattcgttaggttggtgcaatagtaattgtggttttgccattacttttaatgttaattagtgtaatttaaagtaatgggaataccacaattacttttgcactaaactaatacttctgggctctttctgttccattggtcaatatgtctatttttatgccactactatactgttttgattattatagctttgtaagatatatttaaatcagaaagtgtgataccttcccctttgttcttcttgttcaatattgctttgagaggccaggcacagtggcttactccagtaatcccatcactttagaggctgagacaggaggatcacttgaggcaaggagtttgagaccagcttgggcaacataacaaaactctgtctcttcaaaaaaatttgaaacataaaaaaatttcctgggtatggtggcacttgcctgtagtcccagctacttgggagactgaggggggaggattgcttgagcccaggagtttgaggctgcagtgagctatgattgtgccactgcactccagcctgggcagcagtgcaagaccctgtctctaagaggaaaaaaaaaaggattgctttggctattgaaggtcttttatggttccatatgaattttagtatttttttctacttttgcaaataatgccactgggattttaatagctattacaccaaatctgtagattattgtgggtagtatggacattttaataattttaattcttacaatccataaccatgtatgtctttccatttgtctgtgtctttttaaattttcttcatcaatattttataatttccagtgtgtaagtcttttgcctcttaagttcatcctaagtattttattctttttgttactattatgaatgggattgttttcttaattttccttttagatagtttgttgtttgtgtatagaacatgacttattttgtatactaattttataccctgaaacttcactgaattgttttattagttctaacattttttttctttttttgtagtctatagagttttctacatatatgatcatgtcatctgcaaacagagataagcttatttcttcccttcctaattagatgcattctattccgatttcctttcctttcctcttcttttcttttcttttcttttttgtctaattgtctaattgttctggctaggacttccagtactgtgttgaatagatgtagtgagaatggacatccatatcttataccagaaattaaagaaaaactttcagttttcctcaatgattattatgttagctgtgggcttttcatgtatggcctgtattgtgtttaaacaatttccttctatacctattttgttgagagtttttatcatgaaagaatgatgaactttgtcaaatgctttttctgaatctattgagatgatcatattgtttttggccttcattctgttagtgtggtgtatcacgttgattgatttccttatgttgagccatctttacaccccagggataaataccacttggtcacggtgtatgatccttttaatgttctgttgaatgctgtttgctagtattttattgaggatttttgcatcagtatttatcaggaatatttgcttttagtttccttttcttgttgtatctttgtctggttttgatcaggatggtcctggcctcataagatgagtctggaagtgattcctcctattttatttttttggaagagttaaagaaggattgttatcagttcttctttgattgtctattagaattcaccagatgagaagtcatctcatcctgagcttttcttttttgagacacttttgattacggactgaaataaatgtcttccttgtgcagtttgtctacactatcctatttcttcttgattcagcttcaataagttgcatatttgtagaaatttatttatttcctttaggttatccagtttgtcagcatataattgttcacaatagtccctaatgatacttttcatttctgaggcatccattgtaatatcttctctttgatttctgattttatttatttgagtcttctccattttttcttattagcctagctgagtttgttgattttgttgatgctttcaaaaaatcaactcttgtttatggatttttttattgttgtctgtttcttatttgatttacttctctaatctttattaattccttccttctgataattttaggtttagtttcttcctctttttctagttccttgaggtgtaaagtcatgttgcttatttgagaatgttctttcctagtgtaggcatttatgttgtatttttgttttcatttgctctgaaattaaacctagttacattgccgcctctgcttttccatgttttctttagtctgctttttagctttacctttgtctattctttccctctttatttaagatctcttaacttgaataaatataacagagtgaacagtgaaggggttatttcattccttttgggaggatattcctctgttttaaccttggcttctaggactgactggtcataaaaggaaacaataaatgcaaagcattgagtccaaaagtggagaaaagccacagttcatcttccctggcaataatatgatagtattattttaagattcagtgaattctgttctgcgagctgtaagattggttgatttgtaatagggggaaaaagggcatgttgtggggagggtagacatttagagaaagtaaatgaccttgagggtattgaactctgtgaatcaacttgttctctaaagttaggggacataccacttctagatggtgaacctgtgggtgttcatttgaacagtagagtcatagaaaaactttactatctggaatataataaaaatgctgctttaactgctaagtcgccatctgttaccagctctttgctactggtttatcttttttccttttaaaacgtgaattcttggattttcatattataattttatacttaccttaaattaggattgagaggaaactttgacaacacctcttaaaagaaaattattaacttgtaaaaatcatacttttaggtttgggtaatagctggggagaaagcaaaagcaaatcaggaagcttgtaggtgactcatgtgcatttctatgtatgagcaacaggaatggtagaacttttgttccactgcagttgtacaatctaattattcactgatcaatctacacatactgcattactatgtaggttttaagatggcatctttgccatatgtctcttttttaaccttgatatcttacatgtaataggttttcatcagttttgatgaaatcatgatgataatgattacgataatgcctcccattattttctctttagtataaggcatttaatggcttttcctaaaaaataatgcaagcagttcttaaccctaacaatgagggatagagtaggtgtccttacctacacttgttactataagtgatatatttatataaagagatgtatgtaaaggaaattcattcactcattcatttatgtacctaaccattattccttcatcagttcttgttaagcacttactatattaggccctgtatacattttacatgaattatctcctaaccttataacaatggtgtgtaaagaaactaatattatccattttatagatgataaattcatgattagggatattaattatgatgtccaaatttgcacaggtggcaaatgatacatttgaaatctgaacccacacaatctaattcaagagttacattgccactacttcaaaaaatgtggtttattttataggcaaagaaaaggcactgaattgaatattatgactaagcttgtgatcttaaaagatttaggttctgagttggacctgattaaaaattccagctccaccaattactgattacatgaacctggtgggagttgttcagtctttccatactccaggttcttcctttttcaacagtgttgctgagccattaaatgaaacagctttatgtagaaagcactcagcatagtaaaatcattataaatgttagctattacacacttacttctctccttttctggaggaagggagaagatgggtttttattttacaatcttattttataaaactataagcctggagtctagggggtaatgtaggaattgaaatatgaaatggttctgatctaaggtagaaacattagatggatgaaagaatatcatgccgatagaattaaaaattgttaggttggagtattttatgtgggctgagagtaaaataaatctacaatttgtgtgagtggtagaatgtgaagcgattaaataggatagggaattggaagggaagtgctaggacaattcctggcacatagtaggcatgcaacaaaaggttggaagcttgattgctgtgatctgtatgcaaagatcatatggttgcataaatgtgttaatattgttctttggtaagtgttttcctggtatttaagtgcaatggagcacaaaggtttgttgtctaaagtgtaataatgaaaggaatatgaccattactccatctgtcattttcactcatgcctttaaatgagccctttgctccaataaaatggttcagttaatggttccttaaagccacacacacttacctgtctttttgcctttgatgaatttattgcttaagactttagccagtatctctttttgcccattctttttatctgtatttatttttatatgttttttgagatggagtctcactgtgttacccaggctagagtgcagtggtacgatctcggctcactgcaacctccgcctcctgggttcaagcaattctccttcctcagcctcctgaataggtaggattacaggcatcctccaccatgcctggctaagttttgtaattttagtagagatggggtttcaccatgttggccaggctggtcttgaactcctgatctcaggtgatccacccacctcggcctcccagagtgctgagattgcaggtgtgagccaccatgccccgcctctttttgctcattctttaaagtaggaactttggtagaactttcacagcctgtaacatatgtctctagccctagcttggttctaaatcccatggtgccttctccttgggaaaaacagagaaggcactatgagatttagaatcaagttaggactgcagatacaggttacctatgttacaggctgacagccacaggtatattgctctctgcacatgtgttttttcctggcctctcaatgacattataagcttctattatacctcatgtggcgtaactgctctgcaataatagaaattcaataaaggactctttaatttacaattaaagtcaggattgaattttgtggaaaatcttgatgcaaatgtacaaaagaacttcaagaaaattagaatgccatgagtcatgcatttcctggtactattcattcttctttaggtactatcattctgctcaacctaacatttctaccacctacacctaccatctggaattataggcagagggtatgaagggtgtcaaatcttgaaagaaaattgccttttctccaaagttgatgaaactaaaccacagttgattggattacttgctcagcaagagagtagaaccttgtctttatgaattaaatgtcactatttcgtctatttgaagatgaccttatagaggatcatggcttacgacaagttattttgctgaggcttgaatttgaattgtgtgttggtgaatgaggcactgcacacacagtcagagcagctgctctccatgcagcttttcttctctttggttttctgtatcatacacagtaatccttgggtgttattcacatctacttcttgtggagtaatagtatattatagtggtatcataaattcgggatttatgaaagttgtgggacataccttcatgtgaatctcagtgggttactgtatttaatgattttttctcttttgttttgattaagaagctctttgctgggatgctgagttccgatttaaatattatacacccttcttatttctctctgcaaaattatagccttgctgatgaattttgctttactcttgagtgtggtttacttttgcagcaaatacaaatttagtaagttaaatctaaaagccacagttaaacacagttctccttcagaggtaagaaccataactgtttctgtggaccccagcaatggtaccttcttttacaaaacaatgttcttcttgttccatagtcaattacacactgaacctctgtgttatctgagatctaagcagcagggctgctctctccagaattatattcagcagctgtctcctccctgttagcttacccattcctgatgtgttgattcctttcagaaggctccaatccaaataagacttaattagcagcagcctgaaaatagtgtgtctgcctttcttttcctgtataaatcttgtgagtgctaagcttctaatttcactttcctcttaatactaactgaaggtcccataactttctgtggaatgttgactttttttttgagtgagatgagctcttctcatgccagttaactctcatgtcggtgacagcacaatggagaaatattaggaaatctgacagggagaaacattcatgtctgatagagtccagcaacagattagtgaaagaaactggccgtccaaaatcatcctcattcatttccttcactaagtcaaagaaatcattgtgctctgcttaagccccatgctgagttcattttactgacccttccttaatattggctgaagggtatttttaataacttggtatgtttgggagtcaaaggaggccaagtttctggctaggctcagaagggataaaatagtaatggaatgtttggggaatgagagggaaaaaaaatgcctaaaagaaaggtaccttcttttagacctgtttaatataactcccctaattatttctgaagtaggggaaaaaatatacaaaaccctctgaggaatatcaatttttaaacattacagccttgagtgagccacttcaaaatgtgcagagaattggcttatattttatttggaaactaatgtttaagtcaaatggagcaacagaaatccatagtaatctatccaaaaaagaaagaccaaaggattgggaataggtcagggtgcagtcaggagagccaggcgagggatggcagtcaatggaagccaagctggcccagtcagtctgtgggcatgtgagctgaatcaccagtgtggggaccactttcccgtaagaagccctgttgtaattgatcctgtctcctgagcctccccggctgccactggacattgcaggtttggcttcctggctattggttttgcagtcagaggagttcagttcagtttagtgtgttgagtatgagcaaagcagtatgagccgtgaggtatcaggatgagtgtgtgactgccttctcttctcatgtgtcatctgtgtgaattcttcccatgtatcagcctcttctaagacgtgaccttaactagtccagttcctggtgctctgacctctctcaagctacttcactcagagtgctgatcaaatggtttggaaccacagtgttagctatgtccttgttccatttagtctgtaaatccactgaggatgtatcttatacttcttttgaaatacactccgccattagcacattgaggagcactactaggggtttaattgacacctgttgattgactggtacgttaattaatgtagggccttataagcatgtcttccagagacgtttaaaaacttttattcaaattgtatataacatctacttgacaaacatttttagtaaacgtgataatgtagaaacagaattattccctgtaaaatattattcattttagtaatttgagataaagagttatttgctcactagattttattcacttggcacctgtttattaagtgcctatggtgtgtcataagcactgatgatgtaattgagacctaataatagcctaggaaagtatgaaaaaatatgaatatcttcaatgttggttctttcaggccaatatttttaaatgactcattggtagcaaaacatcacttttttttttttttaacgagcagatatttataactgctaccaaaaccaggaatagtttactaaatatgggggtttgaagatattgtctttagctgggaaaagcttccaggctacaagagaggataaagacagtgagtaacatttgagatgtactttatttcattacctaacaaacacctatccagcactcacaatggacaggctgtcttccaagcaggaaaagattatggagcatatgctgtacatatgacctcatttaatcactatagtaagtctataaagaaggtactattattatcctcctttttaaaatagggaacttgaaactctattttacagttaaagttcagagaagttaagtatttcacccaaggtcacacagcctgtgcggtggagcttcttgcaagagtattttggccctttataggatagagagattaattccaaccagggaaagaagggaataaagtaagccccagggaatggatgctgtttcaaccgggttaagattggtttgaaaactggttaagattggtctgtttgcaaatatggggcagtcaagaatatacccagagaaagctattccacaagggacataaatgtaagatattaacaaaataccattctctgtccaacattaaaattttaggaagatacatcctcctctattcttttctctcaaggacttcccaagtttccgtgcaatgtttgctttaattcttttaatatgaataatacaatatgttttacatggcactaccactttatttaaatctcaagattttctaagagttaaatgttcactgctagtcttcacagcaatcatcaaacaggcctattcagtttaagatggcctcatgtgtgcgctgtcagtgacatctgccaaaaccatgtcttatttgtgagaaatgccccttgtctctgcttgatggaaaactgatcagcctcttttactctttcaactcaatgattagcaattactgctaacctagaaaacttcgctggatatttatttaaaaattctcgtcttactgggcatgatggatcttatttgctttttaatataaacagtgaaagtataaatacattcttactttttggagaagataataatattaaatttaatttttgtctccagtgttattgcatttttctaacagaaaaactaaataaaacatatctttagaatttaattctctttaagatatcacaaactatttttcaattttaaaataaaactatatctatatatatatacacacacacacacacatacatatttgagacagagtctcactctgtaacccaggctggagcgcagtggtgtgatctcagctcaccgcaacctccacccccaggttcaagcaattctccttcctcggcctcccaaatagctgggattacaggcacccaccaccatgcccagttaattttggtttttttagtagagatggggtttcgtcatgttggccaggctgttcttgaactcctgacaccaggtgatctgcccacctcggcctcccaaagtgctgggattacagacatgagccaccgtgcccggacaaaatattttaaaacattgtaaatgatcattgggtttcagtggtccaaatcagaattttctttggaagaaaaacattaagagaaatacactaataaaaataaatcagtgtaagcacttgaaaattagttagaaaagatgcgtagagataccttgatatagtaaatatcatatagtcacgtaatattaaaaaatcaatttgaaaacattacatagaatcaaatatctctaaggaaaaatcatgtgaacaactgatgtaataattaagttgaatatcaaaggatgatgtaaaatctattttaatcatatactagggattggactttctgataagacccagagacactttatttatttttatttttttattttattattattatactttaagttttagggtacatgtgcacaatgtgcaggttagttacatatgtatacatgtgccatgctgctgtgctgtacccattaactcatcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggtttttcgtccttgcaatagtttactgagaatgatgatttccaatttcatccatgtccctacaaaggacatgaaatcatcattttttatggctgcatagtattccatggtgtatatgtgccacatatcttacagatgaagaaatgggggaccagaagtttgtcacttccttacgtcacattacttgtaaggggtagagagagcagagctagtgcttcaacccagggccagaatcagcaaggccattctttctatgtgctgctagaaaatgaagactttgtcatggtgcattcagcagctctgatcaactggtaacttgtcagttggacagatcctattttccagagccttactgaaggtctggggatggagtgagtcacaggactgagcttgcatcctataggagcataatcacccctggaaagatagcccttcaattttagggcaatagctatgagactgctaccctagttcttccaaaagtagagtttcagagcacaatggcactcttctcccaccaccaaaattttcattttagaaaaagaacagtaacctttaaggataggcctcctatcctgctttatacattttcagaaatgcccttgaattatatgtatacttttgtggcttgacttactaactttcctttttgttggcttcctgcacagaaaagctgttgggggtgactggtagatgcatttgttaaagggctaatttacaagagaccactttactggaaagggtgcctctctccaaataataagtaaataaataactttttccagaaaaatcctcaaaaacaaaaactttctaagacctgtttaccttgcagaagcctttcaattggcctttagggcagcatgaacagaatgttctataccttgagtggtccatgcactcaggagaatgtgctgatttcagcgtcttccttatagccatgtgaacaccaaaataggattcctttttcctctgctccagctttctggagcaattgttttgactgttcaaaagtgtaacattttgctttgttttatgtttttctggataaaaatatcattttcttcctagagaatttgacttgctaagcacatatcttgtgaattaatatcacgttcctgatatggagggcttttgtaatcagaataactatcacacaccacagaggaataagaggttgaatatgttcaatttctgtctgactattggaagcctcaggtcatcacttcttggaggcagtcctgagtagatgcaatagacactaaggcaaatattatgtgtaccatatgacagttaattcttggaatagctctggaaagtagacattatatgaccattattttactgaagacaatgctacagcaaggatgatttagtgacttatttagggcctcacagtaacagaacctggattgaaattaagtttggtctgagtcaaagtctgctttcttttcattccattacactggataggcttgagagtatattgcagagagaatatggcatttgtacccaaatttcatagttgacttacatttggggcttctttttgaaattttggtttcacaggcgagaatgacaagttgcatatcagaattcaagagtgagatttgggcttgaaaatcacctatttgagattgatatgcatatttccctcttcaactttccatataaagccaggcttttacccagtatggccttggttgtacccctgtgtagttctgggagtttccatagttgatatgtgtatgttggaggggaggcagagaaaataaacatgtccattctgaatgccttttcctgtgagagatgctaatcggctttctctctctcaggagtatatgttcaatgtctggatgttttcaatgtctggattaattcagccgtccaggaaagaagtttgtgctttgctctccatggacaacatctagtaaaggagacttagtctcatcgttcttctctgaggaggcaggattcacgaccaactcatcccattgaagacaatattagcagaaattataaaaggagcttacagagtattttgcaaagttcatttacttacattgccaaaagttatgtgattttactaaatccctcaaaactcctctaaggaagttgagaatatctccatttatccattgaagaaacttcaacttagaaagttcaaagggatttgtttgaagtcatggagtctaatggctcccactcaagggttcttttgtctgctgtaccatcttccacctgctgccttacacatttcagaagtgtgaaaatggggagcagactgtttctcctggattctgagtatcagttgcccccttcctgagttagagaaatatcaacaaacttgcagtttgtataagaattcgatacttaatgataatgcattattatacagtgttaatatattatatattattaatataatgcataactactacacagatatatttatgcacatgcatacacacaatccctttatacctcctgttttccaggtaaaatgagagtttacatttattgagtgtttaccatgttccagatactgcccttagcttttcaacatagaaaagtattattatcttaattttgtagaaaaagaagctgagaagactgtggaggttaagtaacttgcccaaggtaatgcaatcagtggtggcaccaggatttgactccaagatgatcttttccagaacgtttgctactaaacactctgttttattgactctcctttgcttatttctgatcgtggtggtgaaaagtggagttcttttttctagtagaatggtgcttcaatatttcacatgtaacttgcattttcctcaagttcatgtttatttttgagttcctggtctctgagtttactcaccttttatttaaatatgtaaagtagaggctgtcccgagtagaggcaataagcattagaccaaatattctatgtactttatgacagttaatttttgaaatagctctgatgaacataaaacaccagagactgaaatatattctatattatttatatttgtccatcttttataaagttttatgctatacttttgaggtactctaaataattttaagaacttaatttttctgtgtattaagagcagattaatatagcctcaaggaaagaagagattccctgagaaagaaagtctattttatctcattttgtttcaccaagtttttggttgtcaaaattcaggtattcagtaaacacaaatgtagattatgtctattgagctccaccttttagtttatttccctcttaaatcaaataaaagtaatttgaaaaccaaataagaaaatgaaacaattaacaactgggaattcaagtacctaaggtacattaaatatgtatgtgctaacttatcccatggagctttgctacatctcagaacttgtcaaaatgaattcctttcccttgcactcctgtaccattttttcgctttattacattactttatatagattacttgtaatttctgtgagtaattgtggtggcagggaaactggttaagtacagaggtgcttaaagtgttgactttttgcttagctagaaacaggtctctgcctgtttcactatttagtctctggtgatcatgcacaagccatttaacttctttatatttcagtttccttgtatgttaataggcctattgatactaactacattgcagggattttgcaatgattaaattacatatttcataaaaagcacatgggcctattgctcagtaagcagttagctgatgttattgttaatatcctttcattcttattctcatctcttgatttcagaggtttgttgcctttttcctgagcaaggtaatagcagggctattacattagccttctcactggtccctaacaatcagtagtcagtgtgtggcaaggaaactagatcatgtgagatattttatcagaagtgatttaatatagaaattgttcaagtaggttgaggagaggtgctagaaaaataatactagaataacacagagccaataactgcaagaagcaattgcacatttagggtaaattaaagggaaaaagtggggttttaggaccggcaagctcagatgagacctcactgaactggaacccagtcttctgaggaggtggtattatcaaattttggcaaggagctgagacctttgaggagggggcaccaccaactggtgctggtgctgacggtatgatgaggcttgttctgggagtgtagagaaagctggaaagtgggaccaactgctgctgcccatgtgaagttctaatcctggggtaatgtaatcaaaaagacagccaagcaggaaggggtaagttccttctccctctcttgccttcttgcctcccccagggcttcttctggcaggtatgaacagtcttccagttggtcaagtgcaacaaatgtagtctgctgaaccatgaggtctgcatcagaaaacaaagaacagaaggatgggtttagagataagaggcaatatcttagtaaccaacacaagtgtctttcaaatcccagtctctttcataaactcctattggattaaataatcaacagagtgaacagagagcctacagaatgggagaaaatacttgcaaactatgcatccaacagaaaactaatatccggaatttacaaggcactcctacaactcagtgacagcaaaaacaacaaaaataaccccattaaaaagtggacaaaggacatgaatatgtatttttcaaaagaagatatacaaatggtcagcaagcatatgaaaaatgcttaacatcactaatcatcagaaaagagcaaattaaaaccacaatgagttagcatcttataccagttaggatggctattactaaaaatacaagaaataacggatgtcgatgaggatgcagagaaaatggaacactcatacacaattattgagaatataagttagaacaacctctatggaaaacagtttggagatttctcaaataactacaaatagaactaccattcaaaccagcaataccactactgggtatctacccaaaggaaaaaaaaattgttatatcaagaagatacctgcattcatatgtttattgcaatactattcataatagcaaagatatggaatcaacctaactgttcatctacagatgattggataaagaaaatgtggtatacatatgtacaatggaatactattcagtcatagaaaagaatgaaattgtgtcttttgcaactacatggatggaactggaggtcattgtcttaagtgaaacaactcagaaacagaaaaatactgtgcgttctcacttattcataggaagtaaataatgtgtacacatgggcatagagtgtagaataataggcattggagactaaaaggtgagggagtagaattgggggtagatgttgagaaattacctaatgggtataatgtacattgttcaggtgatggctactctataaggccagacttcaccactacacaatatatctatataacaaaattatacttgtacttcttaaatttaaaccccccaaaaatttcctacagtatcacttggaacacagctctcacctgctccaatatcttcatgtcctattgagcaaaggaaattcaatacacactttttaaaaaagaacctattatgaacattgtgctctgggctatggaggatatagacatgaataagaagtttttctgtcctcacacagtttaatgaagaacaaggttaacagaaatcattccatagcaaacgcagaaagtacttagaaggaggaatgtgtcctggctggtgagattcaggaagagttcatggaaggataagtaaaaattcacattcaatagtgtggcctcttatacttggctgacttttcactatacccatatttttatttttttatttttttgctactatgtaactatttcctgtttagccttcagtgtttattttctgtatactttttttctcatgccagtcacttagacatatggccaatgttactgagtgccttctatgggtgctttcagctagttgtaaggatacaacattgaacaaatgagacaaggtgcccccattatggaccttgccctctaggtgggtaggcagttcttaatattaaaaggtcacccaaatgaatgcaaagttgcacattttggttggtgctgggaaagacaggtgcaaactgctatgctagtagggtgatcaggtttcattctggagtcacaaatggcttccctgaggtataggtgttaggttaggttgagtcaagaaggctgtttccagcctgtgcagatctcggaacagaagaagcagagtatgcatctgaggaaaggtcactatgggtgcagaaaaagggaatgaggagtgtgtacagcacttttcacacagtaagcatttctcagggtcaggttcaaaaggcacctcctccatgaagcctttcttaaaatacttgaacactaaaaagatcctccctctttttagctcttaaccattgtgtatctctcatgagggtgtttattacatactgccttggtttgtgattatttatgtgcaagtttgattgtctgtgctcaactgtaagcttctagaaaccataatttgtctcatatccatctttgtatccttcagtgtcatgagttcttaaaaaatatttgctgaataaggtcacttcctcagtatgcctgctggcacttagatggtgtgttcagttacatgcaacagtttagtgtaactgtttctttcattcattgtctcatattactaactgacttgtccgtggagaacattggcagttgattgacatttgtgtataacaggtgaagaagtattcactggcccactttgggaaagacagaagtatggaatttgaggaccggtaccttagatctctatgaatcacagtgaatggctgcttaaccaaaagtgttcataaatctgtagcattgcaaaatgtaggttcaaccaaccaaatttgctttatctttttatttcaccatctgtgttggcttgttctgatttccatgtcattagacaaggagaagatgatcatcttcccgtagctaaacacttggattccatcagaggttcttctgaaaagtaaacatactatggaaaggagggcctgggggaagcaccacacctgtaggccttctttctgttatttttttttcgtgggggatggtgtttcactcttgttacccaggttggagtgcaatggcatgatcttggctcaccgcaacctctgcctcccgggttcaagtgattctcctgcctcagcctccctggtagctgggattacaggcatgtgccaccacacccggctaattttgtatttttagttagagatgggttttctccatgttggtcaggttggtctcgaactcctgacctcaggtgatctgcccgcctcggcctccaaaagtgctgggattacaggtgtgaaccactgctcccagcccttcctgatatcttctaagtctctttgcaacaacctgagtggacccattctcctgtgctcaggacctagctctaggtattcccttatctttcttagaatatggtcattcactggcatctatgatggaacagaaaaatagctggaaaatgaaaactacaaaactctcactcaacattattttacaatagtgtaggagttaatagttgtggcagaactgcatcttctaaggaaaactgcgctatgacaaacagccccagagtgagaggcagtcaactcactgtcagggtgacccataagtcctaatgggtgggaatgatcattatatgaagactataaatctgattaatgtgcactctgagatgaggtataacatttcatgccaaatgaggtaggggtaggtgagaaaggatgatagaaacagctggttctgcacatgtctgaaggaccatagtaaaattacagtgacatagagagataagtaaacaaacatagggaatgttcagatggatatatgtgtgtgtgtgtgtgtgtatttcagtgtttatataaacatatacctaaacttatttatagactcatagctgatgaatgaaccttcacaaatatactatttccagtccccaagtagtggggtacacaattttattctcactgtaaaagcttattctttggtaggacatattgccaaatttttcactgtgggactaatctggaggccatacggtgacatttaatttatgggcaatattatctaacagcattcctttagcagttggtaattgtaatgtttcattatctcagtttagttttgtcataatcttgtgacatgggctgatatcattattccacattgataaagaaagatatttaaagacaaacacaattcccattaagttgcagtgtgtgtgtgtgtgtgtgtgtgtagggtgtgtgtatgtgggattgtttttgagtcatataggacattcttcctcgtaactgatattctggattaaattttaatttgtggagtcttgggcaaagtctaaacctaaataatgtttgggaagaggggccataacctgaaaatctgtgtcagattggccctataagagagaggtgagcgtactggattctggcttcaatacatctattcccctttctagatgagtaaagagtaagatacagttctacccttccttttccctctctcctctcctattcagagtctattctatcttatttcactttgtttttatggatgaattttactgcaaagggtaaagtccagcctgccctttgtcaagaaagattagacctcattatctgtcctcatttctcaaaggcatgaaccaggaacaatcagagtaacttctttggaccttccagcacgagaaagaagtgttctcttccctataggttaaagactgagatggaaaagaaataaaacaaatgcttcttgattctgacttttgtagtatgtagccctgctatatatacagttgtcccttggtatccatagggggattggttccaggacccagagcgggtaccaaaatttgcagatgctcaattctctaaataaaatagcataatattttcatataacccagaaacgtcctcctgtataccttaaatcatctctaggttacttataataccaaataaaaggcctacataccacttcattctcatggattcagtgtagtacttggcacacggcaaattcaagttttgctttttggaatttcatgaaaacatttttctgaatagttttgatttgcatttggatgaatccatgggtgtggaactccaggatgagagctgcctactgtattcagtctgtgcagcaactggtaaaggacacaaacaagaagtatgatgaggtctaatctttcttgacatgaggcaggctggtcctcacctttttatgaagaaaactttgattcagaaactttaatacacagatatatttgtgtacatgtatgtacatatttatgtacttaagaatgttgtgcaaggtcacacagcaacgtcatggtacagccagggcttaccaggtggcataggttttacatctccctcaatatttattaaactacaaacatccctcagagatgctgagaatcgcagagtccctctgtaatatgatcacatgctgtctgtttttcctctagctgattcctgaaatgctggagttggcaggaaaaaaaagataaaggtgaaattaattaaatgggatcatgcatgtgaacacagtttgtaaattctaaggtcttacaaaagatttctatattagtaatagttgcaatatgctcatttacatgagccacttgtcattcacagctaattactaagcagtacagtaacaattatgtggatgatgaaatacacatcagatcaacacttttgcaagctgtttcagttacaatattcaactctcttcccttggtttccatcttctaagtatattgcttaggaaacttggataactactgacaactaagaagaattatgaacattcatcatacaggaagtaaacattcatccaagaaaaacaagtgatagaaatgaaagatgagattctgtttctgagctgcccattggcttttcttatgaggactgaatctgtggactctgtgaaattttcatatgcattgttacactgtctcggaaaaggccatttaagtttacaacatgagagagctagcaggccctcatcaagttctgcaattctaactgtatgtctccattggtctcacatctatgcccttgagttggtttctactcatgccatttttccaaaacaactgtaattagtgtaaaagttgaacaagcaaatattaacttggctgggatatgattttcaaactacattacagtagagaacaaagtttgtaatgagattctgtgtactactattcaaagcaattaggagaaatgagtattgagctcttaacattctgacaagttatttcaatattgtgtccaaataaaggaactttttgtaatcaaaaaaactgattgatttcttgagatttcataacatgagacaaaaaaagaaacagtcatcactgatcttccagcaagtcacaattgtaatgtattgaaaaatttaatggccttgactttagaagtgtaatgagttttgtaattgctcatgtgagaggtttttggttatgctgaatatacgggtgcaaataagcaaatataacaggtgacatttgttgttctaataaaataaatccagctttgaacaagtttagtgtaaaagttataaataataaagaaactttaagaaagagaatatgtgatcacagtatttttatgggaaggtaggacatcttgaatactaatctggaattttattggtaagaggggccatttattgagttcttagtgtattttgaatttggccgaggcactgactatccggtttaatccttataagcaatcctgtaggaaaatacagcgtggattatctaagtaactttcctgagaccacatagccaataaatggaaaagataattcagttgtgggccaatttcaatatttctactgtcctagaggttttgcataaatatgtgatattagaaagaattaaatatcagaatagttatgcacggggatttgagagaaagctccacaattatatagtgagcatttcagtcaagagggagaagtgataaaattatgtgtagagatgagtaggtcctgtttggataactcatttgtctgcatctaatctgtatcctcagagttttgtagcctgtttatatcacatttaatttgatatttgttctttcaaaatctcctataattgggtttctcctccaggtcagggatagatgaggttaatcacaacaggatcaatgaaaatactaaccagtaacattcccagagccattacaatctgactaacagaaggatggagtagaaataaccattctgttttcaacaaacttttgattttatctcattttgaatgggcacaagaaaatctaagagagattctctttaagaattttattcaaatgtccccttgggtaaagtttgtatggagactctcagagctaatatatgagatactactttgattgttgaacgaaaaaagtaaagaaataattatgataaatcaaatgaaaactgtatttatattattaaactgaagaatgtgtggctttattactttatagaatgaagagttcttaaatcatgtaaggaatattttgttcttaagacaaagttgggacggggcgcagtggctcacgcctgtaattccagcactttgggaggcagaggcaggcagatcactaggtcaggagttcaagaccagcctggccaacatggtaaaacaccatctctactaaaaatacaaaaattagccaggcctgatggcgggcacctgtaatcccagctactcaggaggctgaggcaggagagttgcttgaacccgggagatggaggttgcagtgagctaagatcatgccattgcattccagcctgggcgacaagagcaagactccgtctcaaaaaataaataaataaataaataaataaaaagacaaaaatgaattgcgataatggtattattacggacgccttaaaaattaggacactctagtttcaaatattaccacatttcaaagtttcttttcaaggcctattacagaaaacttcaagcagcagtcaccaactcatgacatggcttttttattctgaatgaggcttgagatattgtacaaaaatgagtggatagttaaactttttttgagctgggtgcataaaatgaactcttgactttttatgatagccaagaaatcttcccacacacaatctgcaggccagttgcaagtagctggtgatctccatggtcaggtaagttggtaggtatctgcctacaagatgtaatttaatgggtatgaaaggtcttttattttttccccttcacacctgtcctgcaggtatcacagggactgaaattctgctagccaactgcactttagattcagattcaatttatactttttctaagcaccaactatacacccaactattgctgaattttttatatacatggtttacgtgtttagtttttatgagtgttttcccctcttacaacctacatactatagatattttacaagtcaatcaagagtcacatgtgggcaaaactaatttagtattcaagtgagaaaaatataaagtagtcacaaatatttgattttaagattaaaattagtaacccccaattttactgaaataacaggagctatgtcttattcatcttagttcattgtattcttcctaacacgcacacaaacacccttggctctccttatgtgtaaatgacattaaatacacataatgaatcctaaacagaataaactggtgacatctcaaagtagttgaaagggaaagaagcaactaacataaagaataaaagtgtaaagagcccagagtaatagggaggccaggacaggccagacttcaaggacaaggaagatgaataatgggaaactcatagagaaagtcaaggataacctggggtttattctgaacattgcaactcctgtcaccatgctctcaacagcagttccctgttacttaacaatccatcagtgccttctatttcctatagaataaagtctggattatttagccaggttatgccagggtctccaaaacctgtcccatctgttcctctagcatagctgatttagcctctctaaccacagtctttcctgtaatgggcatttgtacctgccattctttttcttctttcctaaccattccacaagccagcccaaacatcttctgcaaagccttctctgagttaatcctttcatcctctgtgctgtggtacctcctacacactttatattgtagcttatttgatccaataattgcaattttatgtttccctggccaaattatccactagactgggaactctttggagacagaaattacactctacttacttatgtgtcctcagccttttgttcagagactgtggcatggtaggcattcagtagatatctgcttgatgtgtgaaaatatggaaatttatgtttcttagcctggcagtcaaggtcctcttccagtctcactttctaaagataaaatgtcataaggatttggtaagcttttacttttctagggatgtaaaatgaggatgataaatgtgcctacttcaatgggttatcatgaagattaaataaaatggtacatgtaaaacattcagcatggtgtcaaattgttgacaaggactcaaatggtattgactagtatcattatatgacacatttttcaatatagataggtttttaagattatgtaagaataaataagtataagtatatggtaaagactttcagtgctgtggaaatactgaagaggatcacataaaggggtggagtcgggtaaggagtcaacactgtcaggcatctgaatgcagagtagggaaagcagagggaaattccaaggacaagaaatcaagacaccagatcagggggatttaaagattactttcattgaaagaatttttttcataaaaatctttaacagaggaggaaagctagagtatattatgtttaaataagctgaaattcttgagtattttgtgaaagttcttctctgtgctcagtttgacatattttaaattagaggctatcttgataaattgcttagaatctgagcttaaatttcttcccttcattttgttgacagaagtcctacattgctgatttgctttcattttgtcttaagtcgggacatttcccatgacagttaaataatttctgtaataacacttcatgcataactgctggctaactatagcattatccttgccatttctttttataagcatataccatgaaaatttgtgacaattttgttaaaatatacagtctcaaattggtttcttacacattcctgtgaattctgaattctcttctttgaaagcttcctagatagctcagcattcactgggttctccacttactcccttgaaggagattttgagtgctttgagcagctattacaaactagttaacggacttgggccaagtcagtgctctcttttctgcttccattttatctcttgctgaatgggaagctctaccaagctctattcctccagggaaagagtgtacagataagtgaaacaacatatttgaactattttatagatccctagaagaaaggaaccaagaacataattctttgacctagttaacaatttttggcctgctttgtgctattgttgggtttgtagtgacctttgtttgctgttttcccttcctttctgctctgtggactactgtcaatttattgtcactacttcaggcacataaaactggtgaacagcaaggagattctttactctcagttattagacaatatctgtcttttagaagtaccatacagatgaggatacagttcaagtttcagtcagggatttatctcccaggcatctttctaccaaaatgtgttgaccatctcccttatcactatgctatcataaaataagtattcaaataaccatggctttatacatttggccaagttcaaaaagaaaggttgctcttctagcaaatacatgtaaacagcttgagaagtacaataaaagtgcatcctgccgcaatctgtcattccatgcccacgctgttaggtgctgctcttcacgaccatgtccaagactctgaaaaagtttgtggagagccaggaagtggacagggtgactaggtcatctacaacatgctgtatgtcaatggcacattttccttatcccataccatacaactggtcctcagccataacaagctcacagtggtgccaccaaacacagcagaactgaagaatttggaagtgctcaacttccttaatagccagattgaggagctgcccacacagatcggcagccttcagaaactcaaacacatgaacctgggcatgaatgggctaaatactttgcctgaaggattttgctttctacccagctcttgaccttctggacttgatgtacaatttgaatgagaattctcttcctggaaacttcatctaccttactaccttccgtgcactcttatgtaagtgacaatgattttaaaatcctgcaaccagatattaggaagctcacaaagttgcagatacccagctttagggataacaacctgatcttgcagcctagggaaactggggagtttacccagcttaaggaactcaacattcagggcaactgcctgacccttctgctcccagaactaggaaacttatatttaactggtcagaagaaggtatgcaaagtggagaacagcccctgggttaccccaattgctggccagttccagcttgatgtgtcctgtgtgtctgaatgtgtctgttctgagacatatgagtacctctatggcagcacatgcaggcaaatccagaaccaccaaaacataataatcacaaatcagaaaagatgagctggaaacacctgacagacagtaacaaataagaggtgggcattggctgggcctctggcctcttctctcaccaacatttctgtcctttcttgctctgtctctcaaataaatgcaatgtgcgtgtgaaaaataaagacatacaataaaaggcaaaatgtattttataactcaacattctatccttaaatacttgggaattactcttttaacaagttcagttactagcataagtgatttaacaaggaatcaagtataattggattctaagtaccttcaggtacaatttgacccaaattgttttattcagtaacagaagaaaacactgcaccttatttgtaacttgactgcattttctaggaagcagataaggtcagatacttcagaagaactatttatctgcaaggagatatccttgtaccacacagagatttagaggaattaaaaaaaaattttgtttaaattttttttgtgtgtatatggtgcaattcagtgcttttccacaaatgattcaatgggagaccatagaaataagttagtattagtgtggtctttgaagccaaactgacctctttacataactaggcttcagctgtgtaatcttaagcacgttacttaaatcctccaagactcagttagctcatctataaaatggagttaagcgtctaactttttaatagagcaagattaaatgaaattaggaatgaaacatgctttgcacagtacatggcacataagaagcaaacaataactattaaccatacttattctcatctataaagtagatgaaatgacttcccattttagactctgcagaacctaattatattatagttaaaaatatgcagtataaatgctagcctatgttaagtgaaataagccaggcacggaaagacaaacatcacatgttctcacttatctgtgagaactaaaaattaaaagcagttgaactcatggagatagagagtagaagaatggttaccagaggctgggaagggtagtagcggggggatggttaatgggtacgaaaaatagttagaaagaataaataagacctagtatttgctagcacaacagggtgactatagtaaaaattaatgtaattgttcattttaaaatgactaaaagagtatatttggattgcttgaaacacaaaagataaacgcttgaggtgatggacaccctacttaccctgatgtgattattatgcattgcatgcctggatcaaaatatctcatgtgacccatagatatatacacttattatgtaccctcaaaaattaaaaattaaaaaaataaatgctagtaaaccacagatggtaagtcttaggaaatcttgcatcacattaaattctgtttctcacacagtctttgtcatccagtgtatattttgcatttatagcacgtctcaattagattaacctcctttcaagttctcaattgctatgtgaagccaccatattcgacagttcaggattgtgcaatttccaccttcccattcccagttgagtaattcttatctggagatgatctcagctggaaaaagggaatctctgcattttgcttgtcagtcctgaggccagtgacagctgtgcttttctacgttactaaaagaaggtttggcatcaatgtttaaaaaaatataaaaaagtgcatctctcatcctgagagtcaacttgagcaaatgcaatcagtcagtctttctctaacccttgtgtaaatctggaatgtgtttctttctgcagtttgacatgagacccgtctctagattgtaaaaatcaaacaaaactgtctgaccctgaaattgattctgcagcctttccaagtccaaggacttgcttccctgggcaattgtgaggctctcgttttagtgcctcagagaagcagagaaaatacagatacagacagaacgagataatagtaatagcaatagaatcaataactacactttcactagcatacgttctagcattttctgaggcctatgtgccaagaagtgtgctgtcttagatatccatcatctgatttaatagaatatagtattttaaaaattggatctcctgaggttttacagaaagacccttatttagatgagctcttttaaaaactaaggtcaatcaaattagatacagcactactagcttgcattgtcaaccacattaaatgtaattttcttaaaggatacctttctaccctcaaaagctcatgcacactaaggttgacttttctttataatcttcctaactacagaatattattactgttattttaatgttcaatttttaaattatttgaaagcatttattgagcagttacaatatgctgggcactgacctaagtactttatctacattatctcatttaatccctatggaaactaaatagtagacatttatattgtcattatattcatttgttagattcatttacatatggaaaaatagatgctcagtgatgttaacaacaaaatgaagaaaaataagccacttccattttcacaaagacactaattgacagaggtggaactcaaacctgaaaaagtttttgtgagcatactattagcgaataaaatattgctacgatatgatatatttatgcatagcacagtaatttgtttcctcaaaaattatatgaaataattacctttttatctcttcatcgtggaaaaattagcctagattacaaaaatcaaggcaagaagttgtttttgtttcaaatagcactagacttatttagttattaaatagttcaatattggataaaagtgtaagctccagaattagatgacctatattcagactctaataatttccagctgagtaatcaagaacaagttatttaactcccctaaacctcatttttcccatctgcaaaatggaagtaataactgcaatagattaatgcagttagcactgtgtcatacacatagtaagaccttcatgagtattaggttggttgttataataataagaattaaaatcttatatatttctgcattctacaagaagttcacaatacctggagaaggatgctctttttcttttttctaaattgatatgtcaggctggacacagtggcttccacctgtaatcccagcactttgggaagccaaggcaggagggtcacttgaagctaagatgggtctagagaccttgtctttacaaagaaaattgttttagttagctgggcatggtggcacgtgcctgtagtcccagctactcaggaggctgatgcagaagattgcttgagcccaggagtttgaggctacagtgagttataagcacatcgctgaactccagtctgggtgacaaagcaagtccctgtctctaaaaataaaataaaataatttatatgccatagtagtacatatctttgggatgcatgtgatactttgatacatgtctacaatgtggaatgattacatcagagtaattgggatatccatctcctcaaacatttattttttctttgtgttgggaatattacaattcttctagctattttgaaatatacaacaaattattattaactgtataactataaaatactatactattgaacactagaactgatagcttctctctctttatttttgtacccattaaccaactgttcttcattccccatccttcctttccttccaggcctctagtaaccaccattctactttcaaccaacatgagatccacctttttagctcccacgtgtgaaaggaaacatgtgatgtttgtctttctgtgctgtgcttatttcacttaacacagtgacctccagttccatctacattgctgcaaacgacaagattttatcctttgttatagcccattaaggttccattgtgggccgggcgcggtggctcacgccaggccgaggcaggcagattatcaggtcaggagatcaagaccatcctgtctaacacgatgaaaccccgtctctactaaaaatacaaaaaaaaaaaaaaaaaaaaatagccgggcgtggtggcgggcgcctgtaatcccagctactcgggaggctgaggcaggacaatggcgtgaacctgggaggcggagcttgcagtgagccgagatcgcgccactgcactccagcctgggcgactgagcgagactccgtctcaaaaaaaaagattccattgtgtatatatctaacattttctttatgcatgtgtccactgatagacacttatgttgcttccatatcttgactattgtgaataatgctgcagtaaacatgggagtgcagatatcacgttcatgtactgatttcctttcagcagtgagatagccagatcatgtagtagttctctttttaggcttttgaggaatcgccataatgttttctgtaatagctgtactaatttacactcccaccaacagcataaaagagaacccctttctttacatcctctccagtacttgttatcctttctctttttatagccattcgaactagggtgagatgatatctgtttgtggttttaatttgcatttccctaataattagtgattttgagcattttttgaaatacacctgtttgccatttgtagctcttttttccagaaatatctattcaggtcttttacccacttttaaatttgatgataatgatttttttgaagtgattgaattgtttgagtttgttttgttttgttttgagacagagtctcgctctgtcacccaggctggagtacaatggtgtgatctcagctcactgcaacctctgcctcctgggttcaagcaatctttgtatttttagtagagacgcagtttcaccatgttggccaggctggtctcgaactcctgacctcaagtgaaacgcctgcctcattctcccaaagtgttgggattacaggcgttagccaccgtgcctggctcttcaagtttttcagtgtatcccttgtcagatggatagtttacaaatatattcttcgatactgtaggttttctcttcgctttgttgtttcatttgctatgcagaagctttttagcccattgtaattccattttcctatatttgcttttgttgcttgtgctttgtaggtcttacccaaaaaatcttgacccaggccaatgtcctataacgtttctccaatattttcttctagtagttttatagtttctttcctgactgtgcagggacttgctgggagacgcaagcctctctgagccaacaagacctggtcccccagtgttggcctgacagcaacctcctcaggggcccagtctcagctccaaccattctactgcattccatctgtgctgaaacctgctgggagacatgcaccagcctgagccaaggagaaaggggtctcctttttggttttagaaaagagagggagaggatactgttttctgagtactgactttgatgaggtgccaagcaaccttagaaagctgctcatctgtctcatcttgtgtcacatgtcaagagtttcccacttttgcactaggtgtttgtagcattaacctaagtcctttggattgcctaataacactagacctgaagcagttgaatagacttatgattatgtgtttctattaaagaacttagatacctatctgaaatgtaatagtttgcaagttcccaatttaatttactattcatactttaaattagttaggaagactggaagaagtttaaatgcaactactgacctcatttcagttttcaagtcaacttgcaaatttttcaagtgacagcacttttgagataacggagttataggtttatcagcatgggtctggatataaggtctggcattcctatggctatttaaattgctccagacacatatttctgaaaattatgatgataggagtaaataagtttctgggacataatgacatcaattctgtagtaaattcttttttcattaatatcctgcaaattatcaaattaatggataaaatacccaagtaattactccagagaatatacaagatgcattttaagtttgctagctttgcctttaaaaaatagctaattttctttcttgatgtatgggcaagaagagattggctagagtaaaaacaaagttactttcaacataacgatttctttatcataaatacaagcctcagctcactgactgtcatgtgattttaaagaatagctttcccagtgttttccctttgggacacagattatttaagtgctgaatacagtaacttaaatatcttcttcaacatagaataaaaatcttgacttttttcattaggttagaattagtgcatagaagctaagaaatagtaaaacttatgtaatcacattatgcttgggaaactgttttcttgcaaacaaaggtatttgtctcttatttattgtgttgatcatgaaaatagtatctctaccctgaggtgttacaaaaaattaatcaagtcagcatgtatactgcatatgtgtcttctggaatatttaccatttaatcaagaacctaaaaaatatataacctagctcccaaaaagtaacatcagtggttaattgtcaggttaaagaaaagtaaaataaggctgggcatggtggctcacgcctgtaatcccagcactttgggaggtcgaggtgggtggatcatttgagatcaggagttcatgagcagcctggccaacatgaagaaaccctgtctctactgaaaatacgaaaaagttagccagtcctggtggtgtgcagttgtaatcccagctactcgggagcctgagataggaggattgcttgaactcgggaggcagaggtctcagtgagccaggatcgcaccactgtactccagtctgggctacagagtgagactcaatctcaaaaaaaaaaaaaaaagtaaactaaaacaagatagcaaaaaatgtgtttctcttttcttttttaaaaatgtttttaaaaaattaaagaattaacagataaaattgcacgtacagacatgtgtcacttaaggtcagagatatgttcaaagaaatgcattgttaggtaattttattgtgcagacatcatagagtatatttacaaaagcctggatgctataacctactacacacctaaggtatgcaatacagcctattgctttgaggctacaaacctgtacagtgtgttactctactgaatattttaggccattttaacacaatgataagtatctgagtatataaatatgtctaaacatagaaagacacagtagaaacacagtattacaatctaattgagatcaccatcatatatatgattcatcactgaccgaaatatcattatgtggcacatgactgtatttaccatgcaaaaaatgatagtttgaagtatatatacattgtggaatgactaagtctagctaattaccatatgcattaccacaggtagttaccatttttgtggtgagaacactttatatctattagcatttttcaagaacacgggaatattattaaccatagtcatgaggttatacaatagatttcttgaccttattcctcctacattactgaaattttgtatccttcgaccaatatcttctcaaccgcttccaaaatccctccccactccagcccctggtagccaccattctactttttacttttgtgagataagttttttagattctacatataagtgagatcatgcaataaatttctttctgtgcctggcttatttcacttaacgtgatgtcttgtaggttcatccatgttgtctcaagtgacaagatttccttctttttagaaggttgaatagtattccattgtacatgtttgtgacattttctgtatccattcatccactgatggacacttcggttgattccatagcttggctattgtgaatagtgctgcaatgaacacggaagtgcaaatatctcttcaatatactaattttatttcctttggatatatacctagtgttggtgtatattggtatataagtgtatatacattggcattgatggattatatggtacttctatttttaactttttgaagaaactttatactgtttttcataatggctgtattaatttacattcacaccaaagtacaccaggatttccttttctccacatcttcggtgatacttgttatcttttgtctttttgatcatagccattctaacaagtgtgaagtgataccacactggaattttaatttgcatttctctgatgattagtgatgttgagcattttttaatatacctgttggccatttgtttgtcttattttgagaaatgtctattcaggatctttgcctattttggggagatattaggtacattttatttttttatttgttttttatttcagaaggtttttggggaacaggcgttgcccatttttaatggagttacttgtactcttgctattaaattgtcttagtttcttacatattttaggcatagtttgcaaatattttctcccattctgtagattgcctcttcacactgttgattatttctttgctatgtagatgctttttattttgatgtaatttgtctatttttgattttgttgccattgcctttggtgtcatatccaaaaattcattgcccaggccaatgtcatggaaccttttccctaggttttcttctaatagttttatagtttttggctttacatttaagtatttaaatcatttttagtttatttttgtatatgatgtgagataagggtctaatttcattcttctacatgtggatattcagtttcccctgcaccatttattgaagagaacgcccctttgcccttatatactcttggtgcctttgtcataaatcagttggctgtaaatgtggagatttatttctgccctgtctcttctgttccattggtctatgtgtctgttttgtcatacaaaagacataagtaatttacaaataccattacagtattagagtattgtgaatttaactgtgtacttatttttaccagcgggttttatactttcagagtttttgtgatactcactagcttttgtgctttcagcttaaagaattctgtctagcactttttgtaatgaagtaggtggtaatgaaccccctcaacttttgtttttctgaaaatgtctttaattctccttcatttctgaaggacagctttgctggctacagtattcttagctgggttccttgttttttgtttttttgtttgtttgtttgttagttttaacaatttaagtatgccatcccactctctcctggcctgtaagatttttgctgcgaagtcttctgctagctgtattataattttttataagttatttgcttcatttctcttgctgctttcaggctcttctctttggctttgatttttgagtttgattgtactatgtcttagggaaatctttttttttttttttggattagatatgattggagacttttggccttgtacttagatacttacatcattctccagattgagaaagttttctgcaactgtttttttaaaataaatgttctaacccctttatctttctcttttccttatttaactcccatgacttgtacatttgctcttttatttatttatttatttatttatttatttatttatttattttttatttattttttttttttgagatggagtctcactctgttgctcaggctggagtgcagtgttgcaatctcagctcactgcaacctccacctcctgagttcaagtgattctcctgcctcagcctcccgagtagctgggattgcaggcatgcgcaaccatgcctggctaatttttgtatttttagtagagatggggtttcaccatgttggccaggctggtcttgatctcctgacctcaggtgattcacctgccttgacctcccaaagtgctgggattacaggcgtgagccaccacacccggccacgttctctcttttgatgctgttccatacatcttgtaagctagaaatattacaagaatttctttacttttcgtattttttctcatctgactgtatatttccatgtatttctgactgtatgttttcagtttcacagattgtttcttctgcatgatcttttctactgtcaatgacctctattgcattttttcattttgtattgttttcttccaagatttctgtttgacttttttcaaatcctgtattaaatttatcattctggtcacattgatttcttcatttggtgaattgtttctttatattttcttggagtttgctgagccttcttaaaagaactattttgaatctttttcaagcaattatgtttgtttagtgatatgatatttccccaatagttcttgatccttgtgtctgcatatttgaggaattaggtatttattccagtctttgaagactggctttgttaggaaaagccctgtggcaggtacagcactgaggtgtatcagaagctggggcagctgtgggtggcacggtgctcctcatagtctcaggtgtgccacagcagttgcagtcctggggtagttcagaaggccaggacagatgtggctagcatggtgcttcattcaaaaagcctgtggctctctgtcgtaggcatggtgctggggtggcagaagcccttggcagatggtgcttccagaatccttgggaccactacagcccacccagtactggaacaagctagaaacatcggtcagaggtacctggcatggaattagggcatactagaagccagaggccactgcggccaggactgcctgctgctgagggatgtccagagcccagagctgttgaagtaagtcccatggtggtgcaagctggagactgggttcaccaagcaagtgtgaaacttggagcttcgtggtctcatctggtgccagagtgttctagaggctcagtctgtgagtaccagcctgaaatacaggtctgggggtttctgtccagctgggttttactgtggcagacccagtgttggggtccaaggcaaagtcctgtgctcactttcctctcttttctccaagtagatggcatttctctccatgcttagctgtgcaacctgaggttgggggagggatgatgtgagtaatgcaaaattgcctttctatcatcatcaatgtgtcttttcttattattgtgctgcaactacataccgtgacctcttacctgggttccttagcttttgtgaacatattttcatgcatggatatatgtgcaaatcaatgcttctcctggggcaagtatgatcactggagagttccactccatcatctttctctgccccctaatctatggttttgttaaaatgaataagaactatttcttatgtcagctggttttagtaggcctttaagttgtcatgtggcttaatgggtgtttttgaagaataatcctgaaggggagcaacaaaaaggtcatggttatcattaattgtgattataatcacccacaaatatttactgaacacccattctgaacaaggtactctcataaatacagtcatgccctcaactaaatatttctttggtaaacattcttttgacatgaaatcttaatgaagggaaagacttacctcatcaaaatggatagatatccatcaaatccctttaaaaaatatggagaaatgtctggtatgcttttgaagatttttgaaatgatttttctcttccttagaccagttttgaaatgctttgaaaatgtttatttttacagggaagacataacactgaaaacattatttgtaggtagaatgaggtcctaatgaaattcacaggagttccatgtcagaaagtgcatgcagtggtgttcataatttcagggaggaaaatgggccatgctattccttatagaacttggtaccggacctcaattgtgaccaattcaaattttctactcccctccacctaaaaaaatcacactgaggaaggtgaaaaagatcagctttttataactttttagtaaaatttagtttagcagtgttgaatatatttcaagggccaaaatttaggtaaaactatgagctattcaatgggcagttgggttagagggaaaatctatgtatgtaaagataaaaagtcacaaggttaggtagtattaaagaaaatgaagatgatgttaacccagtgactgtagggaaactcttatggagagggagagagttagtttctggcttctgttgacctactgttcactgaatcgattagtatagttactttttcataccatctcactggcctcaaccattggcatctttgcctagaaggaaccacgatttgggaaaacatgaaggactactctccttgtgccctgtggaaacagacctaagttctgagtgacccaggcagccttctgttggtctctctgatttccccatcactgtagagtagaacagggatcagtaatagtcaacatttattcagtgctaactagagcagagagtgctatctcctttaacctcctaacagctctatgaagtaggtacaattattatctcatcttgaagatgaggatactgaggttcaggcagtttacataacttgccacaagccacaaaacggtgggtggacatcatggtcttaactgaagatatgacatttttaactactttctcaaagccatctcttaaagaagctggtataagtctactcagtgttcatgcccatggctgaagcagaaatagcttgggttttgaagataatgtaaactcaaatctcagcctagttatctactcaatgtgtgacactggctatctaattcaaccttcagtattggttatcttaattgttgtgaagatagtaaacttagctcatgttagtgcttactatgtgccaggcactgtttcaagcactttatgaattaacttagtagtctctacaatataactatgaggaagatactgttatcaccctcagttttactaaggtacatggtggttaagtgagttgcctgaagtcacccagtaggaaaatggtaaacctgagattcaaactcgcataatttctaactgctctggtcttctgactgtggagagaaaaaagcttagcacatgttgactgtgtagaacatagcgaggtgctcacccatcataaatgcccatccattttccctgtttatccaaaatgtttgtataaaattatttcaaatattttttctgggtttctaaaggtaatagtactgaagtgcaaggcagcttccatgttcctcaaatacatcagtgaacatgatttttcatgctttcactgacaggtattagagatgctacagatggaagacagaaaatccaagccagttctatcaggtggtccttcaacatacctttctctattgatcctttgctttaaccttaatcaccttattcttgttctcttcactttgtacctgcatcatagtaacagctccataactagtctctcagcttcatttttgccctgcttaaattcatttttaacaaattgcacccagagttatttttcaaacacaccaattgtgtcgctgttcttttaattgattcagacagcatttatgataatgccgaaactctttaataaggccatttatgtctcatctcttgcctctggtcttcttcccatgctggttttattggcttgtaataggagtccactgcccttcctttctttctctctctctttctctctctctctctctctctctctctctctctctctctcactcacacacacatacaaacacacatgcattgaccatctttgcttgggtgtccccttctactactcttcagatcagatctcaactaaaatgtaaattctccaggatatatatattttctccaagtacaaatcagatacctttctaagatatgtgttatcacaccatctgaaattaattttctgcctgctctagaatgcaagttatatgagggaagaaaccgtggcctggaatataatagacactcaataaacatttattgttataaatgaatgaatgaatgattgaatgaagagattcgtaattaatgaggtctaacatagtaatggcttcttgcagaacctcttcagcaccactgtatttcaagcaatctaatcctttgttcctctcttccgtggcctcttttcagccaagccatacttttgcttaccccaactccaataaaagtaatccgtttccaaggaacaacttttatctagctaaattggctatgaactcccacccatttctgaaattttctgtaatggcagagagagggtaaaggagggaaccagcagttattgctttcacagaaacaatagaggagttaaagaagcttaaacaggagcatggtgactaaaggagccctaattagaggagagcagaggcagagggaatcagggtgcctaaaagggaatgtaggagaagactttcagacagatgtgatgtctagatgtttgccttttctattaagggaaaaacaggaggacgtgtttaaaacaaaatatgagtgccttgattaagcaaaaaggtttttcctgtcaggtttcttttttttttttttttttttttttgagacggagtcttgctctgtcgcccaggctggagttggagtgcagtggccctatctcggctcactgcaaagctccacctcccaggttcacgccattctcctgcctcagccacccgaggagctgggactacaggcgcccaccaccacgcctggctaattttttatatttttagtggagacgggatttcaccgcttgtcaggtttcttaattcccccaaattttaaaacctctgtctaaatctgtaatattttagtttatcaatgttctgtgattggtcaacttcttattttacttaccatctttgtatattttagttctgttgtttttgacacattatatgaaaggaggtttttcccagacctaggaatctaagaataaaactgagtttttaaacttttctaaaatattacttaccaaaatattttcctctgtcccattacaagctagtcattatcttcttctatatcagaatttaatataatttaggtacacttttaaattcatttatgctacatattttttttttgagataaagtcttgctctgttccccaggctggagtgcagtggcacgatgtcggcttactgcaaactcggcctccaaggttcaagtgattctcccgccccagcctcctgagtagctgggattacaggtgcatgccaccacaccctgctagttttgtgtgatttttagatatctgcacgaaaatactacagagctgtcaccttactttcagggagcagccaacttctatataattcaatgtttcaacaaagatcattgagtagttaatacatgcagagaactatggctggttataaaaggtgtgggtgcaggtctctgtttatgaatggattaagtttcaagaatccctttgtgaaagtcaattatgtagaaacttcaaatgcattttcctacagaaatcatggttataaatggtgatttgatttccccatatttaactcataagttagccaagatatgtttgaaataaaaagtaggaaagaatgttagaataccaaaaatcaattagagagcaattatagcaggctaggcatggtggctcatgcctgtaatcccaacactttgggaggccaaggtgggcaggtcacctgaactcaggagtttgagaccagcctggccaacatggagaaaccccatctctactaaaagtataaaaactagccaggcctggtggtatgcacctgtaatcccagctactcaggaggctgacgcaggagaatcacttgaccctgggaggcagagtttgcagtgagtcgacatcatgcctccgcactccagcctgggcaacagagcaagactccatctcaaaaaataaataaataaataaataaataaaatagcataattgaatttaaaagtacatccaaattatattaaattcttgtatagaagaagagaatgactagcttgtaataggacagaggaaactcaataagctgtcacatcctctccccctcttatggcacacactgctaattgatcatggcctccattttcgttaagccctcaacctcaaaatccttcttaaaacagtgttttctgcaaccgctaccatcccagttatacctggcatagagaaattgtttggcattttgttgatagagatggcattacttccaacattgtaaagcaaagaaacttatagtagtcacttgaggacaggaggcaaggtggagataggggcagaccagtaataaatggacacttcatggcattagttcacaggatttggccaaaacaaatgattaaccttagatgaaaaacagggtttctaatggccataatgcccaaaataatttatagatacaatgctattcccaataaactaccactgacattcttcgaagaattagaagaaactattttaaaattcacatggatccaaaaacagagctcgtatagccaagacaattccaatccaaatgatcaaagctggaagtattatactactggacttcaaaccatattataaggctacagtaaccaaagcagcatggtactgttacaaaagcagacacatagaccaatggaacagaacagagaacttaggaataagaccactcctctacaaccatccaatctttgacaaacctgagacaaacaagcaatggggaaaggattacctatttaataaatggtgcttagagaactggctagtcatatgcagaaaactgaaactggatcccttccttataccttatacaaaaattaactcaacatggattaaagacttaaatgtaaaaccaaaaactataaaaaccccagaagaaaatctaggcaatacaattcaggacataggcaaaggcagaaacttcatgatgaaattgccaaaagcaattgcaaaaaaagcaaaaattgacaaatgggatctaattaaactaaaaagcttctgcacagcaaaagaaattatcatcattatgaacaggcaacctacagagtgggagaaaatttttacaaaccagcaatttgacaaagatctaatatccagaatctacaaggaacttaaacaaatttacaagaaaaaaatcaaccccattaaaaaggacatgaagggacacttctcaaaggaagatattcatgcggcccacaaacatatgaaaaaaagctcaacattactgatcattagagaaatgcaaatcaaaaccacgatgagataccgtctcatgctggtcagaacaatgattattaaaaagtcaagaaacaacagatgctggtgaggttgcggagaaataggaatgcttttacactgttggtgggaatgtagattagttcaaccatttggaggagggtgtggggattcctcaaaaatctagaaccagaaatagcatttgacccagcaatcccattgctggatataagcccaaaggaatataaatcattctattacaaagctacatgcatgtatatgttcattgcagaactattcacaatagcaaagacatggaatcaactcaaatacccatcaaagatagactggataaagaaaatgtggcacatatacaccatagaatactatgcagccatatggagctagcagccattatcctcagcaaactaatgcaggaacagaaacccaaacactgcatgctcttacttgtaagtgggagctgaacaatgagaacacatggacacaaggaggggaacaacacacactggggcctgttgggcagttgggtaaggggagggagagcattaggaaaaataactaatgcattctggccatacctaggtgatgggttgatgaaaatgaaatatgtttgccttaatacctaggtgatgggttgataggtgcagcaaatcaccatggcacacatttacctacgtaacaaacctgcacatcctgcacatgtaccctggaacttaaaataaaaaattaaaattaaagaaaaataagggtttctaggctaggggttagccacactgaaacagtctggtaggagggaggaagtggaaatggagccacatagctagttatgagatagatgccctataaatacatggaccaggggccatggaacttgtgtcagaattctcaatgggaagcatctccctggattgtgtaaaatgagatgcttacatgcagcgctgccattaactgggtagtcaaggatattggttcttttattctaaagtagttatcattagtcttaattgaacttcatcatttcagataaatctggggatctttgggatgtctgattagtgatgctatgattcaattagattgtacagtcataaatattacctgaggttgaaatatttaatagggtacaggattttgttcctacttttttgtcaaatgattttcacagaatagcccacaaaagatatctagcgcaatgctaagtttgtcctggagaataattggaaaaaaaatcaaaatgaaatatgattgccttaagaaatgaccaacttaataataggccatgtttggaaagccctgggtagcatatatccatttcactgtcacatgtaagtattcattaaattgggggaataaattgtgagaagggaattcccataagtagtcttaaattttgccaaagcttaattttaagctctattttctaggcaaaatcttcaaaagccttaatacttgaaacataagaaatataatttctttgaccttctcctttacttacccttcttactttacttaaaggctcaagttgtttgagcttataaagtacttgctatgaatggccaaatatgtttgagtcatggttttggaaaatcacatgatccataccagaggagagctgtgtcttcaaattatcttctagaaaggttcaccagaaagtacaaaaatgtttacattttagagaaaggaaggagatataaagcataattcatcctgaaatatttatttcagaaatcatgcaattttcaagatatcttccaagtttccagcttttttcctgactttaaatatttttaataattttaattttcattatacatatatatacattcactgtagaaaatttagaaaacaaaaaagaaagtaaataaaaatttcataagataccgtaacattttgtatacattatttcaatctttgttctatatttatatatatttatgtgtatattcctttgcatataagttcgtgtagtatatgctgtttttaactattttctcatgcaaagtatataattaacatctttgcatgtaattaaacattattctacagtatcattccaaaagccatatagaagaactccatatgatgaaagcactatgatttaagtattatcttactgttgataatttggttttattacagttttttactttttaaaaaaactctgtaaatatttttgctgcttaatctctggtcatctctgattatttcctacagataaattcctagaagacttgctgagacaagatgttatcacatttttaaggcttttatctttcaaaaagatttcaccaacttatacttccatcagtagtatgatgaactgctttatttactttcagatggaataaaagcctctgctagtggatctcagctttataaccattttataggagaatcagtcttaggatgattatccattgactttttgaaatagttgccactttgttgtgtctacttttgtagcattagccttcatttcattatgtcaggttaaagacatttttatgtattaagaaattctaaagaaaagaaacctatcgctctgatattttccattgatagcttgaactgctattctaacatgtttataactctaaaccatttgttttttaagaggttctttctaagaatatattgtacttaactgatggacaaggttttgactttgccaaactcatttctaatcatttaatccttttaaatcatcttcctcttatcagtttaatctatgttaagattgtatttttattcacagtttgcatgtctacaagtttccaaatgtttacttcatttcaaagtacttgctactataataatgcatgttaaacatagatgaatatgcaaagacttaaagccatttggatttagaattgcaaagtctcttttaggtcatgagccaggcataatgccctactaagagaagaaattactgcatcaaatcactcctaagccaaaccaatacatatctcatcatttcatgaaagctatctagcttcagagaacacctaacttaatgcattcagttgtctggaaaaacagccgaggagtttttctttgagaaaagttcagtgcctgataatcaatagaaaaccatagacaatatctgaagtctcaaaagcatatgtctggaatgtcgtgaataagacaatctaatggggcagatggggtaagagggtcattttatccatattaaaaagattaaaaaccaaagttctcagtaattgattctacatctcacatagacctacatgcagcttgttgatagaaaaaaatcctcctcagaaactttccccgttagctaattcaaaatatccattcatccaaagagtctctactccatacacttggtgggaaaccagactgatttccataaaatatccatattttatcatcacagctcatagcatcaaatacatattccagtgtttaaattgccttgaagtcaattaagggagtaaagggatttaacaagaggtgcctgagaaagatgtatttcaaaagattttataaactattactttttttaaaggcaatttctgtgaataattttcttaaatatttatctacatagaattgtgttagaaaaagaaagccaggttattcttttgaggttttatattgtaaaagtcaacaggaagttatttttatcatgattcacaccctgcggttgagcaaaggctgagcatgatagaggcagaacaaagagaagtaaagcctgttgttgggactgttgtttaaatatccttttcttctgacccctacacagtgctctgcttacgtttgatactttaaggatccctaacttctcttgtcttccctaaggcaagtgttatggctgggaacttaaatggctattcttaaacctcacagtgtaaagtgtgtctccaactcgttccatattgttttagagccacttgtgatttaatgtggtacatttcttctcctggcacttgatatttgataggaagtggtgtatagtgacttaaaggaacaagagagttccaagggtaaagtatctgtattagttggctctcatgctgctaataaagacataattgagactgggtaatttataaagaaaagaggtttaatggactcagagttccccatggctggggaggcctcacaatcatggcagaaggcaaatgaggagcaagtcacgtcttacatggcagcaggcaagagagcttgtgcaggggaactcccatttgtaaaaccatcagatcttgtgagacttattcactaccatgaggacagtatggggaaacctcccccatgaggttttctggccctgccctttatacatagggattattacaagtcaaggtgagatttgggttgggacacagccaaaccatatcagtaaccgatattagataccagagagaaagcagagctgaagatgacacgtattttagcctagaggcccttgctgttgaatcttaaatccaggcataatggtaacacctcattttattaaatattctgaagtaaggtgaggactcctaatggttatttgtaggataagtaataggagaagggggaatgagtttttgtggatgtgtacaacagcgggtaattgggtccaaccttccttacaaggggattctcattttaagattaggaaaatgtcatacagagagagattttaaaggactaagagaaatagctcaattttttttcacctccttatacagagaaataccacagaaaggacaagatgtgatcaaactttctaagagacacagaattaaaacatagagaaacaagaactatttttaagtgaaataaaacatcagagtcaagatcaggaacttgtttgtttgccaattcagtatctcctggacaacttcctaaatctgtatcaaagtcctgagtcatcacatttgatttaatttttagctccatttaacttctactagatcatatgcagacctaattttcatctgagtcacttctatactctcctgtcaccaaaaatagagtttaaattatacaatagacttataagtatttcaaataccattacaggtaatacaatcagagaatcataatagcccgtatatccaaaaacattagtgattatacttattgcttcttgtcctaaagtaagacagcaatatgaagaataacaaacattcaggtgttcattctatgaatattcatctgtgttagattattctcagttgcagtaacattcagtccttggattaaaagttaggaggggttcatccatgagaaatgtgaaaaacaaaaagaaaacacacattaccctatgtattaccacattagacaggaattcaggggtaggggttaaggtagacttcacaggaaaagggaaactctatacagttgggcctcaggtagactaaattattttgctagttggatgtttgcccaaaattcactgcaatgtgagcttccatgctactactttagttgttggacttcagaatctctttcaacaacatagatcagtaactcaactcatgttgtctatactctttcttgtatatcttttttttccttccatccccactatcacctgacttaattctctgtatctccagttcaagctctggggagagataattaccctattatccactagttagcttacagattggctacagttggaacagattatctttcaccgctctcccacctgtgatgtcaactgaatgtggttatttctgttaaaatggggctctggacacagttggcattctgcagttttgactgcccaatgtatatgtgatatcagtaaccaaagcaaaatatcttttaaaaacacagtgataggattttctaccatttttattttaaataattatttggtataaaaagcatatttaataatatataataacataatttggtagatatattactggtatgtttatttaaatattgacaataatatgttttaataaaatgaataattttataaattatttttcacttaattttcacgtataattactaaaaaaattctatgaagcatgcaggcaatatatgtttctctcacttagcacattagtttaaggttggccctcaataaataaattgtaaagcaggattgtgcctttccccagatcactcagccagggaataatagagccaaatcgaagctcaggtctttgtatcaccagtaatgtgcccctcatatgtagctaaaagctctttctacagtacctagcagctcaatgggaatcaactggtagagagatttgttttttaaatactaaaggaaaagcctagataatgtatgctagcaatacatttttatgtctggaagataaactgcttttacttctgaacatttctatgttgtggactctgtattaggtcattcttgcattgctataaagaaatacctgagactgggtaatttataaagaaaagaggtttaacttgctcatggttctgcaggctgtacaggaagcatgaggctgacattctcatggcttctggggaggcctcaggaaacttacaatcatgacagaaggcaaagcggggagcaggcacgtcacatggctagaggagtaggagcaggagagagagctgggggggtaccacatgcttttatacgaccagatcttgtgagaactcactcactatcacaaggacagcatcaagaggatcatgctaaactatccacgagaattccacctcaatgatccaaacatttcccacaaggccccaccaccaacactgaggattacatttcaacatgagatttgagtagagcaaatagtcaaactatatcagacacactcagggcttaaacgttaggattgtactcatatacaaggtaaacctcctcaactctcaatttctctgcttaagcaatcattctagcttagtcagttagggtcaaaagcatgtacatggtatttgacaagatgactgtagagatgatgtcttactcagaagagagagatctagtgagagatgtgggtacaagatgtcctttttttttcactgtcttataaatgtaatataaaatgggaatttgaagagaaggttcatgatattactgcccagattgcctttctataacaagggagtattattaccactgggaaaaattctcaatatgaacaatgtacgataaaatgctaaattaacaagtcaaggtaattgcttgctccctttgcccccgatgaattagtgcaaattgcatttcacactaattggtccacaaaattcatgcacaataggaacactgggatttcttcagttttgcttgtaaatgtatatatacatacaaataacaagactgtttctttattttaatagtttgttacagactaataggtgcactaattagtctacctctccaaggtgatcttgaaaacaataataattagtagttcttggtgaaatataaccagagaacaaaaaaatgggtgctgcgtttatgtcagaaaactttaaaatatgtgaaatcttagaatataaagttttcaaataaaagagatattaaattaccctattttaaacgttgcttctaacattgttgcaaattctttgctgatgagaataatcaatcaagtgctttctagtgtttttattattacaacctcttttaatcttcctctacttcatggtgccattcttagaaatagtattgcctttaaaattatattttctaaataatgactaattttgttgtccattttctattaactgtaataggtaactgttaatcagggcttcagagttatggtttgagtgttactgtgcttgattgacataatcccagactagagcaaaaccatgggatgtatagttagttatgggatatttcaccgagagtaaatatgtaacttctactaggctacttgaaaatgttgggcagacagtaatcacttttgaggctactcgtttgctctaaaatgccaaatttaaaatcccatacataatctcatttggaacaagcaaacaacataaaacaggcaaggaagggaaatagccttatccttgataagagctttggggactctatcaagtcctggatttttatttgttcatttttcatttatttattgagcatgtgctttgtgcaagactctcttaagatgttaacaagccaatgagaggaacatgaaagtaagcaattatggtacggtgtgacaaaggccatgctacgggatgattcaagtctggtgtactggcaatgatgagttctggatcttgctcttgattccagcaggaaagttattgatgtttcttctggagattatgttcagtacagatagcattattggtacaatttcaaggctcttgattctctgtcttttttaacatacctggttctatggaagtctagctggtattataaatggttacttgatcattttatcactgatagcctgctctgtgtgatgtttccaatagctgtcactttaagacaggctttttgtttggtttaaattaaacccaacagagggacgctgaattccaaaaaagtcgttgatgatcattgtggaatagtgttctctcataatttatttcaaattttagattagcgtacaattggattcagaaaagaagtgcaggacatagtctataaagtaataacacatatctgtgttgctcattttaaaaatggatttgcggctgggttttatttgaagataaacgtaagcatgtcttttaggatgaaaatatgtattatacacttaattattttaatgctttcaacattctagtgagagttataaaatactgccacttctgcataaagaaattaagatttttatctagagtcctaataaatatttctcaagtgaaattttgaggaaatgcagcaatgtaagtggaatcaagcaactgttttatgttactttttatactaaaatcactgatttgagggccatataggcatattttggcatactcagaattaaaggcagagttacttgagctgttaagcctaatgccattgcctattatgaatattacaaaaaagcaatcactttttctgttatccaactgacatttccttcatgagtataacttcactgaatttgacatctgcaaagcatatttgatgttagataatactttccaattataatgacatggtaatttgctagcattggaagtattatagaatactacctcatgatacctaatcttcctctgttttatttgtggggctctcttaaattgaataaagactttgtggctctcttgtgtaaaccgcttcactcaaaccttactcagtaacaaatttattttacagacatagaatgggcttcaaagctcagtacaatcagtagcttgatgatgttgccgaggacctgggatgcttccctctcacctcgtggcctcagcatcctgagtctggttattttcgtggccacagatgaatgccaatagccactgcggccacatgcttccctgttcatgaaaaaaactggtttttttttctaccaccaagacaatttagaatacttgcacacccctggatcaataagagtcactagaagaatgccaacacactgattacctgaggctaatgagttatatgcccttggagttggggttaagcacctcgccctggatcatgttgaagaagagtgaatattgaagaagagtgaatatctgaatacaattagcattcttttaacgacggaaaagcttagaagatggaaggcattaggtatcaatagactatgtacaatattctttctaacgaagaatggatacttcagttcctcagttcctggaactcttgatacttttatataacttgatcttatgaatgaattgcttggtaggaagatggttgttggaataccagccagacagtagtccccctaaaaactggtaatgccatttttagtgaaaatgtgatagtttctcgttggttttcaaataaacttttttggtccttttatggatagtcagatgaacttgtttacccatgtctctgggtctaaaatgaaaataagattaacagaaggctttacaatcatcgttcttcttgaaatcggtaaacattctcttctgggattctcagtggtgtaacaggccagatttagcaccggttatcagaacataaaagtcaacaaaggctgggcgcggtggctcacacctgtaatcccagcactttgggaggccgaggcaggcggaacacgaggtcaggagatcgagaccatcctggctaacacggtgaaaccccttctctactaaaaatacaaaaaaaattagccgggcatggtggcgggtgcctgtactcccagctactcgggaggctgaggcaggacaatggcgtgaacccgggaggcggagcttgcagtgagccgagatcatgccactgcactccagcctgggtgacagagcgagactccatctcaaaaaaaacaaaaacaaaaacaaatggcaacaaagtttggggagaaaacacgtaacttaagagaaagtaatgctaaatcttaatttaaaatataataaacctatcacattggaataaaatacttacaccaaaggccacttaagtccacatatcaagtttactctgtaccttacctcccacacacactctcctgcccttaaaccgatatgtgcaatcatccttttctctgttaatcagagaaagattatacatttgatctctgttagcccgtcagtggaatcttgagatgcacaacaaattaaatatataatctttcaaaataaaattaacttttcaaagaagttcagtaattttccttacaccgtaaggcaacctgctagtaaccacaacctccaggtgagtgccttggaattttactctgaccttctccatcaagagtggatcctgcctagaaacataaaacaagcgcattagagatcccacacaatgatgtttattcactgaagaaataaagccttttttaaaagactattttttaccagattgtctctcttagcaggtgatacttctcctcttgagctcaggtatcaacctgtagtgaagctttaaggaagtctagtgagaactcgaccttggtctcatttcttgcactaacatgtatctactgcacttacctctaacattgccacttattctgacatatcccatcaatataaaaaaactgagtgaagtgtactgcatccattcttcagtgtgactggtatgtcacaacatttgagtttccctgatttgtgtaggggtttctgagttctttttcattttttttccctatgtgataccattttgggctagggaaaaatctactcattggtagcaggtgaaatccggagctaggaagatataaaatagctcacttggcggcattcatacttgagacgatagtgagatgatgctaattaatcccttaccataagtcagacctggtgtgcccaagtgttgtcgtcatcttccatcaaagccaaggtaagcactgtattacctctccttcattcgatgaggagtctcagacttagaggagtaaaatagctgcctgacatagcacatctcaaacctgctaatattggtgtctcctgctggtgctggaagtgtgtacatttgtggttttgtgtggaagactacggatttctgtttcttccatgtagtgaaatatatggccagtgacctattgtcaaggtgagagtttagaaccatacttatatcatctctgacctaattgtaaaagcataggatattttcttagaccaacattatatttgccaaaatcctaagaaattttagtgtgtattttgttcagagaagataaaaaattgtttactttgagttcatattgtttgtgtgtgtgtgtgtgtgtgtgtgtgtgtatgtgtgtgtgtatgtgtatgtgtccttttttttttttttttagatgaagtcttgctctgacactcaggctggagtgcagtggcatgatcttggctcattgcaacctctgccttccaggatcaagcgattctcctgccttagcctcccaaatagctgggactacaggcatgcaccaccacgcccagctaatttttgtatttttagtagagacggggtttcaccatgttggccaggctggtcttaaactcctgacctcaagtgatctggctgcctcagtctcccaaagtgcttggattacagatgtgaaccacatacagataccatgtatgtgtatctttaagctgagtacacattctctctagagattctcagtggagtaccaagaaataaagagaactgctaaattggatagataattataaggcacagcttctgccctaaatgagcttactctctatagaaaaggcaagggcaagatgcactcagacaaatttaattttaaggaacataaataccatggagttaaggggaggaaggataaaacttagggtcatataataataaccataaatcattttgatcacttctgtgctaatgactgtgctgagttcattatttgaattcataatgaatttgccatatcattcatatagtagagttatggaagtttccacaagtggagctggaccagttatgtgaattcatccagtcagactcacatggcctcagccagtccacaatgtaccctccccaagatagactgacctaatgacaaggccattgaaagctcaaacatcccaactcactaatacagatgataaaggaacccagagtacaggaggtctcaggtaaatattggtagtggggagtcaggtagatgggttctacctctaaaaccttggataggatgctaactaaataactcacattctatatggaatgaacatacctcaacataataaaagccacatactacagacccacagttagtatcatactgaatgggaaaaaaactggaagcttcttttcagtttttagaaaggaggcccactttcagcattgttactcaacatagtactggaagtcttagcgagagagatcagatgagaaagaaataaagagcatctaaatcggaaaggaagaagtcaaattatccttgtttgcagatgatatgatcttatatttggaaaaacctaaagactctacaagaaaactattggaactgataagcaaattcagcaagttgcagaacaagaaatcaacatacaaaaatcagtagcatttctttttctttaatatactttaagttctgggatacatgtgcagaacgtgcaggtttgctgcacaggtatacgcgtgccatggtggtttggtgcacccatcaacccgtcatctacattaggtatttctcctaatgctatccctcccctagccccccatcccctgacaggccctggtgtgtgatgttcccctccctgtgtccatgtgttctcattgttcaactcctacttatgagtgagaacatgtggtgttcggttttctgttccagtttgctgagaatgatggtttccagtttcattcatgtccctgcaaaggacatgaactcatgccttttatggctgcatagtattccatggtatatatgtgccacattttctttatccagtctatcattgatgggcatttgggttggttccaagtctttgctattgtgaacagtgccgcaataaacatatgcatgcatgtgtctttatagtagaatgatttataatcctttgggtatttacccagtaatgggattgctgggccaagtggtatttctggttctagatctttgaggaatcgccacactgtcttccacaatggttgaactaatttacattctcaccaacagcgtaaaagtgttcctatttctccacatcctctccagcatctgttgtttcctgactttaatgatcgccattctaactggtatgacatggtatctcattgtggttttgatttgcatttctcatcatcagtgatgatgagtttttttttcatatatttgttggccacataaatgtcttcttttgagaagtgtctcttcatatcctttgctcacttttcaatggggttgtttgttttatcttgtaatttgtttaagttctttgtagattccctttttcagatggatagattgcaaaaattttctcccattctgtaggttgtctgttctctctgatgatagtttcttttgctgtgcagaactctttagtttaattagatcccagttttcaattttggcttttgctgccattgcttttggtattttagtcattaagtctttgcccatgcctatgtcctgaatggtattgcctaagtttccttctagggtttttatggttttaggttttacatttaagtctttaatacatcttgagttaatatttctataaggtgtaaggaagggggtccagtttctgttttctgcatatggctagccgtttctcccaacatcatttattaaatagggaatcctttccccattgcttgtttgtgtcaggtttgtcaaagatcagatggttgtagatttgtgctattatttctgagctctctgttctgttccattggtctgtagatctgttttggtaccagtaccatgctgttttgattactgtagccctgtagtatagtttgaagtcaggtagcgtgatgcctccagctttggtctttttgcttaggattgtcttggctatgcaggcccttttttggttccatatggaatttaaagaatttttttttttctaattctgtgaagaaagtcaatggtagcttgatggggatagcattgcctctataaattacttcgggaagtatggccattttcacggtattgattcttcctatccatgagcatagaatatttttccatttgtttgtgtcctctcttatttccttgagcagtggttctatatgccagcagtgaacaatctgaaaaggaaattttaaaagtattctcagttataatagccacaagtaaaattaagtacctaggaattaacaaacaaagaagtgaaagatctctacagtgaaaactataaaacactgaagaaggaaattgaagaggacacacaccaaaaaaatggaaagatattccatgttcctgatttggaggaataaatatcattaaaatgtctatactacccaaaccaaatactactcaaagcaatctacagattcaatgcaatccctatgaaaatactaatgccgtccttcatagaaatagaaaaaaaatcctaaaatttgcatgaaatcagaaatacccagaagagtcaaagttatattgagcaaaaataacaaaactggaggaatcatattacctgacttcaaattatattacacagctacagtaactaacacatcatggtactggcaaaacaaacaaacaaaacaaacaacaacaacaacaaaataaaacagacacaaagaccaacggaacagatagagaacccagaaacaaatccacacatctacagtgaactaattctcaataaaggtgccaagaacattcattggggaaaagacagtctttcaataaatggtgcggggaaaactggatgttcatatgcagaagaatgatgcttaatccctctctctcatcttatacaaaaataaaatcaaaatagattaacaatttaaagctaaaacctcaaactgtgaaactaccacaagaaaacactggggaaactctctaggacattgatctgggcaaaacatttcttgagtaataccacacaaacacaggcaaccaaagcaaaaaatgaataaatgggatcacatcaagttaaaaagcttctgcacagcaaaagaaacaattaacaaagtcaggatacaacccatagaatgggagaaaatattttcaaactctccgtctgacaagggattaataacgagaatatagaatgagctcaaacaactctacaggaaaaaagtataagaatgtgatttaaaaatgggcaaaagatctgaatagacatttgtcaaaagaagacatacaaaatggcaaacaggcatatgaaaaagtgatcaacatcactgatcatcagagaaatacaaacgctacaatgagatatcatctcacctcagttaaaatggcttttatccaaaagtcaggcaataacaaatgctggcgaggatgtggagaaaagagaaccctcatacactgttggtgggaatgtaaattaatgcaaccactatggagaacagtttgaagttacctcaaaaacctgaaaatagtgataccatatcatctggcaatcccactgctgggtgtatacccaaaagaaaggaaattagtaaatcaaagaaataactggactctcatgtttgttgcagcactatttacaatagccaagatttgtgttcatcaacagatgaatggataaagacaatgtgatatctatatctaatggatataaatatccaactattccaccataaaaaggaatgagatccagtcatttacaacaacatggatggaactggaggtcattatgttaagtgaagtaagccaggcacagaaagataaacaacatatattctcacttatttgttgcttctaaatatcaaaatatccaaactattaaactcattgagatagagaggagaaggatggttacaacgctgggaagggtcgtgatgggggcagagaggtggggacggttaatgggcacaaaaaaaaaaattagaaagaatgaatgagacctaatacttgatagcacaacaggaagactgtagtcaataataatttaattgtacatttaaaaataactaaaagagtataattggattgcttgtaccccacaaaggataaatgcttgaggggatgaatacccaactttctgtgatgtgattattacactttgcatgtctgtatcaaaaaatatcatgtaccttataaacatatacagctactatgtacccggaaaaattattaaaaaataaaaatcattctattctgtatttttatcaataaattgagatttaaaatatcattttcccatataaaacttccatatataattatagctgaataatacaatacaacaaatgtaaaaatcaactacacactgtacatcagaatagtctaacatcctgtttccaactggatagatgtcctaatttattctccatgttgtgtaatttttctgtctcacacatattgctttgagatagttactaatcaatgtaagaatctgaagaaaacttctttgtttccaggtcttcataatactaaaacttttaaaggagacaggctgtgttgtctatgggaaggcttggggtgggggagataaacaagccagtgttacttgtctgttttgattaaagatatcaaaaaacagattaagggtctttcatctgtgctgtgtaggctcagatgctgacagttatagggaggaccctccctctgagcatggtagcaaatgtctgggcataggaatggcatagcaaatttcagactcagatgcataaattagagtctgatttctccatttattaactgtatgctttttacagatttgtgacatgactaagccttaattttctcatccataaatgggtccatacaacatgggattgtttaatcatgaaatcaaataacacacaagtaaaatgcttaacatggtacttggtgcataataagtcctcagtaaaggatagctttattactattgttatttccatctgtattttagaggtacgtaatacaaaattcaagaatcccttaatcttttagctttttattccttctttgacaacaccctggaaatgttaagtaacttacactgttttaagttcctttgaatatttttaaaggatgatttttcagactttgcagaagagaaactaggatcacatatacggtgacttgttcaagactattctgtaggttcctaatagaaatatcctttgtattctgcagctctttctcccccacactgtgcttcttttcatgaataccaaaattaaatcaaagttgaaacattaaccagagaaaagcttttattgttgctttttcccttttctgaaaagaaatctaatagccacagtgaagatgtaaccatcgcgataacttagcgtgtttgacaggtcctccctacctcttctcagttgttagaaaggatgcccacccagatttttttttcattcatgaaagactgtctagtggaagttggaaaaataaagtggggtcatgaatttgtttataaaggctatttaattataagataaattaaaaattgcctaggatttttaatgtgggtggctggtctttgatgaatgttgtctttgcaaatattcccaatgatagtagtagaagcgagtgtggatgccaccatcgcatttatgttgtgaatgggatcttcttgacacccatgttttcacagagtattgcagattctttctgcaggaaaaagggtgggaaaagcctgagctacagcactgctaatgttagcacttctttatatagacagatcctgctaaacctgcacatttttaagtcctgtatttgctatgacaataacatttttcctcccatcatagaattcaccttattaggcaaaagctgcatggtgcacacctccagagttttattttaaagctttgctactgtattagtggcaaagatcactgtaaaggaaaacagaggattctagtaagagaatgtaggtgaaccagaatggttgatgaaaatactgccagagcaagtgtgattctgtttcttcttctttttcttttttcttcttttttaatggaaccagtttgtaatgtcactgctctgattcaaacaattgtatatgtagcccatgctcagggagaaaaatctatgaggtccaagacagaaaagtcagcttacattttgcactcaaagattgtccatgctatagttatctgcccatgaaaggctatttgtaaacagaataaatcattctttatgctattggccctaaacttctcatgattttctgaatattctagactaaaagatgctgcactttcatgtctctgtgctccccgctcctccactagaattctgtctccctcccctactctttttcctctgctgcttctgccttttgaactattatttgtactttaaagcacaactcaagtgtcatctgtagcctcttctgttgacatttccccctacttcacctttggtcaactcctgtatcttgaacatgtgtctctaattctgctttttactataaactttaaataaatgctttctttcccaagtaaatttatttgactcttttcatcctctatttctagccagccatgggcaattgcctgactcccattgcaccatatacatacctctatcgctgaactattggtttataattgggaatttttctaggcacatctatcctctctattaggctatacatcccttaaatgtgtaggagctcttatttttattcccattgtgctgttagcacctagcatgtggtggactctccgtaagtggttgttaagggaagagattgttttaataactgtggtggcccaggatgtagtacagtggctggaaatggcaggagctagataaatattttctgacttcaattagcctgctttctattagaatggcacttagcaagaagtgtaatgggtatagacatacatggcagcaggtgagaaatgagaggaaggtctttcagtcattgcaagtaggcaagtagatttttaggcttagcagtctctttctgaggtctgttgaaggaacctaaaccctttggattaaaggaaatctgttataaatgtctatgaccaaggaagtagtattgattggtttaagattgcttaacttccctgagagggaaagcagcttctgtcttggctcatttgccttctgttggaaataccactctctcatcaagggtgactcgattaggagacatggaacaacaactgaggaggctgcacacccttctctgaaatcttttggcagaatctctctacctgccagctcagtgtcaatgacggacattcagttaaggcaactcttattgattttcatctgtaaaatcctttttctccacctttcagaaactattgacgagaataaaacatcaagccttatatgttatgctttgcatgggaaattgatgttagtggtcatatcccatagtcattagggttctttttcccatttcatagtctttcactacaactttaatgagaaaaaaaatttctatataattcctcctttgatatattatagccctaagagagctttgtctaagcccagcattcaatctagaagttacctaaatgactataaaatgaaatactttaaaaactcttgaaatatgctttaatatttggaaataaaatataacccatgctgtttataaggcattttggtaaatgctaagttttcattactgttcaatacattttattttacatattagggatttctagatttttttttaagttacaaaacttttaaaaggttatttatccattgtttcataataaattacgccaaaacttagtggcttaaaacagccataaccatttcttatttttcatggtttctttaggtcgggaatttgtgaaatgctcagctgagggggtcatgagattgtagtcaggtgctggctggagcaatagttacttgagtcttgactgagactggaggatctatttccaaggtagctcactcatgtggcaaataggtgctgttggcagagggtctcatttccctccatggaggcctcttattcagagagagcaatccaagataccaaggcaatgccttttatgacctagcctcaaaactcacacactatgacttttgccatattctactgattgaagcaattacaaatgttcactcaggttaggggataggagtagacagacacaactctcaagtgtcaaggaatgacagggtctaaaggaatgtcagtgttccatgcaataagaccaggcagtctggaatatatactggtgaatctgtctttagaaaatatagtctgctacaactggcaaaggagaaactgaaaactataattctggggactaaatagtaaacaagatatgtccactgttttcagagagcttgtagtataatagaaagagaagagacaaggaggaggctgatagtcattttacaggttataaccagaagaagataatcacctgggagtccagatggaagattactggatgggagagttaaaatttactttggcctttaaagcctaagttagctaatttggaatactgtcatagactcttgttcactatggatgtgggtctttaactgtgttaccataatgctgtaaaatatgcaatttttgcaaatattatttaaaaggacagctttaagaatcaagttttcctttagtttaaaacctccatcttagttttataaataaaacgttatttattgggggggggggtgtggattttgtagatttttcctgcatgtgaaggtgtgacttaagttttagaagtctaatttagatctgttgaaatgactataaatttatatggattattgcctaaaatttcagttgatattggaaagtggccaggatactttattaatggttttagaagattatgcatgtttctttttaaaatgactaaagggttcatctgaaattagttcttataccattattctaagcctattttttcctgcaaataaaatccttttgaagactaactgtattctagtgaagacaatacatattataattatttaagttaaaattttagttaaaggtagccttagaattgaaaagttttatggttagacctctttagccactttaatagtcctcactaaaaagcactgcttcctctgatggatgggaaaacaaactagagatacatagattacctgtattctcagaggccatgtagccagctcagcttgggttacttggccagtcatttgtgtgtgtgtgcgtgtgtgtgtgtgtgtatacagggtccattattattattaacagtcatatatgtaaatgaactatgactttactaattttattgaattcagatttatttaaaagaaaaataggcctcattttatttttaaagaaatgaaacatctttaccagtaaaaaaaagggagtacttggtttctgccatcatggctgactatgttttagcattaggagtgagactttccttgctgtaaataatcatatggctcaattagaacttgagagaaaaaagatgaatggcataaagtatgaggcaggtgtgtaaaaagcaaggaggggaggaatgaatacaccaaaagaccagatgggaaaagaactctacttttgatgatcaaaataatttatagaactagttctttaatgcagatatgtcagactggtattaaattctgggccagagagctagcctggaatttccaagatacagagtaaactctaactttcagaattctgcttctcccactgaatgacaagggtatttttaagtcttcagaaaattgctcaggggtttctggggtatcctgatggaaatactacaacccccataatgagggaaaatgttagttgagaattatggtagttttattaaagctaattagatcgttgacactttccaagatgtcttttggaacactgcttttcataaatttgagctgtaggggcaccagctataggaggtgttaaggaatccatgaatgcacctgctgatactggagatgtatgaattcactgttacattatgcagcatcaggcctgggaagcagaaatctgatctcaattttgcctgccttctgtgtttatgaccttgtacaggtaaacttatgcacataggggctttctaattctaacaaagaagttataaaagacatcagcctccagcatataaactgttcagtcattttaagtgaattcaactgatataaggggaatgttggagtagaagcagaatttgttttcaagttctagctctgcctcttgttaaactccattatttcaggacaaataatttaaatgttctgattttcagtttacttacttggcaattcagatagtgatagctgccttatcaatatcataggctagtgagagggtgaaataaagatataaataagagattatttctgagctgtaaaattccctgcagagtacataattattactgtactacccacaggcttgtaacgcttttgtctttatagttatttttcctatttagagatgaatgccattgaccttccgcacactttaagttgtttcctttagtagtaggtggttgagccatccacatactcttgcttggtcctcttgttttagagcaggcaacacatttcatgataagctatggccatagaggtgagatttgtctctgaacaagtcaatttgctatgtcatcaaaccatggtctagcaaaataaccaaccactcaggcatttttcactctaagaaactagtgaagagcagattatggctcatttaaaatattgagtaaatgaagttaaggaaaatgtgtcattggagctatagtatatttaagggcacttatcagtattctcagctccagtaaaaaggaatagtcttttaaataatataataaataaatacaattctggcgtgtcttattgctggaaatgtatagacaattttttggtatatgatgtccaagacaaaagactccccaaacaaggttttaacctccacaggtgccactgccaccactaacgtcactgccatcctcattagcatttatttagcccatgctacatggcatgaaccgctatacagactttccctatattatctcattaaaccttgtttaacagtataggtaccatgattatactcgcttggcatttgtaattgttgttttgctctactctatctttgtaccaagtacaacttaattgacacccacataagagaaaaccctatccaacttaaattagtaaaatattggctgagaattgctccagcctctgagtcatggtctacgtaattcattaaattactagtaagatgtttttgaaatcttgttcatgaaattattgagagctctcaggtccatggtgaaaaatttaagaggttttttcttcttagcatctctgaattaggagtagttaacagttatctaggttaaacctatctcatgcatgataatgatcatacagttacttctgaaatgccaaattattacctattagccactgcttgttcttattaaggcagaatctctgatgtaagtcattctaggaacagaagtgcaagcagaaacactgcatattattattacctatgttggatttttagtggtaacaatcaccttcaaaacttatttttatatgatttcattaattctaatcaatctattgaaattgcattaattgatttctagttttgcctcaaattttcttgtaagctagatatttttctggaaacatagcattatttagaaatcttagatctgttttaacaagttcataagtttacatggtcacttttctgtttctatagcaagagtaagttattaaaaaaactgaaataaaaattaagtataagggttacataattgtgaagtggatttacattttggacatctagtccttaattggcatgcaactgaaaggtagacaagatttttttttgcttttgtttgtttttgagacagggtctcactctgttgctcaagctggagtacagtggcatgatcatagctcttcccagccttgatctcctgggctcaagggatcctccagtctcagcctcctaagttagactagatatttaagacatggagccatataaaaatattaaagttttctatgtgttcataaaagtgtatgacttttccaggaaaaccaaattttctttaatatgcatcatggcttctttttaaacttttatgtgagtcttctttttttttggatagtaaatgtaaatatatattcattaaatttttagaaaaacataatgccatagtatcctttaatatattgttgattaaggaaattataaaaaggtcattgattttgacaatattgaccaccatttattccataatactaacacctagcattatataaaagtggctttgattttaaattatacttttaaggaaaaacattgaaactgtattttttttatttatttattatactttaagttctgagatacatgtacagaacgtgcaggttttttacagaggtatacacttgccatgttggtttgctgcacccatcaacccatcgtctacgttaggtatttctcctaatgctatccctcccctagcccccaacccctcaacaggccctggtgtgtgacgtttccttccctgtgtccatgtgttctcattgttcaactcccacttatgagcgagaacatgtggtgtttggttttctgttcctgtgttagtttgctgagccttcttttaaggccaagctttatgtagtgttacgatcagcttagaacaaggaattcattttgaaacagcaaatcattctctgtcctagtcaccttccagaattacctgtagtgccttttcaaaatacagatgccctgccccaaaccctttagagtttgattcaaaagatgctacatgaatctcagatgttcttattttttaaatgtccttatatgaatctaatgtataatcagcaatgacaatcattgaatatttttaagagactgaaaaataaagtcttccagaggggagtacaatcctagtcaaaaaaaaaaaaaaattctcgcactccatcaaaagtagattgagtaaaaaaaatttttggagactctgtattgataagcatgcccccttcagactggctgcccagtatattacactgcttttacaactttcttttcatctctcacggaatctacctatgtatatactttgatattgcgaggagaagattgtgaatatcagctgattcatttctttgccgaactaaatcaaatatagagagaaggaaaaatgcaagtatgtggatgtaaaaaggaacaagaagggggaagtgaaataggtaaaattaaatagaggtgtcaaataataccaggaagcctcccaggggacttagtgacttcagtttatgtattatcttgttattggttaactacggctgctgtttattaattcagatcatcattagagacacgtattgttgtcctactgctagacagcttaaggtgatggtggtaggagtcgtgagtcttttcaccatgactctgccaccctgcactactttaagaaaagtcaaagcatgtgaaccctgtggtacccattagtcagtccatgtggagctctctgcccttctctgccctgaccacgtcaacgtaaggttttttgcatgcacaaaggcaaagtacttttaattgaaaagtttcttatttctttagagtgagaatgtgcatactaaataataatcaaaataagtcaaatagctttgttctgtacaaatggaaatttgagaagaagacctcttagaaaatgctaaaccaaaaaaggtgcatttgatttgaataatgacagagaaacactgacctctcttttcctgggctgaactaaaaactggcaggacatgctcagccttcttagcacaagaattagattaaagtcactgcagttttttattagatggctaaggggaaaatatcatccacgctaaatctcactcttagctggtttctctatattttagtccatttacttgaaactggatcttcactctatccactctatggttagctttttgtaagtgaccattcatttagcctgtctgctgtcttaggatgggctcttcagcagtcaggcaaatgggaggagccatttgatcactacttgtcttttatatacaaatatctggtttgggcacacaatatccttcagagatatgacatcacaaaaggctattgacaataaccttcatgaaatgagatctttgccaagttgtggtatgtgcttgaccgtttccaacatccactaagatccatatgtttaatgccattggcaatacatgcttttcatcacatccactttcaagctggctgtgtaaattggagataggactccaacaattactttagaaattgttatattaaaaataagagggaaaaacctaaattccctttataaggaaaatacctagccaagctcaaatggatggatttatataaaaaaatttcaggaaaaacctatagatagaaaaaaataataattctttggtgtaaatatctgagaaatgtttcatttatctgggttgaatttgtaaaataattgctcagatagactccctggagtggctttatcacgattaggagtttagttctcagctttacagattcaagaagtcagtattatccaagttgataaggctatgaagtctgactcatgtgaaccaaatgcacaagggattcaaatataaccacgtaaactctatataataagtagaacaaataattaccatttactgagtgcctactttagtaacagttataatgaaaggttcttttcctgctgggatgtatatattagcacagaaaatcaatttggagctggacagtgatgaatttaagtctctacagaccattactagctctataactttgggttttcttatctgtcgggtgacagaattaagtcataaaattgatctaatatgtgtaaatcacaaagcacagtatctggcacatggtaggcacacagtaaaatgcctgttgtcactatcatcatcatcttcttcgtcttgttttcaccactcatcatcattaacaacatatctaacagatcctattctgtctgattcaaagcccaatctctttccatactgtcatcctcctgtaggagctgggttgactaaccagcacaatttgctctagaggaaatcctgcacaaggaatcaaattataatcagaaggcagttagtataatgtcatgagataagaggaaatcaacttaataatcttaaagtttgtggcttccaactctgggtgcttgatacatctgtctctacagtggagcagtcctgccattcagccccaataaattggttaattttggggggctgaatattctaataattttaattgtttctgtttatttctaacaacatgtggtgaaaggatgctgaacatcaggatcactgaggagcttttgtagaaatgcagaatctcagcccaatcccagagctggtaaattagaatctgcattttaaccagattcctaggggattcaaatgtacaatcaagtttgagaaacatcatttttgggggatattccttagtatctctcttaagtacctagtctcatccactatatgcatattcttactagtttcccttcaatagaataaacttatccccaagtaatcttatttccaagctgcatagctttgtactaaatcttttttttcctctccatcactatacgaaaaaaaaaattgctgtgtaaaagagactaaataaaaaaaattgtttccaggtctttgtttaaaaacgactctatcactcaagttctatatcttggcagatggcatcatttatatttaagggaaaagatagttttatattatttggttctactttttagagtttgcgtttgcatgaggtaatttttttatttttggtcatctctttgaagtctctcatttttttctcattttatttctctggtataatttctctggtatgattcctcaatcactgctgctgaaggaagtgcaatgtcaccctgacaccaaccaactggaaacctggcagtgcttttggaaattctttgtctttcagtttttcctagtagaacatggagttcatctgtgtttgcaaccacttataagtggatattaaaaagccaccagttccttcttaaatccacttagattttaaagagcattctataatcaatgagtttggtctccaagaaaacaatgttcctgtcaagacaagctttaaaactttggaagcgtctgatcagcccatactttatggagataacttctctataacctttcaagcttctacttatttactcttttctataaattagtagacctgataacatacctatctgtaaatacagttatctccagattctatctctctgttaagttaacatggcaatctgtttaaacaaactggaggtccttcttggccttcaaattcatagaactaagacacactatttaaatgtttgtgtgtatttgtgttatacatccatatatatccttacttatttagacaagattataaaaaatcatttctccagcatgtacatgaaagctttcttcaaaatttcttcatttttttcatgttctgaatcaagtctctcattattttaacagaaaatagaaagtaattttacctcatttttctaagccttgttgtttagagaggtaaaaacacatgtctaagtctacccttccgacccctccgaccccctgcaaaaattaatgactaaaccaagtgttgtaatccaggtgtcttgggttctgagccattgcaccattaaataactcacatcatagcaattggatggggaattttaaattcattaatttatcatttaagaaaaccagtgagggattacccatttgttttactaggtttttcctctctttgagcagtttcatttagaaactaagactcttttttttccatgttgtcagaagagctaaaaagaaagtattttcagctccacggatttcaacagggaggcttttaacagttatgctgcacgtatccaattagcttgtgaaatcttatctcttctaccagtaaaaagggctcaaaaagaaaacattgaaattccaaaaagagcaagagagtgtttttggcaacagggtaactcaactgaaagagagcttactagttaaaaatggtaatttgggcattttgttttcctttaaagaggtgtgtcgatatgcagaagtaggaaccaaatgtgcgtatgtacaaatgctgctgagggaacatctcttatgatgcccagggctggaatttactccttttttcttttttcacacttaacaactagctccataaaaggaattagacaagagtctttctagtgatagatactatgttttccttcttgttgcgtctgtcccccttatttttatacctttcatcctttttaaagtcctttgatttgctaatttctctattccatctaaagcaagcaaagactgcttatttttggagtagaagaacttcaaagtctctaccaattttgagatgtaaattgctcttctgtgacctaatatatgattaatacagcacaactactaacacagtgttttttggtccagtagtaaattggtattctcttaatcagaaaatgtattccctacgtaataaaatagatcttttctgttgacattcagagcactcaaagatccagtccttaatttacattgcttattacacctcagcttgacccctctgcccagccaaaccagtctacaaactgttttacagggcttccctctcctttctgattatagtgttttgctgattttatttccttttgtagaaatgtcccaactcctcctcttcccaaatcctacctgctttccagaaaccatctcagatactaattcctaagaacatcatagagccagaatattttcttatgcagttttatctaatattcctagctacaaataaactcttttatttttgcaatgtgaatattacccaaggtatttccttacctattgcaagcctagattttttaggttactatgttatttgaaaagcatgcagtcttcaggtctgactacttcatgatcgaaacatattacactttttttcgtcttccttgtagaggactgtcaagaatacaagaaattttacagcttctcttgactttttaatagccattcacctagtagacaagaacctgctatggatggagcttcatgggatcaatataaatttcatattctgaaatttagtgtaaaaatgaactttgtattacctcaggtcatggtctatagtcttgttcttctagcatctatacctttcagcacttctcacacattgggtttatattcctccaaaatcttacatagaaaaggtgttcagaaaatgatagctgacctaatttaaaattacagagtgacatgggatgacaaaagagagtgaaatgtttaaaagctgagtatttactatgaacaatagatttactctgttctttctagtggatcaagactaaagagtactagaatgtaggacatcttcaggaagaaaacaatatgtatcagaaagctacccaatcaaaatcgttttgccacactggagaaattgtggactaaactggcttaaccaaattttcttcatgggagcgtagtgtcctcagtgatttattcaaatcaacaaccatcaggaagtagtctccaagaatgaggtatatggattggagaaatgagagtaagaagaaacggagaaaaggaatgtactgttattaaattctaggtgaaggaatctcagagatttccttcatcttcataacaccagaaaaaaatcttagaaatgagatagtctctatgattctaaaagtgagattatatacctggagatttcgaagcccaaggctcgtgtttcttcagctgaaaatcactgccgtaatgcacaataaatgcctgccaataggaggcgctcataatcttttttttcattagaagcgactgtttctgaatggagtgtcttattctgttgggcttctataagaagaataccatagactaggtggcttataaacaatagaaattcatttttcacagttgaggagacttggaagtccaagatcaaggcattgacagattcagtgtctggtgaaggcccacttccttgttcataggtggcgccttgtcactgtgtcctcatatggcaggaggggtgagggaggtctctggggcctctgttataccatctcactgggaagtaggtttcaacatatgaatttggaggagaaacaaacactcagcctatagtagggagtatctcatctctttcatgtctggaaggtaaacaaaggttgaacaccatcaatttagaagatcttcatctgacagaggggctgtagggtgtagaagagttagtaattccccaaggctgtacagcttcttggttgcacagcaagaactggaatccaggtctcttggttggcagtccagtgctgtttgcttagcatcacactatccaattaatagctcctctccatcctttgactggccttacaactctcaccacctttattaaatagagggatttccaagtcagtttttgcaagaagctttaggaccatgtgtcccctatgcaccttatgctctacgacatcatctctgagagaaaaagaacgcccatgaaaaatatccatctacactaaagacatttatgtataccaaaatgtggaagcccagctaaaatgggatagcctgaataacaatcaaatatgagtttattgtttacttttttctttcttgtactaactctagcaagccagctcaagccactcagttttggagtgattgctgccttctggtgtttgccattttgatgatgagatgagtaatttcttggtaccatatgaaatatcaaggtcagagtggctggagcatcatagggcaaacaagagtgagtcactgggtgactgctatgaggctgcctcctctgtgattttgtgagccagagctccctgcttgaatgctctttccggaggggtaaagactttagaaacctatttttcttacaaaaccattgttgttgctttgttccccacaggtacttttttctttaagatgtaaacgctccctgggtgctaaatggatccatccttatttcttgcaaaagagtttggttaaattatttttatttcagagtttttcctagcgggatgagagtcctgagtggcctattcctaaggaggctggaggttgaaaataataataataaaataataatatggggttaagaaagagagagagagaaagagacagaaagagagagagagtgtgtgtgtgtgtgtatgtgtgtgtgtgtgtgtgtgtaaggaaagtttagtcccagcagcagccagtcccagccttaccctcaccatgccttataatgcatcccatcagtgaccaataggaatacaatgtgaaccataaatgtaattttaaatttttagaagccatattaaaaaataaatctaaaaaaaggtaaaattaattttaataatatattttctctaatccagtacatccaaaatattatgtcaatgtgaattaatataaaaattactaatcaggtattttacatgaggttttttttcacattaagtcttagaaatcctatgtcaatttatgcccaaagcccatgccagttcagactacctacatggccatgcgtagggactgtaatggacagtgtagttatagagtaaaaaccagctctacagtttggcatttgagatccttcttaatttgtcctataactttttaaactttgtgtgccctacaccctctatattccagccttgccagtttccttctcatttgtccgcatggtatagtttttcatttttttttatttctgcagtggcctttgcctccctttccaccatccgtgtcccaaaacatgtcccagctttggagacagcctgataagggtctataaggtccgtgattgggatttaattccaacttcattgcttaataattaggtgaccttaggcaagccatttagcctttttgaaacttacactacctatctttaaaatgatgatcatgccaggaatggtggctcatgcctatggtcccagctacttgggaggttgatcgggggaggattgcttgagcccaggagtttgagaccagcctgagcaacattagagacccatctctttaaaaaaataaaagaaaaaaaaacatgaggacaataattactctgtgtgtgtgtgagtctgagggggtggtgggacaagagagagcgagagagaaaaaactgatgtaatgaatacaaaacaaacaaaaaatatttttaaaaagacatgtagtgctgtagttatacaccctggcacataatagttaaaatgtcctcctctttctgagttactttccaagttgcttttgtgagtaacactcctattcccatctgccagcagtgccacagagcatgctgttaaatggtcagtaagcttacttaagtatctcattctttgtattctgcagtctcatcacctgcacatcttagttctaccttcaacagcccctgctcaggctttcctcctcagtcaccatcatcaacccctttcttctttctttttgccaaaatgctaacagcaaaatatacagcctctgctttttggaaatgattgactctggtaccaagtagagctgcacaggtgcccttccgtgggggctgagaactaacaagctaccactgaaaactatgcccagctcagggtgatggtacagccagttctgtcccctgctgtaagagtttcctaggcaaccagtacacattgccactggaagaaatggaagaaaagtcaaaacctgcatcatttccagttttctatacgtttgaagtgctagaaacataataaaaaacatatggataactcagcatgtgtttcagtatttcatgtcatgttggttatggcctctgtcatatctctaatggaactgctagtgaattactagtgatggtgttctataagtgaaattggttatttctaatgaagtaaggtttatcgttttttatatcagccttgtccatattttattaaatttaatcctgcatttttgtgtgtattgagcttttataaattacattctaaatttcctttttaaatatctttttgctaacatataaaagtacaattgagttctttatcttgtatccagaaaccttgctaaatcactttactaattctaatagcttctatatagattcttttgtttttcacttgtgtaatcatgtccccagcaaattttgagaattttaattctccatttccttatcactctttttacttgctttaacactgtctagaacttctgctactatgatgagtaaagtggaaatagtggactgccttttctcgtttccaaaatcaagtgaaggcttcaacatttatcactaagtataatatttcctataattccatgtagatactcttctcttcctgaagctttttaaaacattacaaatggaaatagattttgtcctatttcaaatttgctaagagggctttgaaaaatcacaaattgagatataattttatcaaatactcttcctgcatctattgagataatcacatgatttttctgcttcattttataaatatggtggtttaaatttattgatttttagttgataaaccaatcttatattcctggaataaacccaacttgttcataatgtattatatttgtatgactcattggatttcttttgcttatattttgtttaggattttttaacttatgttcgtgacagagagtttactgatgttttctttttcttgtaatgtctctgacaggtttaaggatcagggttattttagcatcttaaaatatggctctaaaggctaccattatgtctatccatccatccatcgattcactaatcacacaaatattttttgagaggcaatatagcatagtggtttaaaatagagattctagacttcctacatttgaataaaaaaacttactgtaactatatgttatctatttctgtataacaaattttcacaaacttagcaacatgaagcaacacaaagttattatttcacagtttctgtggatccagaatctggaaatcaagaatctgagccctctgcttctgggtctctcagaaaactgcaagtaaggcatcagccagggatagagtctcacctaaggtttgataaggaggtgctatgattcaaatgtgtcctctccaaaattcaggtgtttcttttttaaaaaataaaattagttccagggtacatgtgcgggatgtgcaggtttgttacatagataaacgtgtgccatggtggtttgctgcaccaatcagcctgttacctagatattacgcctggcatgccttagctatatttcccgatgctctccgccaccccctaccctcccctgacagtccctagtatgtgttgttcccttaatcaacccaaatgcccatcaatgatagactggatttttaaaaatgtggtacatacacaccacagaatactatgcagccataaaaagaaacaagatcatgtcctttgcaggaacatggatgaagctggaggccattatcatcagcaaactaacgcaggtgtttcttttctttcttttttttctttatccatgctgtctcttttcgttttttaaaaaattatactttggctgggcatggtggctcacgcctgtaatcccagcactttgggaggccgaggcaggtgtatcatgaggtcaggagttcaagaccagcctggctaacatggtgaaaccctgtctctagtaaaactacaaaaattagctgggggcggtgtaaggcgcctgtaatcccagctactcaggaggctgaggcaggaaaatcacttgaacctggctggcagaggttgcaaaaaaaaaaaatatatatatatatatatatgtactttaagttctgggatacatgtgcaaaacatgcaggtttgttacataggtatacacatgccatgcacccatcaacctgtcatctatgttacgtatttctcctaatgcagtccctcccctagcacccccacccccaacccccgacaggccccggtgtgttatgttcccctccctgtgcccatgtgttctcattgttcaactcccacccatgagtgagaacatgcggtgtttggttctctgttgtgttggtttgctgagaatgatgatttccagtttcatctatgtccctgcaaaggacatgaactcatccttttttatggctgcagagttaacgcaggtgtttctaatgtgatagattaagaggtaaggactttaagaggtgtttaggtcttgaggactcctcccacataaatgggattaggtgcccttctaaaggggcttgaaagagggagttgggtctcttttttgccccttcaccttgtatcttgtgaggacccagcattcctcccctccagaggatacagtgttcaaggtgccatcttggaagcagagagcagccctcaccagacaattgaacccaatgctgctttgatgttggaattcccaccctccagaacggtaagaaataaatttctattctttataaattacccagtctcaggtattttgttgtagaagcatgagacagactaaggagaaatctgcttctaagctcacgtgagtgttggcaggattcagtcctttgctggttgtcagactgaggacctcagctctttcatggctgtaggctagagtctaccctcagcttcttgccatgtgggcctctccatatggcagtttacttcatcaaagtcagaaggagagagagagagagagagtcagtagagtctgccagcaagacagcagttacaatattaggtaacgtaatcattgatgtaacattccattaccttttgccatactctattggttagaatcaatgtacctattctacttacattggaagagagggaattaaataaggcatgcatatcaggatgtagagataatcaggggtcatcttagagtctatctgctactgtaagttagaaagattatttaacttgtatatgcattggagtcttcttctgtgagtgaaaataataatagtacctatttatagggtcattaggaatattacataatttacataaataaaacagctagaatagtggctggcatagaggaggtactgcattactgttagatgctatgacagaatgagcatccttatctgaaatgcttgggaccagagtgttttggatttggggtttttttttttggattttggaatattcatagaagacatactggctgagcatctcatatgtgaaaatctgaaatccaaaatgttccagtgagcatttccttttagtgtcatgtcagcactcaaaaagtttcagaacttggagattttcaggtttgggattttcaaattagggatacgcagcctgttgtatgtgaagtgccatatactattcaaggtgtgagggacttaacattgagtaacaaggacaaaatcctaccctgatgctgattacaatctactggagaaaggcagaagataaacatataaatatataatatgagtgttggtggtgggggggtgttactattttatataaagtgatcagggtagttcttatcagtggcctgaaggacgtgaaggagaaagctttgtatacatcttagggataacaagagtgaagtaattaaaatgagagtgtatttactttaagaaccacatgaaagcttgctttgaaactatacattgtaacttataaatattcatggtagttattcacagatgacagtttattcccagatagctcttccatgtatgcaaaacactactctgtagaaattgttgcagaaaatttgcaaaccgacaagaggttatgctcaacagagacagtaaaaagttaatctagaatcttggattaagctgagtgatgccttgggtatttatccaaatttgggttgagttaaatccagctgcagcaaatgctactacaacaatggaccaataaaagcagttgaaaaccccttttcttttctaaactattcataattcaattaattaaacatgaaatcatcccaaagcttaatttgtttttccttctagcttacattttttacagtttatacatagttccaatcacaatacagttgtgtctctttctcttttctcagtgtttcattagagaaatatattgttaccaataattattagggattcatttttaatgattaaatctttcaccatattggtatatcaaaaatacttggtcttattctcctgagcagtttggttatttttatcttgtttgctattgaaaaaaattggatgctgttaacacttctgagataatacctttttttgtattttaaattagttttagaataaattctcaagggtgggttacttttccaaaggacattaacattttatgaagcccatttatttcaagtcacatttactagggttttgtttgttttcttgtttttctttgttgttgttttttgtttgtttgtttttgagagagttttgctcttgtagcccaggctggagtgcaagggtgcgatctcggctcactgcaacctccacctcctgcgttcaagtgattctcctgcctcagcctcccgagtagctgggattacaggcacctgccacaacgctcagctaattttgtattttttttagtggagaaaaggtttcaccatgttggccagactgtttttgaactcctgacctcaggtgatccgtctgcctgggactcccaaactgctgggagtacagtcgtgagccactgcgcctggccagtccatttttaatggtaacagaaatatcaccatcaattggtgataaaccaaatgtccatagattgtgttatttctgaatacacttaatgttataacctgttagcagttaaaaaaaaaaacacagtatttatcccttcaggcaataaacagaaatcttattctcagtagtctctatgctaactgtatgcataactggatattttatttcacgtagtagttcagagtaatctgaaacctgaatatttggacaaacaactaattctatttcttgctaccagtgtgaccttgggcagagtatacacctgctcaagttcctcagctttgttatctgtaaaataaggttaataagaatatccaccttagaggctttgtctcagttgatacatgataggagctcagtaaatgaaggccattactatcatattatgtgttcataagttatttttagatcagaacttgttgaactcaccatgaagggttaaaagtttgctggaaacattagcagcagctagtggtagcctgggctctgctagcactgctgaaaagacaacatagtagaatacaagccatgaagcgggcacctatgggtcatatctggttatgtgtgtttatcccacatggtgttttttttttctaaattcgttgctaatattgaacaattttgaaatttcacctaaaatcctgatttgttgtttttctttaaaaaaataaattgaaagataaaacaaaacctggctattttgcttatggcaactgtcagctggagcagagcagcaactgctttcattagaagaggtattggaaaggaccgcacattccccaagtgccacctgtgcttcattgcctgttgcttacaccttgcctcctttgctcatttacatgaccttgctggcttccagagaatttcaccagcacagtgactgagctcctggcctctgaaggttgagagacctgggttagactcctggctctggcctaaccacgaatgaaactccaagctagctgattgatcacttatgtcactagacattgcagagcactgagtggcacagtacatttcttaccaggctccaggatgtctcattatgagagatgctctgtttgctttagccttggcctttgggccaaagacatcctttcctctagtctgcaagaagtatgaattgagaaaattacaaggaatagtagaatgcctaaaatgctgctgcaaaaagtctgtgtgctctttctgaaaagactgaaaatggttactttgagacagtggggaatccataccaggagcactaagcttctatttttatgcctgggagagtttttgaagccattactccatgttatctagtcttaaaatgcatgattcatgcataacacagattggaaatggcagagagattgatcttatggtagaagtgtgcagttttccatagcactagccgaccatttagtagtacaagggatctgtagacctgagctaattggttctttcaggcatttgagcgctagtgttcagcttcccactgagctctgcatttttccttgtttacacattgtaattaatagaagaggagactattgtacatttacataaaacctctaacctctatgcacataatagggggcctaatgaaaacattatatattgttcttggggttgctagctaagcagattaagcagaaaaatcacagtgatgaggaatccaatagacctgagtttcagtcttggcactgctgctatgacctgtgtgatgcagggtgatttatttaaattctctgactcaattttctcatctgaaaaaaaaatgggatagcattaatgtcactcatggggggattatatgaaagaattcatattagacatttaagacatgaataagcacttagtaaatagagttaaccatggttttcccagtgtattaatgcagaatggtgagaaatttctatataatagtaaatgtaagccacagtttttgtccttatggacctaagaatatttggtagggtttatgctgaccttgaatatatttttatcttatagcacagtcatggtgagcttgactatctggctttgactctctatcccacctcttactcattctgtgacataaggcaccttactaaacttcctgtgtttaatatccttatttattaaatggggacattattactgacacatagattgtgtcaattattattgataccacataccttgtatcagttagtattgataccacataccttgtgatgtctggcacaaggtaataataacaataatgaagaggaggagaaaagctaacatttatcacatgtattctatttattagtacattatatttattacatgtagttaattgatgtactaacttttagatgtattatgtaaacctcacagttacctgtaaagttattttcattattagtcccttttatagatgaggaaacaagagcataagaagcaaaatatccaaaagatattagttgctgtggtcattatctttaataaaatgaacatctttccaattaattacaattatatttaaataatggttttaaattcccttccctcttaataattccattgcatctgtagagcttatccaactttctgtagctggacattttggttattcttatgacattcacatgaagagcaagttttgaaacttcacattttacacaagaagttgtctgcctgtttgtgttagctctgagattaattttacatccttctgttcactcgacagatttaactgaagagttgagagagtaaggctgtcaggctaacctttgagacaaggaataaaacttttggacagtgcacattggcaggcagagggctgtgttactaacagactggatgaggtaaatattttcaacctgttgaatctctaatccatttttgcacaatctatagctatgaggaaaagcacaagtgagaccatactgggctaaaataagtagactgaggcatcttatacacagactaaaactaatattcttggttgatatgctatttagaccaaagagatactgtgctgttttcactcctggctcattcttctccaccataagaggtgtgatcagccctgttgaagccctctatgtctaggctatttctaattgcactctctctctacccccaaacacttaaatattccctttccctgccttattttcctccaaagcattgacctctatttacagactacatattttacttatttattgtctaatctcccaccagtggtatagggagcctgcttactctagtttgcaaaagaaaattgctaactatttgggagttttgcgagctgattatccatagtgggagtatttacaccatggaaattggcaaatgctaccaatgagggcttttattttggagaggtggtttgccagaacaccgttgcctccccgttaagcataatctccatgaaaaaagagatttttttgtttctattttgtttatttctctatcatcctaattagaaaggtgcctttcacatagtaattaaaagttgtttgttgaaaaagtatgaaataggcctggtgcagtggctcacacctgtaatcccagcactttgggagactgaggctggcaggtcacctgaggtcaggagttcaagactgggaaaacattttaaatggtccattttcaaggcatgataaatctaagtactggcagccagcttgtggatgtaacaaatggcacagctcatgcacctaaaaggtcacaataagtgaacagaatgtagaggaggggtcagcccataaaagggaagaaagttttgttattgggaaattgaaacttaaccagggaagggggccagggtataaccttataaggggaataatgaaacttaggcgacgtccaggaagattgtaaccccatagtactcgaccaatgaggaactgggagaagaacttgtgtgctgggagataaattatctgctgtaactgccctgggtgtgcctgcctaccagacacccatcttgcaagactgctattagaagtctcactttcactgtgcctctgagtccattctttgaatttggacgggtaaatgtgtgttttttcagaaagaccagcctggccaacatggtgaaaccccatctctactaaaaatacaaaaattagctggacatggtggcacacacctgtagtcccagctactcaggaggctgaggcagaataatcagttgaacccaggaggtggaggtttcagtgagccaagatcatgccactgcactccagcctgggcaacagagcaagcctccatcttaaaaaaaaaaaaaaaaaaaaaaaaaaaaaaaaaaaaaaaaaaaaggaaatgaaaaaagtatggaataaatgcatgaggaaatgatgtaaatgagtgagtgaatgaatgaatgaatgaagaaatgaaactcaatcagtacccctcacatggaggtaaaaccagtcatcatagctgcttctcttggtgcagtgattgagtgattcacaactgggcatggagagcttagttgctaaatgagttttactagatcccagtgcagaattgagtcacagaacttggacatctagtctatagtttcaagtttctctcttcttgactcaaaactttggccttgagccaatgaaattttttctagttagatttagtaaatcaagctactcattgcttagtcattaaaatggaaaagaactaagaatatgtaaacagaaacctgaaaaaagaaaacattacatgtataccatggggaagttaagacaatttggcttgtgcttgctttcatttctccagctcagatttatatttataagtcaccctaaacaagaaggatgcctaatgttttagcttgattgtttataattgcattacatggaagtcctatcatacaacattgttgattgctgagagctgtattaccttgtgtcacaagctctgggattgccgtaaagtacctccctttctggaaggaaaagagacattcagaaataaagcatatggtcagggataaaaacagactacctaaaatataatcaagcatttatttttgttgttggtttttttctcccccgaatgttctcttcagttttttttcatgctttttgatgtcagaattggtaattagatttcaaacatcattatttgtttggcatgaccttaagaaagatgggactgagtctgaaaggacttaaaattgagaaaaaaatttcaaatttaaagagttatgaataatatagaaaagggaaaagatgaatttgtttattaacatcttagaatggaggctattcttaaagtttagataaggtgatatgagaacaacaaaaagaattttctctttcaaagtagtatctatgaaatcttctactgaatgctgaggtatagttgaaggcagagatccaatgattgagtcccatctgtgattaagtaaggttggaatttctaagggctgtctttaacctcttgaaattaatggaagataataatgctgctttgggtcaagtcctttgggcaccattatcagagtaaacatatcgtcaactttacacttattatgtgatctgtactctgtattgtaagatgcatacttctttataagcatctcattttaaaaacaacctcaaacaatgctgtggggtaagtattaatatttgtgtcagttaagatgctttaggtagaaagtgtcaaagtgcctatttaaagtgccttgaacagtaaggaaatgaattatactacacatttaaaactccattgttagtgtgggctgctggtgagaggagaacaaagctctggctccattttctcagctccatttccaactgtgtccttctccatgtgtcaactttgcttttccgtttaaccaaaagttagctgccagtgggtctagggtgccatgattcattgttcttatccagtgggagaaaggagaatccaaacatagagtataaatccttccctttagtaggcttaggtaaatttgtgtcatatgcccacacctagaccaaacaccctctctagggaaatgccttgtgctgcttgtcttagttctatgttccttgaccaattcactagcaaagcagatgggcttataatgattggctcaccaataagatctacccctggagctagtgatttgggtttacttcccctgtttcccacagttgtgtgaggatagagaagatccctgaacaacaccaaagtcttgttaggaagaatgaagtcggtgctgaatagacaatagacaaccaaatatcgctactgtcttattatcctgagtttacaggtgtggaagccaagaggttcatcaacttgtccaagatcaggcaagtagaatgaggaggagtagaagaaagagaaggagggaaaacaaaggaaaaaaagatgagggaagaggacaattagaaggcagcaaacacttatattgtactttactgtgtcaggcagtactctaagccctttatatagcaatagaaattcgcatatttaatttttacagcaagcctatgaggtaggggctattagtataattaccactttgcagttgagaaaacagaggcacacggagtttaagtaccttgcccaagtacatgtagcacatcctgtggagctgagatttgaatgctgggaaccaggaagctctagaatacctggttgtaaccactctaaacccatctcttgactgacctgtcccatatcaaagctcctcatgtaaccatgagggaaactactggcctattccagtatttcttcttcctctgagactaatcctttgatttttggacctcacatgttattcagcttgcctctacgtgaaacagcccttctgctttctctgtgctgatgaatctgtctttgattatcaactctttttaatgaatgagagcgtaattctgtgaattgtcttcaattatgcagctttcctgaaaggttgcttgtacttctttatgtttattctgctgtcttattgtaatcatcatcctatgttgattaagcaaagagcagtaaagggtaagagagcaatggcttgtaaatgaggtacattaacaaaaagaagaaataaagcaccacctgaaagatttaattctgtttgatcaagacatcaatataactgttaaatgaattctctttgaaaaaaaaaattctttttcgttttatcatccttcttcaaagaccagagatgggaatgagaaactctgtttcagagggggagctaagattgcagccagagcccaactcaaagaacaatctgaatttagaattaagtcttattctaaaattccaaatatatgttagtgtggtcagctacatgtacaagttctaccttcataaaaacaaatgttataaaattatatttatccccaaggacactaaaataaatcactcccataggagcctgagacctcagtgcttatggcagaggctgagggatgcaggcaggcagagtggcgtgggagattcggatttaaggagcctgttcttcaattgtggcttcatcactcagcagttgtgtgaacttcttggaactcagttttcttgtttgtaaaatgtttttatagggccacattctgagtttgattgttaatcaaaattgtttcacttctacaatttttactaataaaccctcacccacccacttgctccctgtcacccagctatttttatcgtgaatccctccattcttcccctggtcctctcctctctattattagactcttcctgacattatttcttttcctacccagcttccactctcagcagcagcctcattgctgttcccacttccctatttagactttctttgagggcaatggtcataactcatatttccatggaattccccgtagctcttataatgataccaactacacatgaaatagctgttgagtgatactgaagatgataaaatagtaaattaaaacagtgcacataactctgttttcatgagttctgtactatttccttttgtaaaaactaaaacaaaacaaagcaaacaaatgaaacaagaacataatcttctttataataagtattgcaagtaaaggattgtctctcgaaccttgttgttgatgtaggaaaatatcttttatgaagttgtcctaatggatgttttcattagtatgtattgaagttactaataaaaacacaggagtgcttaaagtgcatgccttaaggccttgtgaaacggctttggttgggtaatgcgatacattatgtgttatcagaaaaaaagtaatggtgctctggttgacaaatattccagatgtcaacatcacccatatataaagatgactggatattaaaacattcacacagtgtatttcttcctatttaacacagtcaatctttgtaacaaaaaagacaagtgaaaataaacagcagaacctgagatctctaaataatggttgataatgcatacgttaaggacaatatatcaaataagtaattcatttatctattttttaaatgcaagcaattttttaacccaatccattaagtgaatgctgtttacccacagtagcccattccattcctgtgatggaccaaatgtgttcttagcctttccctgggtcaggttaacagagggcacatgtgaatatgcttatcattctaagccctcatcatcttcagaatcagaccctgtgatggactcctacattggccttggttttctgaatcgaagccctcattcatgggattggccccaaacaaaccagtccttaaatcagggaccattcacagtgcccccatggggtttttagccacccagactctgaaatagtaacctgatggtttaaaatcagaaagtctctttatttcttctactatatttctttgaactgaaaaggagtagaggccaaaaagaagccacagggattatctcctagttttctttttcctctctcacatttctcccttctattctactaataggtgtctatcaagaggatatatacaaaagaggttgcactgaactttaataatctccaaaatcttcaccttcaagagtagaaagaatcatgagttaaatttctcattggtttagagtgtaaaaatgtattcttactgataataaaagttaaatttactaaaaagcagtatagatgccttgtgttcttgaaaattatatggtgtaagttgcatacacattagacctccttttccaagagaatgtttcctcttgttccattattcagatgtttcagtctttcagatcccatggtgaactgagagcaataaaatattgtctacaatatttttgttctaggaaaatcagggacttgcattaatatgagtgtgactgtttctatagcagtcatgtattactcagggttctttaaagaaacgttaaggaattggctcacacaattatggaagctgaaaattcctaagatctgcagttggcaaactggagacccaggactagtgatggtgtaattgagtctgagtccaaaggcctgagaagtaggagagctgatgatctaagttctagtccagaaaccaatgagctagaggcccaagaacagtgcatgcttcattccaagtacaaaggctggaaaagactaatgtcccagcttaagcagtcaagcaggaggaatttcctcttactcggcctttttgtgccgttcaggtatttaattgattggatcaagtccacccacattcaagagagaaatctgctctactcagcctaccaattccaatgttaatcttatccagaaacaccctcagagacacacccaaaaaatgtttgatcaattgtctaggcatcccatggcccagtcaagttgacacataaaattaatcatcacagcactcttgtattcttataataaatcatttaagggaaatcagtaagaaccacaaagtctttgtgttggagataaaaatggttacctgctttggaatattcatgttcattgcttatcaattcacctctttcttaagacctcataagaaaagaaaaaactgttgggatttacaaatagaattttataaattgtaatcataaagaggagtgtcctcacccaccaagctattgatactagtatatttaaaaaataatacatattggtcaatgtgacttttacaacaggcctatggaggtacttatatagttttaattattttacgaatgaagaactgaaggtgagagcagccaatcatctggcacaaggtcccatacagaactaataagtggctgaacaagaaatgaactgtctacaggacaagcagccccataaatgtgggaactgtgtagttccacagggcccgtggtcaagggggtctgcacttggtttaatgttctgcagtggtcctcttgaaatgttatatattttatatatatacatataaataaaaataagtttaaatatgtaaatattatatataaatatatgaaatttaaataaacttaatatatatatttaaagaaggggccctgcattttcattttccactgggcactacaaattatgtagccagtcatttttctttggctataaagtccttgcagtccatcacacctctttttagagatgaattctcccagcaggaatagttactacctgtttattgccaacccaatgatgaacccttgctgttttctgcctgtttcacttaggaaggcttggtacctgaattgatattgaaacattcatatgacaaatattcgaaaggccagcttttagctttctggctggttaagtgccacatagcaggacacaaaattatttcatgtagtttgctaactccctttagttgttatttcttttaaacatattaagttgtattttcatttctacacatggagtcatttcccttctcctccattatgttctaatatatttcattctatttggacttatctaagttgcactggttttctaaaagtgactgctgctactgatatattttattattaataataaacatttaatgttgggcatatggtatgaagtcatttttaaaattaaatccagttttttactatctaaattaagaatgtcagctttgaagttagtgggttgactgacaatgatatttttgttttttcatttatttcttaaagtgtttaacatttaatgttctaatttaagagttgaagaaatgatgtggtatatttttgaaacttacttttatcaaaccctaaaatacatttttgtttcaagccatatataagaccgttactatgagttggtgttttgaattgggacactttcttttcattagtaatgtatattcccccttttattttaaagtgttccctatagccatcacatattgccacagtttgggggcatatgtgaagacatctgatctgactctcttacttctgaggtaaagaaaccgagtccagtgagactagctcaaatagtgacagatcaaagatcagatgcaaaccccctgaatttaagtccaggactcttttattacaccacacaaatctcttttgatgcctaaaatcactaagatttctttttaaattttctgtccatgataaatatttatatagtcttgagcctcaagttaaagtttagcttaccaaaggccctatgaatatgagaatcagaaatctggagggaaatattagcttttcagtaaaagggcaacagtgtttttgaaatgttcaatgtcatgtgaggaaaaaaaaattctgtctttccaattaaattctcctaacactcaacgatgcctctagattgttttggtaactttataattctataacatattttataaaaacaaattgtctaggaaagttgtcagtaaactcatgtcaaagtaagtacactgtgaaaataatgtagttgactctgtactgtaataaggaataccaaccagcaaggtggtctggttaaaaggaagtttttttctcaccagcgttctagttttttggttgctagtggaaaataacagaaatacatttgcaataaagacaaattatgaattctgtgcaactgacagcagatctaatgagggtcctttgaaacatggtaattgattccaagttgctattgtattaatacaaaaataggtttcttcttaaatctgtctatctaggtaatgcttcagggatgcaatataattgtactgaccaggcgtataacttgtgatagccaattacaggatttttgtaggaaaagttgcctctgatgtagtttggaaacaagagttctgattaaacattccttaagaaacgagtacaaatctttttaaaagatatcttgtttttcctctttcttatgaccaattttcataacttttacagctttgcttccgttatgcaagtggccttttaatcttatgcaaagacattactcttagagaaataacttttttattccttatcctggtgccccatgccacagaataaaagcggtcagtcctggttaggaaaagaaccccacagatagaaaacctaaaaataatattcaaacaccgatcattcttttacactcctcacagtactagaattacttaactaaatttcatctctattgatcacccctaacatgccgccacagctgtacagtttccttggtattgcctgtcagccactagggggcatcctggggcaggcagacagctctaggtttgcactttcacccttctacttggtgggtgtcccatcaagtccttggccaacttagttaagctcccttattctcagtaacttctttttaaaaattgagataataatactagattagcttataagttattttccatatatagagaaataataatgctggattagctcacaaattacttcccatatacagatggattattgagtaatacataaaatgataagggaacaagaacatcttggaactaagaaatgtcactttcagtgacttttctgccagcagcccaatcggacagctgtattccatcttagatagggagatggagggctcccagaaggttgctttgactctttcaaattcttgaaattcccatctgtggaaaagtatgtttatggacccaaatgaatttcagtccactggccatatgcaaaatctggcagaatgtcatccctccctaattgcttgattctagctagagccaatgtgcttggtaagcaggaatgtttgtggtcgaggcattcagttgaataagctgaattaaaatgtttcaaaactccatacacacttcagttgatagtacagcatttaaggcagaatcatgtggaacacatccaaagtgcaaaactctgtgggaattccaccaagccacataccatggctttatatctgaaatgactaactggaatcactgggtgaggctcttggcagtgtccatttatggcccataaagttggcttcaactttacagacaggttcatattcctggaaactgcaggctgctaaatacattgatatacacattcatgacatgcgtatattcataggcactttgaaacttgtttcaaggtgacaatcaatatgtttacatacaattcaacttcaggttataaaattatcattaagcaatatgttcatgggaaagaattttggagaaaacttagtcttgactccctaggatagctttgaagataacacgagttcatgtgtacctataaatatcattgcaacactgcataatacttagtctatcaacaattttctttttcctttattattacattagtatacctaaagtccatggtggtatttactttcttaaggtgaggttaaggcttcttccttataacaacaggtaacaccaactgaagtactctagtagagggactcacatttattcaggagttgccatttgctaggcagtaagcattgattattaccacgtataattttgcctcgagggaacatttggcaatatctagagacattttcattgtcattactgttacctacagggtagaggccatggatggtgctaaacatccaacaatgcacaggaaatcactccacaacaaaaaattatccagtccaaaacatctattatataatcctatggttgaaaaaccctgcgcaaagataattggttttgatttagtcttcgtaaacatcatttgaggtggattatggtgttatcctcatttctcagaggcagaaattgtagcactgagagggggagaggctgtccaagattgtagaacttgtggaggagtgcaaatttggcttattctagaacctagtttcttcatccttgctctctaagggtagagtccgaaacagaactcttttttctgcttccagaacacattgctgccttcttagttaattactagaatgaatgattataaaacttacctcctgcagagtgagtgagttttaaaaatttgtttaaaacaacaaaagaattcacatattgtgtaactttggatttagggtaccattgaaattgatttccttagaggtgtgctagaggcaaagtttgctaatctggttggtggaagagtactggtggaatctttctttaggtttctctctatgtttaagttcctgcttgcacctgtgctagtcaatgtatttgttgaggaagatttatggttctattcttttaggagagaatattcacactttggctttgccttttgaggcttacacatattatcactaaagtacattatcatttttcatctggtggtagggaggattttaccaccttctgagttaggtggaatgctctaggcagagaaaggattagggctcatcagagccaatagggccaactttgttccgttgttttcctgccaaaaagaaataggggataatagaaactcatcagttgctatttgcaaaactgtttaatttccctgaatattttgttctcttgttgacatgagcattgactgcttttttgccatagtgggataatttattttatacgaggtggtgttttcaacaaccactatagaatgttctgaatcactgtgaactctatctggataaaaataaatgctcttattttctccaatggatatttttccttgcccatgaaagttatgactggttctgcttattcctcaaaccgattatatgaacttctgataaatgtttgaataaaatgtaagaaatattgtaaataagcaaaaatcccacagaaatcagaggaagtatgttctacctctgctcttctaagtctgaccaacagttaaataaattcttgggttctatgaacagaatttttacatgatgaattttttttttttttaattgatcattcttgggtgtttctcgcagagggggatttggcagggtcataggacaataatggagggagggtcagcagataaacaagtgaacaaaggtctctggttttcctaggcagaggaccctgcggccttccgcagtgtttgtgtccctgggtacatgagattagggagtggtgatgactcttaaggagcatgctgccttcaagcatctgtttaacaaagcacatcttgcaccgcccttaatccatttaaccctgagtggacacagcacatgtttcagagagcaccgggttgggggtaaggtcacagatccacaggatcccatggcagaagaatttttcttagtacagaacaaaatgaaaagtctcccatgtctacttctttctacacagacacggcaaccatccgatttctcaatcttttccccacctttcccccctttctattccacaaaaccgccattgtcatcatggcgcgttctcaatgagctgttgggtacacctcccagacggggtggtggctgggcagaggggctcctcacttcccagtaggggcggccgggcagaggcgcccctcacctcccggacggggcggctggccgggcggggggctgaccacccccacctccctcccggacggggcggctggccgggcggggggctgaccccccacctccctcccagacagggcggctggccgggctgggggctgacccccccacctccctcccagacggggcggctggccgggtggggggctgaccacccccacctccctcccggacggggcggctggccgggctgagggctgaccccccacctccctcccggacagggtagctgccgggcagagacactcctcacttcccagacggggtggttgccgggcggaggggctcctcacttctcaggcggggcggctgccgggcggaggggctcctcacttctcagacggggcggttgccgggcggagggtctcctcacttctcagacggggcggccgggcagagacgctcctcacctcccagacggggtcgcggggccgggcagaggcgctcctcacatcccagacagggcggcggggcagagatgctccccacatctcagacgatgggctgctgggcagagacgctcctcacttcccagatgggatggcggccgggaagaggcgctcctcacttcctagatgggatggcggccgggcagagatgttcctcactttccagactgggcagccaggcagagggactcctcaactcccagacgatgggcggccaggcagagacgctcctcacttcccagacggggtggcggccgggcagctacatgatgaattttcatctacattaaaagtcaaggtgaccaaacaaaggtggtattttaatataattaataagaagcaaaggagaccaagatcagtgccttatctacagaaatatgaatgtgatgatcattaacaccatggcaaaaagatgaaattagttgtggggtgaggcaggtggcattggctcaggactcataatcccaaagaatttcacgttttgacttctgtcatcttccaaaggagagcagtgctactatcacgtaggtatagcagcagaactaaaggaagaagacattagtcatatgacttttgtcttattgttgaaaaatactagatagtacactgtgaattactatttcatcttgaaatgatcttgagagtcacacaatcacactgtactatttgggggtatatatggtaaaaagcattacgttttaaatgttagttagaagtaaacattttgacatcccatcttggcatttcttcataaattaatatatgaagaaattcaagtacaggagtagcttccacttctcttgacctctgaggggcccaggagaaggccatcagccctggaccatatgtatagagaaatcacaggggctgagagcaggtcttctgattatttattacttcctaacaaaccactccaaaacttaccggcttctaaaaacaatcactttattatctttcacagtctgtgggctggttagacctagctagggtgagttgatgattaaagactgtcatataggggtttgaacagccaacataaatcaccaccatgtggctgatcatgaactctgcctgtgagctgggagctcagctgagggatctgacagtagaacctagacatggcctctagttgtgatgtggattttgcacagcgtggcaactgggttccaagaaagagtgccgcaagagcaagtgttttaagagggaagaatcagaaatgcctatccttttaaaagtcaggactagatctgatgcagcattaccctttccatgtcctgttgattagcaagcaacaggaaaaacctggattttaagaggcaggaggggaataaactccaactcccaatggagagagtgacaaagaatttgcagctgttttaagcccacaaagtagatagggaaatgctgaatctcactccaccttagaccaaagagtcactagcactttctacacattgcaaatattcagtaaggatttatttctcatgctttacttgtatcaattaacttgatcctcacaacaatactgtgtgaggtaggtgaaaaactggaggcatagagatatggagtcaattgcctgagtgaaataactggggtatcaatcaagggctcaaacccagaaggtcttcttccaggacccctctcttaatcactattcaagcaactctcccaacagtgattttccacacttttttgatatatataccatggattcttaaattttttttctctttaaaaattgttccttccttttgaaattcatcctcacttttataattttagcttgtcaatattagtatgacacatttgggaaacttgctttataatgctccaaattctgaggagtaactattctatctagggatgtggtctgtattttaaatatgcatgcagtttggagctagactgagagagtagtcaagagcaaaggggagtccagagactaattcctcttttgggtttctcacaggctacatggcttctcactgagatatctctcccactctttgcaagtctctgcataaccttccttgcatatgggactttaaggttgccaccacctctctccacatagtaacctgttacacttatttctcagtgtgcagcacctcattgtctaggttatttcttagatcaggtttctgaaggatggaaaatctaattattgttttattagtttgagccacactacttatagatcactgcttaacctatgttgtctgtccttagttcttatgcctgccctggttcagagaatcaaacccagaggtaaagctggggctggggttccttatgcaaagagagctgtctctttagtaggaactctggattggctcattttgctttaaagaagttatgggcaggaggagagtaactgagaaactgtaattgagatataattaaaataagataaaattgatcaaataagcagaaaaagtgggagaattgaatggctgagtagaagtaatttttcagcgttggaagagatctctgaggcatgataacgccagcagtggtgctatattctggcacattagggagaagggttttgagatgtgagtgaaggtattgaccatatcctgctaagtaatgctgtgactgattgacaatatcgtggttgaatctaaagctagatgaccctgtcagtagggaggcaatagtggggagaaacatttctgccctagaaagatttcctgtctattctaccaagttactctgtgttgctcaaagtaggataattccaggtgaccaggtcatatgaaattatatgttaaagaatttgaattttaatggcataaaatgctagattatattatgtacataacacttttatctacactgtaaaaataaaggtatttgataatatttatcagtgtttgattcttcaaggaggggcctagctgccatggctaatgcctgtaatctccgcactttagtagactgaagtgggtggatcgcttgaggccaggagtttgagatcagcctgggtttcatagtgagaccgtatctctatcaaaaaagaaaagaaaagaaaaggtgtaattaactgggcgtggtgacatgtgcctgtagttgtagccactcaggagactgaggcaggaggattacttgagaccaggcatttgaggttacggtgatcgcataactacattccagcttgggcaacagagtaaaaaactgtcactgaaaaaaaaaaagagagagaaagggatacaagttgtattggatcatttctattaatttagtacccaagtaagtaaaactaaaagaagttccttcaagagtattaaaacatgttgccctggacaatgaaaagcagttttccttagaagaaactcgttagatctttcagtgatggttagcgctgtggaccactgagtctaaccacagggagttgaatccaggcttgaccacagtctggcttttctgagttaccttcaccaaggagctccaggatgctcagctgaaaaacgggaaagtaacattcacgtggagatgttgtcagagtgaaatcgataatctgtataattctttttgcaaattatagtattttcacaagtgtggctaacaataacattttgaactgttagaagtagtttgattccagagggtatgtagtagggcgggtactggggtgaactgagtgaaacaccttgggtggaaaatttaagggggtgccaaagactcaatattcaagataaataatattttaatgcaatattttaaaaatcactacaaaataagtccatgaaaagaaaatatcaatattttaattacaggcaggatctgactctgcctcattcgcctagtttcaataaagcttattttacgaaagcaggcagccagcccatgaatcggagttgctgttttgattttttttaaatatttaaatatcatgtatcttgattactgagtattttttttttttttttttggtgccctctaaaattttgtgctctgggtgagtgcttcacttcctacattgtagtctgggctctgatgtgtaagtttttaaaagaatttaatcagagattcagaattctaaaattcagatcctagatgtagacaagacctttggggccatcatgattaaccttctatgtagttacaaatgctttctaagcaccctttttaaatgtcaaagattatagtttttccttttatagcctatgacctataaatcatacatgtacatgtggaatttttaaccttttacaggttcactaaaccttggctgctgcgtctcgagggcacttcatgaaacaagaaaacctcttacctagaggccctcgagttggactttgacttgctgtggtttagagggtccatttgcttttctgtttatgttcatttcttttatactcaaggttttttctgacctcctttgactattttctgagggcaaattttaaccatcctaaaaacaaggaacatctcaggaaattgttttctttgctgcttttcaatattgatgggattctggcagtggaaatataattaaaatcacagcagttatcaagttcctttttataataaaccttttatccctttacctaacctgctcctgcctttccttgtttcccagggttaaatggcagtgagccatttggctcaaccagctgtactttggcagggcttgctatgaatcagatgtccttttcctcctcgaaggcagaatgtgtcacttacttagactcacctcacatttcaatttgcaagtgagcatgtggcttctgtgccttctattggcagcagttgatatatcaacctaaatgatagcccttgaatgtgtaattattgcagctcttcatggcttaccttccgccactcacccattcctgaacttcatatccctctagttcattttgtgcatctttaaggtaaaatattcacccagggatcacaaagggaagagtaacccccttaaggcaatggtccccaacctttttggcaccagggactggtttcatggaagatagtttttccatgggacagggttgggtggggggatggtttcaggatgaaactgtttcatctcagatcatcagtcattaattagattctcaaaaggggtgtgcagcctagatccctcacatgcatagttgacagtagagttcgtgttcctgtgagaatctaatgctgctgctgatctgacaggaggaggagctcaggcgatgatgctcactcacctgctgctcacctcctgctgtgtggcccggttcctaacaggtcatggactgatatggggtccacgccccaggatttgaggacccctgccttaaggaaccaagaacaaaataataggtgtctagtcagacagtgggctaaagagtgaccatggcaaagcttcaggctttgagagctaactggattgttttttgtccccagaagggtatgtgtgatggttaattctatgtgtcaacttgactaggtcacagtgtgtgcccagatatttgactatacattattctgggtatccacgaaggtgtttttagataagattaacatttgaatcagtagactaagtaaagcagactgctttacgcaccagtgtgagtggctctcatctaattagttgaaggcctgtgtaaaacaaaaggctgaccctccagccagtaagagggatttccttgttcctgaagacctggagctggaacatcagtcttttgcttctttcagactagaactgaaacaacagctcttcttggttgtggagcctttcagatttcagactaaaccttagatcttcagttcctctggttctcaagccttggattcagactgcaactataccatcagcagtcctgggcctccagcttgccaactgctgttcttggaacttcctagcttccataattttattgtatataaatctctttatatacatcttatttatgtatgtataaataagatatatgtatacatatacatgtataaataagatacataaagatataagatgtgttatatattaatattatatgaaggataattttatatgttatatatgtataagagatttgttattataaggaaatggcttaggaatttcatatgatacatagcatgccgtgttaatcagtgttccccagagaaattggagaaatcttattggttctgtttctccggagaactcatgaatacagcatgctgcctgtcattgggaaattcactgcagtctaagaaacctaacaatgtgacatacaacagtagagaatatatctgatcaaagaaaaaaaataaatgcatccacaagcacatggaagattatagggaatatttgtcatttggagaatctttccggtatctgaaccccttgcctatgtttggtgaagatggtgccttataaatattaatgagaggcagagcccctttccttatgtagaagaaaaataaaatcaaaaccaaagccacattctcatcactgtttttcttagtaggtaggcatgacccctgtgacctagatttgaacaacctgaggcacatactctgaatttttgagatggagtttgtgacacagagaagtggggtcaatgcagatttttttttgatgatggttaaagtgacaacagtacacagtttctaagcacaacagcggaaatggtgacttcaggggcaaccaatatctgaatccattggtgtcagcccatggtggagagctagagcatggaatgtgggtgccgggggcagaggtctcctcattgggcaggatccacagcgtaattttggctgtaggagttctggctgcatggcttccgttcattctccccatttctcaaatctggctctccagacttcattggcaattgtgttacgtaatacgttcagtttctgtttaattagccagtcattgttggttgtttctatctaagaaccaggtctgattcatttactcatttccctaataattttttgagtacctactatataccagacactcttttggatgggaaagaaagagcaatgattaagacagacaacgtattttctcttataaagactgtatttttgtagggcaaatgaataaataaataaataaacaagaatataaacaaggaaaaatcagcttgatgtaagagcaatggagaaaataaaatagagtgatgtgatagaaagggacaggaggatgagaaacagtgttcagggaagcgttctctaaggaaataacttttacattgagacctaaatggcaagaaggagccaaccacacagataatggagagatggagtcttctgccagggtaatggtaagttcaaaggccctgaaacaggaagtcaatacaagttcaaactccagggtattttagagctcctctgattcaaacatccagacgtagaaagaaactgaagtgtaaaaatttttcaagccttctgtgaggactcttaagggattcagtaaacaaattgtaactatagtgaaaaataaaaagcagagtgcaacgtggaagtgagtgcgtttctgtttaaattgaaactcccggcacaaatgttttccctttgtttggttcttcttagttttttctgagttcatattttcctagcccagttttatctttcctgtcttttcaacagcgtgtattaggagaactggtgaactagcagcagcccctttcttcaatgactttcctcaggtgtgtaatgatgggaatgggaataaatttcagtatagttcaagtgtgtgagtcagtaaagaaatactaagatggtcaatggaccaatgagaagtttgctacatctgggaccgactactacatacgattcttctcaactataaaaatatctgtgaagtaagcaggtttaaataacttttaaaaactctaaaacagtgctgccaaatacaagtataacacaagctatgtatgtaacgttaaattttctattacctacactataaaattttttaaaaggctaaaacaaatcaggcaatattaattttaacaatatattttaaccagtatatccaaaatattattccaaaaattattagtgagttattctacattctttttaagctaggtttttaaaatctgtctatattttacatttatagcacacatggactctcaatagccacatatcaggtgctgatgctgaatagacacacgtggctagtgactaccatttggaaagagcaactttagatggaggctgatttggttacagagtgcttggagaccaggaagtgggataaatcactgcatgaatccttgtaatatcctaggtgtctgtttttgttatgtttgcttccttttccatattcactggctcctttgtaagtcctctgcatttcaccacccctctgtcaccagttctgccttttcccctcttccctgaaaagttctctaagcagggaaaagttgttaagcattttaaaactgttttttaagtttgtttgtttgtttttacagttcccttttttggtgacttacttttcatcttatccttcatttaaagaaggcatcctgaaaagcataatgaacccctcagaatcaatcccacaccctcttttgtcaaatatctccttccctccccataattaagagtttataaaaggaaccaggaagtgtttatccatgatgcttaaaacacaaaaataggaactctaggttttctttctatatggtgataaatttttctcctttctgagtcactagctgattttcagtttagggtaatattatttctacacacctacttaattttaatgtgacaaaaatgagttttgtgcagtgtttcctcctgcaaaaaatgctgcctctctatttatccaatagaccacactgattccaccatgccttttttgttttgcacatgtgattttaagaggtccactctttttctaaactatgaaaagctatataaatattggaaattatagcataagaacaatacaaatatactagtactgatatattcattaacatttatgcttaacatttatccttcctgatatttgaaagaaaacaagtaattgttaaatgaatgtgtacagggatccatgtgttccttatcttcattcacttattatgctataagtcatagattattaatcagccaaccaccttcttgatattggaagggaggcaaaatctattttctccatgatgaaaatcccaattacttggtgcaaaattaagacccaccaattatataaaggtcacacattcaattcctcacatgtctgtgggaaacatgaaaaagggtcattgcatttaccctctgccatagaagcaccacacttttgtgttgcatagtcagacaccacttaagatactggacttccttcagctacctaaggaagaatcagctaggacccacagtgtttctcaaaggttttcatgtcaagactcatgcacaaaatattttatatgctgactgtattaatgatcagagatgatgctgtataccaggcctctcctggtggtgataagggctgtcagatcaatacctgagctcctgtaacctattcacagtgtcccactggctggaaactctggcctagaaagtgtaggtgattttttactattagaagaaaaactaaagtaaatgcctgattagtggtaggaactactcttttgggagatggctcagaatattgcttcactgatggcaaattgcaaggacaactccattttaggagtgcctggcttacacccaagaagaggattgtaaaaagggtctctttatcattgatgccctcgcatctcacaaggttagccagattactatttggtggatttttctaagtgattaaaaggcaaagctactactacacacaaagcaaataattgttttgtcatggaatagcacattttagaacattggaagaatatataaaactccggtgaaccaagagatcctggaaccaaaactcagcattgggcacatctctctggatttaaattagaattcctgattgataactcaagtagaaagaagccacttctagtctcttctggacagacttcccctatgcagagtgatggatgtcaggcccagctttgtaattaagccatcagatgatttgcaaagttaaatacgtgcaaagagaaatatagcattcgagctacatatggcatgttaatgctcttattttgaaatacttaaaattttcagatctaaagttgcatttgattagatttctttaaagaaaagaaagttgattagatttctttgaagaaatctaaaatatacttttctagggaactaagatatctcctaagacttagtgtcaaaaatgtccatatatagggcatttattgagtatttactctgtgcaagatactgtttgacacttaatttactcctctacaacatccatatgaaataaattctcctcatttaaggataagactcaaagagcctcaataacttgcccaataatccatttaagtaagtaatagagccaagatgtgaactgaacccaggtctcctttttaaataaatccttttatttaactgctgtcaaactctttcccaagacagagctccccacagggaactttaaatagaatacttggcaaagatacaggaaaggaggtagaagtatgggatgatttgctgctctatacaaaccatcgaatttctttctatcccttggtttctgtaatctatgtgctttatctcatatattgacatataacaattataaaagaaaaaataaatctattttagttgaagtattttgaaagtgttctgtcattttaaattaacattactaggtagtaacaaagccatttggattcttatcccctgttaacactactccctttttaaagctatgaatgttctttgcccagatacttaacattttgttgaatttcagtgttctagaaatagtttactattctctaaaaaacattagtgcatagtgctgttagagccaagaaaactaaacagatgattggtaccattaggaacggccctgtaagcaaacgtgatgtagctcacactttctcaaatctgcatcaagagtatttcagatagttagcgtcattgtgtctaaagaaagttatcacatgcttaacaagtcccaggatatgaaaatcttccttaacttagtatttcaacaaatgcgaatactttgtgtcatggtttctacatgcatattcataaactttgtagattgataatagattatgatgaaacaataactgggacatgaatccacaggttatatgttacagaggccaaaatgtttttactgccagtgtcagaaaacaaacccagctggactgagccaatttgtcaaatctaatttgggcctgaagtggaaatatcaactacctaagtgtaatatgatggacaaaggttgatctgtgaatgcaaaagtcaatatggtaatagcatgatattttgctttggaatcaaacatacttgcttgggtggaaatccttgttttcaacacctatgtgtcctgagagcttggccaagtaatttccctgagtgaattctgtctgctaataagatcatgccaattaaatgtacttggaatgttgtagaggctctcctttcaacatcaaaacacgcataagaatcatggaggatgagggacttattaatgtcaaatgcacatttttggccatggagagcagaaatctctcctgccctttcattctctcacctctacatctatgcaacttaagcagtgctttaggaaataaatggtgagcaaggggccatccttaatgttggagaaaatggtgaacacaggactttcttactcttcttgtttctttttaagacgtgattaaggaaaaaaaatcacaaagttctcacttctgcagtatgagtaaacattttgattttgattatgaagccttcctaaaaggtgaaaaagatggtaatgagtcttatatatgttttgggaaattataatattctataaatttgccttcattaagtggagggcagttggataatgtttatttttgtgccactcatccatcattctaaatagtggtggcacatttctgacaatttactgtacagatgctccttgacttatgatgggattacatcctgataaaccaatcataaaataaagtcaagtcaagccatcctaaactggggactggctgtactttagatcctagagaaggtgacagtggaattacatgaggccttttcttcctttaacccttagaggagttacttctgtttgaaagaagtcttcacatctgcattttcaaacaatgccagacaaataccactagtcaaataaaagagatagccactgctaaaattcatcaatagaaggatctccacaccgtgaatgtagtttcttcttttatacgtacaggcgatttcaaataagtaaaccatgtactcttcagaactggattaaaaccatatcggaaatttgacccttagacatttacgtctggcacatatatgcaggaaatgaagcctttggcaaacttttactaggatccaaatatttggctcttgtagacagcagtttcctgtgcttgtgtctcatcctgcttttctggtcctgtgttttggcatgaggcaaccttgctcccataaaaggtatccgaaatatgtggagacttccctgttcctgcacacagagaatggatgtggaaaccacgtggggttcatctcataaagcatctgcataagccgtagggagatacggcaagttccacagagaactcagtgtactggaaagaaagctacacaatgggacctgaaaagactaaatagttctctcatctggcaacagagctgtcatgaagacagggtagcaagcagtgttttgcaatttaccatgctgtttgttcctttctctgtttaaggcccgtggagtgccctgttgatcaggattctacctctctgccttcctctctctgcagcgatcctctgtctctacttctccagttaggccctctggaattgtcttaatgatgttaactaccctggtggataagcacagcagcccgcagccactccagccccactgcctgctgctgcagaactcaaccaatgaaatcaatttgttgtcgacagctgttcctctccctgctcattcaagagcttatacatcattcctcccctctttctttgggaagtaaagcctggctcaggtgcagaggaaatgagtagatccgctaagatttcaaactctttttttcttcatggcataccgtcttcctcattgctgtactatcattttactagcagatgaaacccaggcgagatgaagccagagtagaactgattaatcttggcccactggagatagatagttttcactgggggcctgctgcaaatggaatccacttaggaaaaaccagtttgattgtcttgaagacccagattctctatatggaaaaagaagatgctttgaaaggaaactattatgttaactactaggcttcttggcaagaaaataagcattatgtttgtttttttttttttttttatgagacccttctgtttttatatatttctatggctgtagttcatttcagcatgtgcaacaataggtgaattctctgcttatacttattgaataaaatgtgccaagaaataaatgcactggatatgttcagatgggttatttcatgtaaccctgtattagtcagagttctctagagggaaagaactaataggaaatatgtatatgtataaaggggagtttattaagtattaactcacacgatcagaaggtcccacaatcagccgtctgcaagctgacgagcaaggaggaccagtccgagttccaaaactgaaaaacttggagttcgacgtttgagggcaggaagcatccagcgtgggagaaacatgtaggctgggaggctaggccagtctagtcttttcatgtttttctgcctgctttatattcgctggcagctgattaaatgatgcccaccgggattaagtgtgggcctcccttgcccagcccattgactcaaaggttaatctcctttggcaacaccctcacaaacatacccaggatcaatactttgcatccttcaatccaatcaagttgtcactcagtattaaccatcacaagtccaccccttgtcaatttgaacccatgcacatcccctgagatcatgcataatcttcaaatagagacaataatgtcataattacacttatcataaaacaactatcttttgtacaactggaaacacaccaatccccaacccaaatgctattacataaagttaacaatacttaaatgatgatatgaagtcaataaatattatgtcacataaaggagaaaagaaataaaatgaagatattttcttggtacaattatatacatgcaccgacatgtttttaacaaaaggaggaaatactcatgacaattacagtccttatttctgcaactcatcacgtggttgtggatggtattgagggttaccttcttctactacccattctgtattgcctttgccttcagcaagcacctcaacaggttgtgtttttatttttcctggttgagtgacctaaaccttcattcctgaagggtctgggtcatttgcagtcctgcctggattgaactgttgtagtttcccattgaccttaatcacagggcatggtaacactaagagacaccctaatggatctcttgtattccatgcatactcttccttacctccattgtggagtagtagactgatttcatcttgatagtctgggtcagtcaccccagccaacattgtaactcccttcttagcctggtgacttaaaggtaggaggagcctggcggcaatcttaactttcagttcaatggaatcattatgtctcctggtggcagctttcttccctctagaaagaactaagacctctaggccagcataatgtcatttcatgggaacaggaagcaaaaattttgctagtggttcactaggggtgatggtaagtggtgccacttccacttccaccccttgattcctggacctgtgaatcccggctatgggagaaacagtaccatatattggatgctgattcagagtatacaaggccttctggagaactttgtcccagccctgcaaagtattgttacctagttggtattgtaattgtgactaccaaaggccattccaccattctatcaatccagctccttcaggatgatggggaacatggtaagaccagtgaattccatgagcatgagcccactgccacacttctttagccgtaaagtgagtgccttggttagaggcaatgctgtatggaataccacagtggtggataaggcattccatgagtccatggatggtagtcttggcagaagcattgcatgtaggacaggcaaacccatgcctggagtaagtattccagtgaggccaaacctctgccctttccttgatggaagaggttcaatataatcaacctgccaccaggtggctggctgatcaccccaagggatggtgccatatcgagtgctcagtgttggtctctgctgctggcaaattgggcactcagcagtggccatagccaggtcagccttagtgagtggaagtccgtgttgatgaatccgtgtgtaacctccatccccgccaccatggccactttgttcatgggcccattaggcgatgacagggatggctggggaaagtggctgagtggtgtccatagaatggttcatcttatccacttgattattaaaatcctcttctgctgaggtcatccactggtgagcactcacatgggatacaatgatcttcacagtttttgaccactcagagaggtccatccacacacctcttccccagatttctttgccgccaattttccaatcatgcttcttccaagtccctgaccatccagccaaattattggctacagcccatgaatcagtatataattgcacatctggcaatttctccttatatgcaaagtgcacaaccaggtgcactgctcacagttctgcccactgggaagatttcccttcaccgctttcctcagggatgtcccagaaaggggctatgccgtagctgtctgcttttgggtggtgcctgcatatcgtgaagaaccatctgttttccaggccctagtcttgtcttcctctgtcaactgatcataggaaactccccatgaggccatcgatgcaggctgggggagagaagacagggtggcaggagtggagaccatgggcatttgagcaacttcttcatgtaacttacttctgccttcaggacctgctcgagcctgatcacatgtataagatttccgttcgatgattgaatgctgctgcgcacaacccgctttatggctagatgggtcagaaagcacccaggggcagttcaggttgtgtggtgacttgatgacccatagtctaacatttagtttccaccaaagcccagtgacaggccaagagctgtctctcaaaaggaaagtagtggccgggcacggtggctcatgtctgtaataccaacacggggaggctgaggagggtggatcatgaggtcaggagatcaagatcatcctggtctacatggtgaaaccccatctctactaaaaatgcaaaaaaattagctggcttggtgatgcgtgcctgtaatcccagctactcaagaggctgaggcaggaggatggcttgaacccaggaggtggaggttgcagtgattggagattgtgccactgcactccagcctggcaacagagagagactctgtcaaaaaaaaaaaaaaaaaaaaggagagtagttatctgcagaagatgtcagggccttgctctaaaatcctagagatctctaccgtgattcacctatgggggcctgccagaggcttcagacagcatccctatctgccactggcacctcaagcaccattggatctgttgggtcatatggcccaagtggcagagcagcttgaacagcagcttggacctgttgcagaaacttttcctgttctgaccccactcctagtgggtactcctagtaccaaaatcggtgttagtcagggttctctagagggacagaactaataggatatatatactatatatactaataggatcaatatttaataaaactcccctttacatatatatatgtgtgtgtgtatgtgtgtgtgtgtgtgtgtgtatatatatatatgtgtgtgtgtgtgtgtgtgtagtattgtattgtattaagtattaatcacacagtcacaaggtcccacaataggccatctacaagctgaggagcaaggagagccactccgagtcccaaaactgaagaacttggggtatgatattcgagggcaggaagcatccaacacaggagaaaaatgtagggctgaggggctaggtctagtcttttcatgtttttctgcctgctttatatttgctggcagctgattagatggtgcccacccagattaagggtggatctgccttcccagaccactgactcaaatgttaatctcctttggcaacaccctcacagacacacgcagaatcaatactttgcatctttcaatccaatccagttgctcattattaatcatcacaaaccctcattgcagatagtaaaacaagtatgataatttgcattgtacaaacaaggaaattaaggttttggatttaaaaaatgatttcaactactttatgtttatttatataaaataaatatgttaaatataaataaaagtttttatttaaagtgtataaatataaatatacacttgtagtcaaatatatttacattgaaatatattttatatttatatttattttaatggctacacatttatttttaaattcttttggtaaatcggatgtacacaaattttcttagtgattttcagcttttaaaagtagaatgtggtaattttacaggttaatttttttttttgagatggaatctctctctgtcacccaggctgagtgcaatacagtggtgtgatctcagcttactcacaacctccacctcccaagttcaagcgattctcctgcctcagtctcccaaggagcttgaactacaggtgtgcaccaccacgcttggctaattatttgaatttttagtagagatgaggtttcaccatgttggccaggctggtctcaaactcctgacctcaagtgatcagcctacctcggcctcccaaagtgctgggattacaggcctgagccacggcaagtggcctacaagttaattttgaatgctagataattaaatttgacagggtttaatcaactcgtttaatggtatgataaggaatgtttaggtaaggacaggaaacttacagaatgaagttacaggaagttaaaagaaaagttacataatgttaaattcacgtttctacccactgcttttggtatgtgtcaatttgtatgtgcatctgcccgtgtgtgggagaataacggataatggcagggggacgaggtggagagtaacatgaagcagagagaaaggttcctctaagactcagcatcattcctgtctgtatctgatgatgccctgcactttaggtaaagcttagcagtttctcagcaagcttcaagttgtaactttgatctcttttctgtccgtttttgctttagactctgatcaaaattacttatatttttccttcagccagaacagagcaaagcccttcacccatatgctcctcttgaatattttatgactatatttatggcaatgcgtcagtacaaagttgctattggggatcattgtgcttctgaatgaaggacatggatttaaaaccaactagaggattgtggctggaaaacacattgctttggggaggaaaagtaacggcagcactgaaataaaataaaaccatagcatgaggtataatatttagatttgatttagaattaacttattttcccacacttaaacagaaaagtgtctcattatctgatattagtatctatgaataatgtgtaattaaattgacaatatttctcttatctttcatcacattatgaaatactcccatacatggattctaccaggttaaacttaactatgaaatattttttatttaagggaccaagctgattaaaggagagagagtgagagagagagagagagagagagagagagagagaaagaaagagagaaagaattgttcagaaaattattcagaaaaatgtcaacagggcctcaggaaaaaaggaaggaaaaaacacaaaactcaaaactagctgttaatcttttcagcaacattgtgctgaaaaccacctgcccaaaaccatcctaagggcatagtgtctcacgcctggaatcccagccctttgggaagataaggcaggtagatcatgaggtcaggagttcaagatcagcctggccaacatggtgaaaacccatctctactaaagatacaaaaaattagccaagcgtggtggtgcatgcctgtaatcccagctacatgggaggctgaggcaggagaatcgcttgaacccgggaggcggaggttgcagtgagccaagattgtaccattgcactccagcctgagtgacagagcaagactctgtctcaaacaataaatatataaacaaataaaatgaaaccatcctaagggttcaagcagacattcagtttatggggaagcacaatgatgtggctggaagaaaacttactgagaaacggctgaggtagggagtgaagaagaatgtctggtgtgtcccagttcccctgtgctgattcagtggtgcatacagaccatcctgtccatttgaacagggtcttttgttaagtgtaggtggaaagaagggaagggagggatagagggagaaaggttgagacagtgaggaaataaggggctcaagcctcttggtgtttgatggagctgttactgagtaagtggcttactccatgaggcaaggtttggaatccgggccttataaagattaaaaacttggaaaagacattttgaatcttaattctgattcagatcacagcaaatctagacatttagctgaatggtgtgagaaatgttaagattgttcctaattcaaaatgacaaatatgatttgctatttcccattccaaactaaatgatacatttctctgcatcttgaagagttttttgttgctattgttatttgtttgactggttttttattgttgttatttctttctttttaaaatctttgtgttccccacataaacactaacacaagtgggaagagttataacttaagcccttattagaaagcaccttctcttaaaaaaaatgttttttttttgttttttgtttgtttgtttgtttttgtttttgacagagtctctccctgtcacccaggctggagtgcaatggcacgatcactgcaacctctgcttcccggggttcaagtcattctcctgcctcaccctcctgagtagcttggattacaggcacacaccaccacgcccagctaattttttgtatctttagtagagatggggtttcaccatgatggccagactggtctcgaactcctgacctcgtgatcagtctgcctctgcctcccaaggtgctgggattacaggtgtgagccactgcgcccagccaaaaaaagtttttaaaaaaatacttgtttcattatcctagacttgtgttgttcacattattaagagattgaatggcactttagaaaatttggggaaaaggaataaagacaatatgttcattgttctacaaaccaaaaaacccaagaatcaacttttgctgcatttctttcattagtttttttgtttctttgctgagttctgtttgttgttgctgttgttgttgttagtttgataaccaaaagacccaaacccttccacaaagggactttcagcagaaacagtgtggtagggacctgtagtaagggcatgaacgtcacatggacttgtttgtgaatattcactgtgacatgcagtgtctgtatgaccataagcaagtaacttgaactttctgagcctcgatttccttatttgaaaaagaggataacaatacccattttttagagctttgtgaagactgcagctaatgtgtgtgcagtgcccatcatgaagcctggcccctacagcaatgtgccccgtcactgacgtttcttgcctcagaatcatattcattgttttccttctccaacaaacagcaggaacattgcaaatgtggaacaaaaatggtgaaaataagaatgatgggtaggtccaaggggacaaacaggacggtgctagaaggaggagttctgaagagaggcaaaaataaccactgctggatttgtaatcttgaccaggtggtcttcgttttttcactcttcaacactgtggaataaatagtacagttaatatttcaggcttaacttttttgtcatctgagacattctgagacataagttatgctttcaaggaggtgtgtaacgagctatgaaaataaaaagctctgaattggagtcattttgggggaatgttggagtgaatagtgtaactttctctaaatctgtttagcagctcgtggtaacaatatgccaaatacataaattatgtggttacaaaaatcagctttacacccctgtaatgtctattaacatttgtattaatatcaaaatgtgtacattttagagatttactataaaatacatcaaactggatgattttttattcttgacatttacaacatcctttcaagatttttttaaaaaacaatattatgattctacactcacaccacataattcttttctgcattttatttggtttttaaataactaaaaattttaattgcttgagctgaaaaactttaactataaaagtagtttaattattcaaacaatgtaaagatttaattagcatcctgaattagaatgatgaataatggctaatattctttgagttctccttaaatggtagatattgttttaagggcttcacatgtattaactcaattattacaacaatcttataaaataacattatgactactttcattttacagatgtggcacaatggggttagtgacttgccccaggtcacacagtcagcgtgatcagtagttcaggcagtctgatctcagagcctatgtccttgtcagtatgctgcctctctgcagtagcatccgtttagtgaatacatagtatgtgccaggtcaatgctgagaactttgtgtatcaaattgtatttcatataatctaacctctttaatatctctataaagaatgactattgtactcattttacacataagtaaaaggaggcttatagaaatgaggtcatctgcttaattcttgttatttttttggtgctgctcactattctgttgccttatttggtatctttgctgtttctgatgcttctgttggggaggctcccaaaattaagccaccatcatgtatatctctttgctcatttggtcttagttatattgactttttctcctcctaagtactaatatacattcccctgaggtgaaagggctctctacagacaggacttgtaattattttataagattgctcatacaggcagaaaaggattattgatcacaatttatctaatagccagttcttgaaacatttgaaagaaagcccgaggaagttacatcagaaggcacatgagtggcaccagccaaggagaaacaaaaaaatccttcccgacacaagctacaaaaccaaaattatcccaagaaagactgcccaccgctttattagtcccaattgcattttcgagacctcatgatccaggccctatgtccattttaatattttccttagtaggtctttgggttagggggaaattagattatccatggggcctaaactggcatgctagagcttccagtgtgtgtgtgtgtgtgtgtgtgtgtgtgtgtgtctatgtgtgtgtatgtgtacacacgcacacatatacacaggcaccacaaagatttcgttgtcctcagaatttattagaactcattatatttagatcgacaccacatgagatcagaaaatgattgtattatgtataaggtgagtttaaacctttaaaaataaaaataaagaaagctttacacttgttaacttctcaagttgtgaattttattttgtatttagtggcagaagatgaaatgattccagaaaaaaattgtctttctaataaaataattcaattaatagcaaaatcctttgaaataaatcattttatcatggtgaaaattaggatgaaaactcatgatcatttacagtattcccctttttcctttggtcatagcagtattttgttacctaatttaaagtggaacattgtacctaacaattacatgttttgaagtaccagccaaatataatgaaaacttctggatcttgatcagaaacaattagatttctctcaaaatcactccttattaaagatccgaaatagtgtcatggtttgtcattacaaagatctgggtttgaaccctgtctcaaccagtttcaaactatgccaccgggacacagtaatcttgttctacataaaatagaaataaaataatctactttataggattgttacaaggaaacatgataatgcttgcaaagggcttagcacagtgccaggcagatgcaagcccacaggaacctgtgatggtgtaagaacgtggaaatgacagtgctttttcctgggctaaagagggtcacgtacatttgctgcccttccagccatgacccacacatctctgtcttaccagttctttggcagtggttttgaagaaggtcagaactcctcagaattcaaagaacagctttgtgcacggatgtgactcttagaattcaggctttcaatgaagaacactgcataaaaacatattgttagcaaattccgaaaagatagttctatttatcagattttcaaagataatgccacttggaaaaaaactagtaaacgtgtttccagttttctcattgagaatcacccctgcattgtttcccagaccccagtgattcaccaccacctttttaaataacttatcaatatttacatattatgtttcttaacatattttcacttttaaccctaaattgtttcaataatcttgtttctgtttaattattatcaccaacaagaaaccaatatcaactgacataatagaagttttaaaaagtacgtaattattcaaaagaaggtctgttcatgtcccctcacatggtcctacatgacatttattccacatttgggaaatactcaaccacagtatccttcctcactagtttcaggaacataaagttgatcacaaaagcttccccactggaatccagtattcctgctattctttaactgtagcattcagcctctttattttaaagatgaagaatatgaaagatagagggtttaataatatgcgcaagggacacacagcttgttggaggctctgtatgatatactgtggagaatgtacaagagaaaattagttaacaggtatgtaggtataaaattcaccacttctgtgattaaggtcataaaatgataaagcaaaccatagaattgtagggaatgagtaaagtgaaaaattgtagaacatagtaggaccgagtcttttatatatcattattaaacgtgagttaatgggatggatatacttcttagttcattgttttctcattttcccctatgccatttttggtatgtgattgtctcaaactgacacctctctttatatttaattaagttatatttgtattcagtatcctcatcgtgatcatgaaaaaatagagctgcactgggcactatgcccctaagtataataactatcctgtatctcttggttggatgagacttggaaaatattagccattgatttttctatctccctttcaaaggaatccccacatattcttggatatggaacatggcaaagccctatgggagacacatgttttacgttaacctccccgctccaaaagaaagcagttgtgtttgcctttctgtcttccttacccttcgcagtttctattagtaaatgtttatcgtttttattcttctatgctttccttatgctggccttctagcaactgtgagtgagataaaagaacaggagaaagctcaattaatttattcatgatttatctgcctgactttgaataagctcatgtatctcataagaatttcagagctcctccagttttttagttagccttgagattctggaactttaggtagaattgcagaactcgagagccataggtataccaaaactaaagagggagcgtcatcttcccttctagtccctaactgaataagggatgttggctgaatcatacaacactatcaatttgtagactaaaatggccaaaaataggcaattttgtataattgagcctatgggcagaggaaagaacattcattactaccctgtaactaaggtcactcaacatgggactagcaacaagtagacattggttgcctataacatacggacctaactacagatatatctagttcttggaagcccaatcttttgataaatgttaaatcacaaaatgaaataagcaaagatgagatctaagccaggcaatcaagtctcagctctggactaatgcaacgaatgaatgagaatgtagccaatagctgttgctatatgatgagtgaggctgtttaacaaatgaatgtgcaactttgtaatgtgtagccaagatgtagccccatagaaaactacagtggagggctattgaatgtggcagacacacacactaatgcaatgaatattttagggagcactattgggtaatcttgtaggctgagagggcacatcatcaagattcattaacaccactcataatccaagggaaaatttccatgcatacattatgggaaagactattgtttaggattgcagatacacatagcaggagttgctttagattgttttgggggcgaaagtaatatttttttcagtattcaaatatgtcttacgtagttatttctgataaggaagaaacatttgttaatccaataggaaaccatactagcttagttataaaaattgtatttttttcacttacttttgcaatttgatccaattgaaaaagtcatgtattgtgatttttatgacagcattctcacatttctatcctttaaatgtgttcatatatttgggacttaaagttatatgagaaataatttattttattttaaattgaaatagtcacaggtatacagcacaggtgcagtatatcagtgacaatcactgattctcaaggaagtgaagggagaaggagagggcaagcagtaaatcctgaggaatcttatgtaaaagaattgaaggaccagtgaaacaaaacaagattttagtggtaaccatggcaacctccatggataaagaagaacatgacgttttttggtcattattattattgcatttcaacatttattgactgactgcctggatgggattggggctaatcaattttttcctgggaggaaaagaataaatggagatgaggtttccctaaagggaagccaatgcattctaagagctattaatgaacttgggactgtcagatgacaaaggaacattaagttctctctgttgtacagtggagagattttttaaacttagagattatgtcatataagggacagtgccctgacatttgtgccagagacatctgacaggtgaaaaagatatatgataaaattagtgatgtggaaccaaaaaaacgccagaggttagatttaagattaatcgagttcttgttcagagagagagccaataattttttttttttttttggtgagctatcttcttgtggagtccctgggacaagatttgtctagtgtagcagcataattaaagttctgccctatcaaagaacaagtgtttagatacattctcttctgaactagtttaatgcttgttcatacccaggcacaagaacaaaactgttacaaaacaaaataaccccagaataaaagaaaatgaaaggctcctcttccattctgggatgttggggggcaggtctggaagataagcaggaaggggagtaaagtcactgtttttatgtctggcattggcttgggttgtttgccaaatggaaactgggggagacctcaggaagcttccagtcatggtggaagttgaagcgggagcaggcaatttgcatggtgaaattaggagcaagagaattgagaggtgggtgccacacacttttaaatgacatagtattagtattactatctgaatagacctccttctcttgagcaggatttcttaaatcaatcagctgggaatctgcttaaaatgaagatttttggttcagtagaatcatgtagattcaacagaatttgttgggactccagatttcttatttctagcaaactcccagttgatgcccaggatgactgtatcttaaattgtaaggcttaatcatggttgcaccacagatcacctggggtgctttgaaaattcttgctgcccagcccacgtccctaaaccagtgaaaacagcaaatccagaggtatcatctaggggctgagaaccacagtagctataggtcaaaggtgaaccacagatacattgatttggctgacaaaggtttcacaacttttcttacactaaaaacatgggaagatctcacataaaatctgtaccttcaggttgtattaggccgttcttgccttgctctaaagaaatacctgagactgggtaatttgttaaaacagaggtttaattggctcacagttctgcaggctgtgcaggaagcatagtgcaagcatttgcttctgctgaggcctcaggaagcttccaatcatggtagaagctgaagcaggagcgggcacttcacatggtaaaagtaggagtaagagagggagtggggaggtgtcacacacttttaaatgaccagatctggtaagaactcactatcacatagacagcatcaagccttgagggatcttcccccatgatccagacacctcccaccaggccccacctccagcattggggattacaattcaacatgagatttgggcaggggcaaatatccaaactatatcacaagtctttgttgaagaaacagtatttccacctggctgccatgtgctgcagctatggcactctgtgccttttatttcttgtttgtttgtttgtttgtttgttttagaaacagggtcttgttctgtcacccaggttggagggcagtggcatgattatagctcctggcagctttgaactcctggcctcaagcaattttcccacctcagcctcccaagtatttaatactatgaggcacatgtcaccatgcctagctaattttttaaaaattgttttttgtagagatgttatcttgctatgttggccaggctggtctcaaacacctggcctcaagtgatcctcctgccttggcctcctagagtgctgggattacaagagtgaggcactgtgcctggccccgataccttttagataggtcataatctctccaggtcaaccctgcctggagagacactttccccagttcctcgtttttcttcatggcaacttttcaggctctcagagccctggtaagtagatgaactgaactcgcctttttgttatctatcctccatgtctgtctcctgcacacttgctttggtgccctctccagagcatcatgtcataatgtctcctcttggatgaatgatttgtaatgtattcttcctttaagttcttgactcacacagggcaaagatactgaattgttagtttgagttatgttgcccactcattctaagatccctattgaaacactgatatggaaaaatacttgtgtaggagtcaggagctagcctgtttctgctacttactgctatattgatactgaacaagtcacttaacctctctgaatcttagttttccacatttgtaaaatcatacaatttggagattggaccaaatgtcttttgaagatgcgaagacagcatcagccaccattactcattcacttcacaagctctatttatagagtgtttgcttactctgtgccaggcacccttgagtggagaagagataatgaaaaggcaagttcagttcatctacttaccagggctctgagagctttaaaagttgtcatgaaggaaagtgaggaactggatctccacacatctctatttgcccaaacaacctgagttgtgcttgatgttcaggcatgattattaaccacaatagtttcactccaaagtgttctggtttggttaagagatccaaactctgtagttaggaaaggatggcactgtgaggtttctgtaagaaaggggactccataggatgccacagctaggtgagtcctagacgtttagcatgatgggtagtacagaggggagaaaagctgtgcctgcattgattattcacgtgttttcatgggccagttgccggccccatcccctctgctttgcaacatctcagagaagtcctgctaagcatgtcccaactccaggcagctcctccacacagggcagagtgaatttggccagacttgggggactcttcacatactttgtcagctccaacttcagcagccctaacagcacaagttctagtgattgttttctgtttctagtcctttgtttctgtcctttttcatcttgaatcttgtatgtttccaggcctctgtctaagattctgctgctgaaattctcctgcctttcctttttaagtttcttttttgttttttaaatccctggtgacccagcacttcacgggccacactcatgcctgctgctgccatctagtggaggtaccacaatgtcatgattgcctttatctgatcaaaactgggctaggttataatttacttaaaggaattattcagacactgcttctggtttgagggagggcgattgaagagtgaagatgtttttacaaagtatacagcacttgatctccattgaaataggttttttttttttttctgaaaatggattatagaagctaaccctaaaaacaccaatgtaccggttccttacttatagaagccaaataatagtggtttgaagagtgaataacccaaggatctgaaagaagaaagaataaccattcacaccctgttcaagcagagttatatttctctattcaaatcaagtgtgtgacatcttgcttctttccacatgaagaagagattttccaaaatgacaccaggttgatcagcatactcgatatgtctgacttcctagcctgacctgcagtagttacgcaatctctttctcttaataatgacttcgaaatttcacattgagaatataaattccattcttgcacttgcaattgcgtatttaaaacaacaacctaccatctttctaataatgttgaagaagagatatttgctttcttcatatctctttgtcttccttgttcctcctttttccaaaaataggcatctatcctgtctccttttccctatttctggttcattctgatgattttttttctccagatttcttcctacaaaaccttctgttcaccataaagactctcagtggttctcatctacttaagtatttcaaagggattgaatttatttttcaatttttgagaaaatttgttccttgtaatgatctcaatatattggtattcctcaatatgaataacaattgccaattaataatataaacaaagcaatatctatattatgatggctatagcattattattccaacctcctgagggtttatctggaaggctaagatgaatatttttaggacatagttcgcagaggtcactggaatatttcatcttctgtgattattttttatttaaaatatgttggccaaaagcagattttagaaataaatgaatagtagttttacttagggtaaaaatagggcataaattgaactatgatcatcatattaaattatactaccatattatgtttgctacatttggagctgtgtcatgtttaatattcctatgctgcaattgtcctgagaccatgctttccaaaaataatacaaagactcttctgtgccttttggactattatggtacctaaattgaaatatcaaattgcagatatttgagactctggcattttattgttggaaaatacctaagataaaacatactctgctccctcttaattttaacataaaagaatctgaagcccagaaagcaaactgttatccaggggtcacatagctatctttaaaccagagttgagtccagttctctttggaccattctagagtatcattcattttatttatatatacatggatatctatattaatgttatattttttccacatatatttcataaattttatcttatgaattacagatctttcaaatatgatacctttccaatattttctaaagcagtaatttgaaagaaaaattctttcaagaactttttagattttttttaaaaaaggaaaggcaactatggcgttataatcttaataggtacctgtgttaaaatgatttgaactgttgcctaaaattaactgtcttcttgcaagactgctttggagggtagcgttgattatatccatgtgatcatgtttacaacatattcctatataggtacttcttgtcatcttccatgaaacatttaaataagaataactgtggaacagttacatgacccctactaagatttgttgttattaataggtgatgaaagacccccatgtttctctaaattgatctatcttagtgtttatatttcaagggtgctttaagatgacaccatattgctttttttcctgatgcattagactagccacagtagcaaatagatccttctggtgaagtcaagaattaattccctcttttaataccccagaaagattattttccctgctattttgttctctaacagttcaattctgtattaccataaggaatgcggatatacatttttaaaattattttcctgattgattctttaatattctacttacactttaaatcttctgaacagaatacagccctccctccttcctttcctcccatctttcctttctcccttccttcttcatataccatttgtcctggcccctgctacgtatcaggtattttgttagatgctgtatttcttgagattttgaaaagattacctcatagatttgattttgtttaactctgagaactatatatcaaattcatgatcatattctgaaaattatgtgatattttattttagtctttatagtaatctcttaaggaatgtgctgaaacacaaattattaatgtttctgatcattaccctaatagattgtgcttaattaaattgttccagttgtgaagaaaatgtgtacacaactcggtaatcaatgttttgtctttcatgtaactaccactatctattaaaaaatacagctctgctactttgtatttttgcatttatacaaatgagatcaatgttgtctcataatcaagccagttgacatggtgggagagattttcttcagttttttcagttgataagagcactccagcaacaatattcccatgcactaactggaagtctgatttaatagaggagttgctgcctccacccctttcggaagccacagcagggaggcctggcttggggttcattagagtctggtacgatgacaacagactgggaagcagctgtaaatgatcagaatcaggccttggctagtttcagcttctgccaagcccagcgtggttcaaaaggctttctggattccaaagaaaacatgccagccttatacctactgatcacaggacatagacaggatatgtgtttctggatttgaggttttagaggaaatgcctgtcatttgcatctgtcttccagccatacatatgtcagcagaaaatggacactttaggtggatgtgtttttcatggcaattccgtaggctctcaattttctttaaccttcaagataaatctgcatttaaaatataatggagaagggaccatcttgtaaaggttttataaatgaacaaaaggcagctaggagcggtggctcatgcctgtaatcccagcactttgggaggccgaggcgggcggatcacttgaggtcaggagtttgagaccagcctggctaacatggtgaaaccctatctctattaaaaagtacaaaaattagccagatgtggtgatgcgcacccacctgtaactccagctactagggagcctgaggcaggagagtcgcttgaacctgggaggcagaggttgcagggagccgagatcatgcgactgtactccagcctgggcgacagagcaagactctgtctcaaaataaataaataaacaaacaagcaaacaaacaaaagacttagaggagtcagacctatactgggttagggttagatatgtacccaagcactgcattaggcaccagggaaatggagatgaatacgaatgagtcctttctataagcagtaggacaatgtttgacccatcgttgactgtctttaattaattaaaagataaaagagcattatatactatggtgatagacatgtagacaaacagattgctagagatagagagatatcactaaaatggataggtactaaatagtatgcaaggtactcaaattaacctgaaaatatagagaccttgctatccaattaagtagacaaaaatagatgcagaataccctgaattcatttccatttccaaaagacaaaaatatatgtgtgtgtctatacacacacacacacacatatacagaagtattcatatgcatgtttgtcatccatgtcaccttctgttgctgggtagattttgttttgtttcataaattctcattctgagcacgtataaaaatacaggtgatttgtgcaaggtggacttacagaaaacaggctggggagtaaagagggcaagcaggtggtctgccatatgactttcttttttttgatatttctcttttacctttgttattcttacttttcatttcttcctgtctcacttaatctcaaggtttgtctggttggttggttggtgattgtttttaaagctcacttagaatatttgcttctatgttgctattgcctgcatagtcaggtcctatgaatttcaaaatattgtttatttccccacagctattagctccaagaataaattaatttgaggatctaaaattgttttcatcagcaatccagttgcaaaggaaaagcaaagaaaacatgaaaatagggagagagatacaaaaagagaagaagggagaggcagagagggagggagagagatgaacagaatgagagagaaagaagcaaaacccacagctctacagtaccgtgtgagcaaacgctgatgctaagtcttccttgagaaattttgaaattgtggagacttgtccagcagcccctcatacactagcaaagttccaaggtgagttcttaccttgatcagcaaagacaacatgaaccatttagcacaaaatcaccaaaaggcatgtgtgctgggtaggatatatagaatatctgccacctatagaactccctcccaagttttcttttaatacataggtcaccaagctttgtaccatataaccctgtggctcaggccacaactggttgataggggattcattggcaagagccacaggctgaaggctgatctgtggcctatatgggaccttgttgcaagagctgcatccttttaggtgcttactagagccctgctagtgaaagtgtgatccacgtaccagcagcattagtattacctacaagaagctccagcttcaccccagaatcaaaatttccatttcaccaaaggtttcaggtgattaatattcacattaaattttgaggagctgtgcactctaaaactcaattggatcctcttttctgaaaagcttagatgtgcagcatgaagaatatcataaacaccaggtggtgaagaattagacatgaaaaggaaaatagtaaagatgccatgagtcaccaaaagtcatgagttaatggaatccatggagtggaacaaatatgagtaaagtcccattagctggtggacagagcacagtaagagtagagacagagagaagctaagggcacatggccttaaggagagggcaatgaagaacttctttgagaggatgacgtctagaattgatgttgagttagctgctttctaactgctagaacttctatcgcatctgaatagctttctgttttccatgcatcctcgttatgcaactgctaaaattgatgccattgattcttactgtcttgaaaacttgtggcaaattctattaactgaggtaatttaggaatatcactaatcctggcaatctcaaaaagcctcaatgagttaactcttattccctggtcttgtttctcattcttttgccaaagtttagcttcttggaaagttgaattttaatatcatttatggcttcactaaatcttgatgaagccatgaaaaagaagtatagggatttctagaatgatggagggaggggcttggcaagccctccacccaaaaataaatttcaaaaaccctccaaatatttgataaaacaaccatttcattactctggaaattggccataggcatacaaaaatttgagaaacatttattaagaaaaacggctgaaccctgggtaagggcactatgagtctatagcatttttgcctggggcttcttttattatttccaaatacttcactgtggtaagtctaccaggaaagggcatactgtgaaaaccagtactcagttgctaaagaggactggtttggtttggagcagaaagtgaaaaaaacgcatgcccctgtgcattgtcagacacaatagtgatctgggtgacaaaccaacagactagtatgctacagctagcctgacagcatggtcctggttgggacaaacaaaaggacagtagattcaccaaaaattaaacagggagatctagtgaataagacagccattgtgtgcattgagggctcatacatccctatagttcttaaagtctgtacacatgtgcaaatttgcactcacagtcagaagagactacagagctatctatacatcccttgctggacatgagactatgttccagtgcagaaacacaacagggtccagtgtgatttaaactgcctgaactttgttccctaactgacacacagatccattgggaaaagtaagagcttattggctcaacatgtttgagcacaacctctggtcaatcactggttgaccactaggctattctgacacagcaataatcactaagaagccaaattttaaaataaaaataagattttttaaaaactgagcagagacataaacaccctcatggggagagagaatgcactgacttaatctagaaaatcactgccaacaataaaatatcaaagtaaacaacctccactaacaaaactggaatccagacttgctgtactatattacctaaagggtccagttttcactaaaacaaaattcatgagacacataaagaaagaaaaatgtggcccagactaagaaaaaaagaaactgactctaagggtcccacatgttaaactttgcagacagaaactttaaattagctgctatgattctgttcaaagaactaaaagaaatcatgtttaaagaattaaagtatgacagcaatgactcattaaatagagaatatcaatatagacataaattatcaaaagaaacaaatgggagttctgtatttgagaagtataattaaatgaaatattcactagagcagctcaagagcagcttcaagatggcagagagaagaacatagatcagtagaaagtatctatcctgaaaaacagaagaagaaaagcatagaagaaaaaaaaaacagaagaaggaaaacagaaagaagaaaagaatatacaagaaaatgaagagagtctcaaagacctttagtataccatcgagcataccaatgtacacacaacagcagtcccagaaaggaagaagaaagaaaaggggtaagaaaaaaagtttgaactaaatagttataaacttcataaattagataaaagaattttaatctacacattcaagtatcttaacaaactcagagtggaatagacagaaagtcctccaaagctacatatatcataaacaaattattgaaagccaaactagccatgagaatggctacaattaaaaaaaaaaaaaaagccaggcgtggtggctcatgcctgtaatctcagcacttttggaggctgagacaggaggattgcttgaacccaggagtcaagaccagcctgggcaacatagcaagatctcgtctctacaaaaaattaaagaaaaaattaactgggtgtggtggcgtgtgcctgtgtgttctcagctcctcaagaggcagaggtgggaggattacttgagcccaggaggttgaggctgcaatgagctgagattgcaccactgcactccagcctaggtaacagagtgagatcttgtctcaaaacacaaaacaaaacaaaaacaaaagatggacaatacaattgttagagacagtgggtgaaactagaacccttatacactactactgttgtgaatataaaatgatatagcctctttgataaacagttttgcagtttcttaaataaagaacctgactatactgtccagcaattccactcctaaatatctacatgaaataaaaacatatgtccatataagaagttgaaaacaactatttatagcaacttctaataggcaaaaactggaaacaatccaggtatctatcaactagtaagtggaaaaacaaaacgtgttatgtccatacaatggagtgctatttcacaatgaaaaggaatgaatgaactacaacatagatgaacctcaaaaacattacactaagggaaagaagccagatgaaaaagattacatattatataattttatgtattggcaatatccaaagcagatacatctagacaaaaaagcagatcaatggttgcctcgggcagagaatgggagcagcaattgaatgcagtgggcatgagagatcttttctgtggtgatggagatgttcttaagctggattgttgtggttgcacaattctacaaattaactgaacataaattgtacaaatgggcaaattttattgtatgtaaaattagactgaaataaagatgttaaaaagagagagagagaaagggagggtgagctgctccctgtcagatgcaactgctttggacaatggcattgagtgaagagaaagtgtatcaatggctatacccatgggattttaatttatggaagtgacaaagtgatgacatggagagatccttgtaattgaataaagaatttatcacttacattttccaagagaaagaggcacaccacaccatgtagggccacacggggatgtgccagtttggtcaagtagccaaaaagatcccagggaaggggtaggagtttccacgggaaggacaaggtgggagaaggcaaatgactttgaattggctagtttgaataattctgagaggcagtcctcagttgtctgatacctggccctgtgttgatttagggcaggaagaatattggcttgctgggtgagaatttaagaagatagttgaaggtgtgggctctgggttggttagtttgcaaatgaaaggcatgttccctgctgaggcctttgctgtttttaataattggacagctctgagaggggcagtctatcctcagttggggggctacaaatgccagtgcaacaagaatacagaaaacatagttaatacaattggcttttgatgaatagtttcccaataaacaaatatggaacctaagacaacacagaaagaaggacaatttaaatggcataaactagaagctcctttttcctattttttagtatattttaataacaataatttgttagtttgtttctctttttttctggaagaaacaaaacaaaacaaagcaaaaaagcctgcccacatgtttttaccacatatggaaaaatatagccatttttatatgttctttttcacatttacagcatgcactactagtacgtacattgacatttggcagcaaaattaggtaaaacactctttaccagtaatggatttaatagagccttgacacatgtaccaaaacacatgtaccacatatccttgaatatgatagtcagcaatggagtatgccgcaatcaaggtttgatttttataggagagcaaagaacctcaaatctttatcattagtctttatatacttattgaaagagtttttaaactgataattttttattgctcagactaatgtgagactgaaatgtattaatatccctcttatttgcttgtgtacattatacatgcaattcattttcataaaataattatataaaataaccataactagtttaagttttcagatgttaccatctctcatgttttatttttagacaagggcataaattctactttcaggtatttgtaaaaccaacaaataaaaaaaacaaaaaacacaacttcagagattttagagtgaaagcttagggagttaaagcacacaaaaaagttgagcggcatagtccaacagatgtttaaacagatgaatgaaatgtgccttgtgaattcctaatgaatttcaaagaatactgcctggtactgacaaatgcagcagatcacccaagtggcaatagtcgctggaaaatggctggggaagaaaaggtctaccaggggcagagctcaagtcatttgtaccttagggtgtctgcttatagttttacgtctatatttctaacactcatttaagacaatgagggttgtacccagcaaacatacagattgttctttacacttgtgtcatcacatcttctaggtctacttcccctatttctaacttctttctcctccactggatgttttaactacgtcccttcatcacatttatcaaaggatgcacaatatcttgctgggagcatgaccactctttctaggtctgaatagatagaataaccaccacctcagaaaatagactgtacagcttaagacagatgttgaggcatgaagaagataaatcctcctctttacagtatggacattttctaaaaataaaaatagccaagtgaatcttgggacattatgagctaagagaacatagcacgcagtggattcttgatgcatgtcttctgaaaaagagctacatagaaaaaagttattaaaatggttggggagggagtctgaaattagatggatccctggttctagagccacaattttttttctattaatctgagaacagggtaaaataaatgggaatgtgttgcttaatggatactatgattgagtagactggttaaacttattaagagggttaagaaatgagactcttcacgtagaagaaaagagtatgagctttaaaatcagatgaaacatgctgtgcatcctggttgccccatgttgtagcttgggtgcttctagtaccctcttggagccttgggattctcctatataaaaggatttggttgtaatgattaaagatcacagatggaaagtccaatatatggctggcattcaatacgagaatctgggaaataaaaccacatgaaaggaataatgaatgatgaaaatcacagtgttcccctgccaggcctttggcttttaaataatgactcaatccgaaggaccgattttgtaaaatactagacaccagcaataggggccttttagtgatctacacgtcccaccgtgtgggtggtgagcatattatgtgttcacatagaactatgtgaatgtagacttaatcctagtgacaattgtgtgggagctataaataaaacaatgttttaaattaataacatttagtatataacttggaacagaatatgcagacacaatgcctaacagtctaatacataaatctctcataatagactgatggtattaaccatacttagtctctatattgctttatcatttggaagtctcatccatcatttctctccatcatcatgcacttcaaaacaggtattaaaacctttactttataggtaagaaaactgagttcaaatttaagggactttcctaggtgcccctgccattacctggctgagctgtaactcaaagcctggttttctgacaccaagtccagaatgcttttccccagtgcattgcaactgtcattcagagcaggtgtacctctttaaacaatgctagcaagttttgcagctggtgcctggctgctgaaattcacagccatagcagagtgtgtttttgggttacttaaccccaaggcagtgcgccttcaaatccgtatcacaggctgcaagcaacctttaatctctctgctgcccagtctagtctgctgccatcagttactgtatctgccagttcatcatgttcacagtaaagccaaaagacgaagtagcgattgaaagggggcaaactgcaccttaagaaaatggcatttttctggcattgataaaggtatcagctgccagtcagtagagagtggaaattgttccaggttaaggatcagtcagccaaaacatgcattttaaatgaatatagcagctaccctgggataaatttcagtggcagctgaaacacctgcccagaaagcaaggcaatttttaatcctgtggctcttctttatgagactgaaatttagcacttaggtggaaatatctccatagaatgaatgctaaacaagcttgaggacaatcagctgtttaaaacgtaagatcagtgcatacggtattttcatttctctttatcttcctcatctgatttttaggaattatgggatgttcagatttatggtttccatgtatgtgaagtggaaatagaaactcttcacagattctaattttctgatggttgtttttgtgaaacatcctttcagatggggaaatgtctcttacctgtgtgagcagactaagaatgtgctaaatggatctcactttaaatattaatgtcttcatttcttatttccttacatgtaataaaaatgaagttatatacaacaaagcaaacagactgttgtaagatatttcagcatgaaattgtaatatttctactttgtgtgtgccgaagaacattttaatcaccataaaaaaatttctctttcttttccagttagttatttgaaggatttgcactacaactctatttataaaaggcaggaattgtagatactttcatgataatgactagggaggagtttggtatgaaatgtaccttatgtagcccagatcctattaagttgcacagtggttggcagctctggcatgacaaattgataaacatttttggcttgtaatggcattatgtgtttgcttgtttgtttgtttgttttataacggattgatctttataagtagtgtttcatggctttaagacaatattggcctcagtttgcatttcctgaacttcaatagggcttaaccacaggtgtgaactcctggccttgacttgcacttgcctacacccagggacaccaagggacattactgacatatatatatatatatatgtcatatgacatatatatatatatggcaaaacattggaggatgccattggcctggctcttgcttgtatttttcacttcttgccccatggactttatgtgcaattacattgttttgatttattatacttggcctcttttgtttgaaatgtctacctttcttggactggttcaaagtacactggaaactatatttatgcttacttactccattcatttatccatcatgactgactgtactggatgctgtgctgggaggtgggaatagtgtggtgagcaagttaaactcatgagcatgaggtggaatgggaattccaggcacatcaacaggtaatttcattgcagtgtgatatgtgctatggtagattaggtgccaagtgccaaaggatcattgaaagtgggctgtgagtacttatttgagtgtctgagcttgctttctctcttcttggtcccgagtatgttatgcagatactgttttcattcctaggatattttcttgagattttattcttaggatcttggttgatggggcaaagataacctttaaacacaataacagactccaggagaaaagggaacagatgctaaaatataataaggtttaatctgacttgccaactacatgtgactttcaacaagtactgtaacctttctagtcatgatttatctgtaaaacaaaggcaatgatgcccttacagggtgctgggaagggttagagtttctatctgtaagttgtttttttttttttttagcatagttcctgacatatggcaagtccaaagtaattattgctctgctgtcgttgatcagtggtactatctacctgtgaaagggcaagcgtaaggataaaggcagggattttgtgttgttagtgtgcgtgtgtttgtgttttagcagacatagacgtctcccaattacacttttgtattctcttgtctaccaactgatgctgcagttttttctcgtcatcaacatgcctttaaaagtatgtcctgggtgagctaaattaatggcagctcattgattcttcctccttcccaaggtgccttgagaagggtgtgactaacatccattgagcataagcaagacatttcaagttgactttaactttgcctgtcacactgaaaaatggctcctaatgagttcttaaaagggaacagagggactgagagcacactaatctcaaggcagccttagtaattggatgtaatatcgctgtcacattctggatatgaacacatattaccgtgaagtctcaaaatgtttaatttggcttgctggaatctcaattttagactgtacttagatgagattaagcaatggttgtaaacttctttgcctgcacatagtggccactcaacttacttctgcatagactattcaatcatcactagagacctgtaagctaaattctcttatccctattactcaaatgagaataaaataatgaactgtccgcagtagctaattgacttgccagaggttgccccagtcagagttatgcgacatggaattggtagccaggccttgtcacccctggtccatgtgctttagactgtgccataattgcctttcatctctttgccagtaagctggtttgttagtcacattctatcttgtggcgtccttgttagccaacccgattgcttgaattgtgtttgtatgaggtcttatctttccccttgaagtctaactaggagagataatttttcccatggattaaattaatgtagtagtgtgatgagaacttagaatttgaaacacctagatctgctctttctcctaccttttatttattctcatagagaaaataaattttctttcatgtaaggaactagactattctgagcctatttcctgagcttggctaatatctcttttccaagggtcattaaccaggctcaaatgagatatacacacgggcaaacatctttaagttgaccaatgctatacaaatatattaaatttgtgacatccagtcttaccttcgcctttgagtgtaaatgctttatctaatggccagtatttatggtgtaggtccctatctttccacatattttacgtacatcacacacttgcttaatggtaaattcctggaagatagaaaacatgtattttaaattgtgttccatgatgatagtgagtagataatttctagcaactaaatttaatagaataattacaattatctttcgggaagcccaaaacatactaagcatttaaatatggtaagtaaatgaataaagagttttttttccaaagtagtcaacccaaagccatattttaatgaatgttctaaatcagtggttcttaaacagaggtgacctgcctcttcacaggaaacattttgcagtgtctgatgacatttttgattgttacaactgggagagaggggtgctaatgtgatctagtaggcagagccagagatgctgctaagtattccataatttacaagacaagacagtccctacaatggaattgtctaacccaaaatgttaactgttcaaaggctaagaaatcttgctctagattaaaaacattgctgctgaaactatggttcttgagccaacagtattggcctccttgacagcttattagaaatatagactcttaggttctattttagacctactacaatgagaatttgaatttaacaggaatcccatctgatttgcatatgcattaatgtttggaaagcactggatgcaaataatactgttttcttaaaagttatcttttggaatggttttagacttaccaaaaaaaaaatgtgaagaattacggaattcccatatacccacaatcagtttcccctgtaataaataccttacattatggtaattttttataattaacaaaccaatattgatacattatcattaactacagccaattcttcattcatattttattagtttttaactaatgtcttttttgtattccagattctcattgaagatagaactttatgatgtttagtgatcatatatccttaggctcttcttaggtatgacagtttctcagtcttgtttttgatgaccttgacagtattgagaagtactggttagatattttacagaaggttcttcagttaaaatttgtctccttttctcatgatgaaaccagggttatattatttttgaagagagaccacagaggtagagtaccatcttaatcatatcatgtcaaggttacatactatcaatgatgatttatcactggtgatactgactttgatcacctggcagaggcatttttgctcagtacttagttctacagcttacacttacttgttatctgattcaagttcattttactggccaatgaagggtctgtccttcagcagctaccttttgttttggaattctaaaggcctacattgttacaatcaccagatgtattatacatgtggagctgcaaattgtacatttataaatgaacagttttacagattacatggtggactttatttactctggggaaatatccagattgcagtaaaggacaaatctgattaatcaaaagagctaaaaaccacctggaaccaacaactaattgggatttttttttttaaaaaaaaagagaaaccaatccaactggtagtttcagatctgaattttgaaatatattagataggaaatcaatgtttttagtcaaataggtagttgcagagaatgtttcgcccccccttacgaacatgtcatgactttgaccttcagtgtggtagagtgattttgtagaagctggaagagaaggattacagttccttcactggatacgcatgtcttacaattagtcatatagtaggtacaattagactatggcttaatgtcttcatcagatttggataattatttctaaactgtgtactttgggtgtgttgcaaggataaaatgaaataaaagatgtgaacaagtacttatttatcttaaactctgcctcactgtagattccagccattactttttactactacttaaccaatacaagatagatcttagcttctcacccctctctggcattcctacttttgcactgttggcatttctatcttcctacagtcttctgcagcaaatggaaaactcctttcccacctaaaaacctcagcttggtattatactttaacagtagaaatatcggtggattttcaagtacagtcaaaaagtatagaagtagcattactaacgttttaaagatgtaaattccactaagcaaagaacaccctaaaattttgaccttgcaaatatgaatatccactagcagcttcttcgaggccctcaagggcaggatgttctctgagattttgaagaacccagatgccattctgaactgtttgtgtttatctgtgtaagtgacatgtcaaggtactaagattgaatggtggaaaaataagtgtctaaggatgagttagatgctagctttttatggccccataaatttttaacacaagagcttttgttgaacttgaagaattctttgttcctttaaaaatgaaatactgcaaagtagatttgagttccacaacaattttaaaattttcttttaaagtaaatatttaagaatcatgtaatcataaaattgaacttgaaactacccaggatatatgtgcagatgaatgctgaagccacggaaaattaaatggcttgtacagtcagcttcttagttactgagtcaggacaaaaataaagttcttttgacgttgagtatgatactccgttcaatctttcatgctgtgtcttatctccaaatagtgcagtttgattttttttttaagtaaaatcctataaaaaatatatacctttatctgggtatagtataagtacagacagtcccaaacttacaatggcttgacttacaatttttcaactttacaattgtgcagaagagatgcacattcagtacatccctggacttatgatagggttacattctcgaagagcatttgtaattatatctttggaaaaattttaacactagaattttttcagatcgaaaaatttaaaaatcacaattcttttgtcttgggaactattaaaattagggaaaaactacataaagatttcaagagactacatgagcagatacagtgtcagatctacttcaatattagcatgcataaagcaacatattttgaaggaaatatatcaaaattcaattatggtatatacaccctgcaactgatttcaacatctgaactagagtttgtgatcattataaattctgtcatggtaactttagtgtagggtgttgctacaagccagaaggtcaaatcatcatcgtgtttgtcaatccaatgcttccgccatggtgaaatgctattgcatttttctgcttaaaaaatctttgtggagaaacttctccaggaaaggtagagggtgcttaaagaagttacgagagagcaactaaaacagccaagaaggcaaaaatttcatgtaaacaattttcttatctttatttgaaatgaatggaaccaataagaggatatgttgaagcctataaaatcaggaaaagaatgggtacaataaatgtggactttaaacattaaaatcttttgaagtttaaaagagataaacatgggacaaatgaaagccaacattggttctaatagtaattctttgtaactttatccttgagtgcctgggtccttccaaactctcaacctctgtaagtgcactttcacttgtatgttctattttggtgttggatggtgaccatgatgggcagtttattgaaaaaaaagtatcaacttaacactgaaggcctaagagccagttttttattcttacttagaccatctcaattttatgtttagtcagttttgctcttgttctctctgataggtgtattgtgaacttatcaaagagaaactaaagcatggaagaagagaatgtcattgtcagctaatctaaaacttttttccattttgtaacttcctttttcttaatcaatttgcacctttatttttagccacactttttatatgatacttgtttcaaaattctattgacattcctcccctagcatcaagtcctgaatgcttatattctcatttttcactggctgccctgatggcaaggcagatgcttagtccaccatggagaggtgggagtgactttgccctcctgtgcactgatcctcattcttctaggtggagtggctagaatccacacagaagttgagaacggagacctgagttttagttctggttctgttctaccagaaattttgttctcttttatcctaccaagttattgaacttctaagaatcaattttgctcatttataaaattaagcattgatcattataaccttgagtgtctatttcaactctaaatttgatgactctaaaggaattgttctcctgagtcatattacaccactctcatctgtcttcagccaaaatgtattattttgcctctcatagtttcttctttttcactttacatactcagaattctgattcttgcctctaagctatttctttcacatttcggcatctgtccctttactgaattcatagaagtgcatttgaagttagttttctaactttaatattcttccaagtttaagttatccggagttatttatagcaaaaatgtgggaagttttacttttttgtcactttttaccaggaaaaaaaaaaccctgcatatttgctcactaaagttcactttttacattttgtgattattgtgaaatagaaagtattcactaatcaatcacttaaagttggagcaccttgtctaaaatcaaacttttcctggaagttccagtttttgaaacaattcttatttaagtgctgtatctttgtcaattctaaaacattaaatatttttaatactaacttactcaaaattttggttttaatttttttaaagcaaatcaaattctatttagaatttgtctaatttaatcatttagctaatttatgatggcagttctgtttcaaaattagtactataatagttttttagtgactctatcctacctccctcatttgtaatagattcagatatggctacaacataaatgacaatttttcagcatatctctgttcttatacaacaaatgtgactgaatttatcaatgacagttaagatgagtgaagaagagtgtataatctgaagatacatttttaatggatttactcagtatagtcattgtacttataggtggcctagacatgtggattaaaataaatgaggctaatctatgaattttagaaaaaatacattcctttcactaattgaggggagtgaaaaagcatgtcttcatttattgacaaacttctattcaactaaaagcatttactttaatagaaaaagtgtcattggtccacaaccaaaaccaaaaatttctctttatgctgtagcatagccaacctcttagtggcctagaacaagtcattatctctaacagttctgtgggttacctggattcgggtgtttcttgtgtgggatctttcctgtggtttcagtcagatggcaactaggcatagagttacctggatacttagacagaaagcagaagctgccaggccagcaccatttccattgtattctattggtcaaagccgttgtagtgcctgagcagatttaaggatgttgagaagtacctcttgaaggggacattgtttaagagcatgcagcatgagatatattgttatgggatctttagcgaatacagcttattgtgatagttttaaaggaataccctaccatattccttaatgctggggttggcaaagtacagtctgcaggccaaatctggctctcagcctatttttgtaaataaaattttattagaatatagccatgcttacatatttatatgttgtctattgctgctttcacaatacagtggcagagttgagtagctgtagcagataccatatggcctgcaaaactttaaaatatttactctctggccctttacagaaaagatttgccaacctctgtaaaaaagttttaaagactgttagtcatctgaaggcgtgcattaataattacattaatttaaattcttattggctgtattcatgaattttttctattgtttttttcttcaggcagaatgtatcaactctaatagcttccatgacttctctgataaagataatttcagggaaagtaaacttgtttttttcttcaaaatagaagctttcccttcagccctcactcctgatccacaaatgtggactttattgttttatgaggttactctgttttgtcagatattacataggttatagtggtcttcaaacctaagcttgtcagcaagtggacataatttggggaactttaagagctacagaagtcagtatcccaccctgtagaaatcctggtttacataacctggcctgggtaacagacatcagtacttacaaatctgtagtgtgcctggagaagaacacttgataactgttgcacatcttgaagtcttgttaaatcaacaataaagcaacccatcttctgtaaattaataaaaatacattcatctcttgcaaagaagtgactcgaattttatctgaaaatagacataatgcgctcattgccttctagaaaaacactgttttcttaggtgaacacaaagtgtctttaggggaaaaaaaatgctttcttacataaagaaccatgatcagaggaggaaaaaagagagtacaggaaaaaaaatatggcaatattatcaaggaagtgtaattattataccagctgtatattacagtaactagaaatatctagtatgaaaaaaggccttgaaatgggcagggtctgggaaacagtgagggcatttgcatggaggactctggaaagaaaagccaacagagaattgcacctcatcattttgcaggaggcagaggctgctgcagtgtttgtgtgttggaggtggaggaatggagaatgaaatgatagccacggcctaaggcaaaggtcagaacttgaagaaaaaactgaaatatgtgttgcctccctaaccagttccatcttctagatgaaattccatatggaacgggtatacagatttaaagctacaatcaagtaagttcaaatgaagtggttcagtccaagttcaatgagactacaatatataaagaatctgcctttatcttaggatggtaaaagaagacaaagcaagctcatttctaaaaggcagcatcttgaatactttctgcaactgtaatgtcaggcataccaatttgatatcttagatataatttctgattgtaatagtaatttcatttttaattaggctgaaagcttcagctgctggtaggcatgaagtgtattttctcccaaagtcatgcttctataatgcattatttgtagagtaacagcaattttgtttttgtttcacaaaacaaaatacaaagtttgcctttttccaccccaaagaacttcaaaactaatggagatattacataagtcaactaattgagaaaggtatgatattttgaagaactgagcgggcggaatcttgggactgggttaaaaaaatagtcttcattgttgaaataaggaatgattcttcacagggacaatggttagagagtaagagggatgttacagtgctgttcagcagagctttctggaagaatggaaatgttctacactagtgctgtcgccactagccacatgtaacatttgagcacttgatatgtggttagtgcaagtgagatgaatttttcattttatttatttttaattaattcacatttaaatagccccatgtggcaactgactaccatataggagagcacaacataaaggaaacaaagtgttcttggaactgaaaatgaggagatggaaaccaattgttgttcatcattataataataattcataaaacagagtatgtttctaatttaaagctttatcgtaatcatcacaggtgaaaatggacatctttgtgttcctagttactcattttaataaagtgtttgtggaaattatgttaataaaagttagcctttgatcattataaatatagcctatcaaaactacaattattacattatcaaggaaaccatttttccatactttagtttacaaaacttggtataatatgccacatatcagctttaggttaaatataacaacaacaacaacaacgaacagtgaagcagatttagtcacaagggacacctcatcaagtagttaatttgtagaaaaatttcattttttcaatttgaatgaacagatggcctattcattaaaattcaaaagtagataattacttgattccagtatttttagaaaaaggacattttataacattgtgttgggggaagactcataggtcttaaaatgtcttgtgtgactggacacatcattctccactgtctacaactgcctgccgtgctaactgaataagtaggttaaaaatagccttgcagctcttcttcaacactaaaacactcacttaaaaaaaaaaactgctcatctctctgaagaaatatcttcgcattaacctctaaaccctgctcaaacattcaatcagcaaacgtttatctatcactttttgtgctggatgcttgaaagtgggggtatgcatttgaaaagattgcccttgcccttaagaagtagagttcaatggtgaatgttcattaatccaacggtcctgaattttcttcactttagtgatattctgcaacttttttctcatttaagtagttcaataaaggtggatacttagtaattcgttacagaatattcatatgatgaataattctgtatgaataaatctgctattgaaagtcagtgtaatgacgtacatcctagaattaccttaccacccaaagcttttcttttctttccttcttttcttttaactagaagtgttcctcctgttcctagatacataaaatgagagaagtaacatgtttgcctaatttctttggttgctgggaagctcagagtgtgtgtttttactctggctttcctgatctaggaattcttgatctatttcttcttcaacctttacttcctagttcttgattatctctctatagggttttactgtaattcatcccaaacctttttgggaataagtttataaacttttcttcaatttctaaaatgtgttcatttccacaaagcattttaaggtttctgaaaattgttttacaatttaagaatataaagttttcatctgcctcaagaaccaaattatgtaaaggaaagttgccaccttgaattttaaatcaaaggaaaacaacggtccttgctaattagatgtgatcttcatcctttcgttcaggttctgcttttctaaaatatagttttctcatcacacacttcctccattttggccttacactttgagaaggatggcccctgccgtaggcattttcttaggtccatgttgactatcttatggttgaatacagaaaagtaagaaatagctatgtatgtacattcctaaactacctgctctcagcagccatttctcatctgagagacaaaccttttcctaaatcatacaaagacccacccatgataaagagaaaagccttgtccatgttacagtaaagtagtacacatctgcaagcctctttctagaactcttggcaccagttgtttcagaattcatgttttcagattttttaaaagtaatgtagcacatatactgtgtgttttataataccgccaattgagtctgtcacatcacctatagccaaacacattaacctttctgcaaagtctgtaagtggtcatttaggtcaaataaataaaggccataagtagtctcatattcatttagatcagtttttgaagccaaatgagaaaacacctttgggatttagagagcataccagggattgcaaatctaatggtaactgatacatcactctcagccccaccccagtgctgcaactctcccagtgactgtatattcagctgaccaacacaaggaagccctttgggctctgcacatgaacaatcccatgaagaactattagcaagatttagcattcttgcgagtttagctctgaccagtcttcagtagatatataagaaagagttctaatggccaacacaaaaaccaagataatcagaaatattacactaaactgctatttttgatgtcttaacttaaaacctcccactgctacattgcatcctatttccttaactttaactctcttctattattccacaatacattcacccaccatttccatttctctccacctcttcctcttcatctgcagtttctatgacattcatattccatctaccacataccaccatttccataactagacataataatgcacagggcttgaatttttgcctaattctcttctgcaggaagtcataactaacccagttccttcctataattactctggattacttagctgcaacatgcctgggtggaattgcaaaaggctgtaatatgtctagttagaatattccagtgaatgttcccttatcatctagcacatgaccataaaactcaaaattacaaatggcttctcattaatatgtatatgtaatcattgttcaactcagtatctaatatttttgagggaattatatctttgcattggtcacaaaaatatgtttcttgcttatcaaaagcatagaattagcctgggtaacatagtgagaccccatctccacacacacacatacacacactcacaaatacaaaaattaccacacatggtggtgcttgcctgtaatcctagcgactcaggaggctgaggtgggagaatcacttgagtccaggaggttgaggctgcagtgaatcctgatcatgccactgaactccattctgggcaatagagcaagaccctgtttcaagaaaaaacaaaacaaaaaaagaaaataaacaaaaaaactttcatcaagttgacattcatgttttcccatcaagtagggatttttgtttattctgtggtctgtgcctctaaatatatccacatcttaccacagatgtggatcatctctaaagggtttaatctatccctgcttttaattcattctgacacagtcatgataaccacatgaagtgtattactttcccttgaaattcaaacaggttatttctgaggattgtgactgcattttctacctgtagagctgaagaggctgatccttattcatttattcaactactaccagcttgtaatattttttcaatagcaaacaacaaacgaacaacaagcaaaaacagatctgtttctgtgccattatcttcttggtgcactgaaagcatgtccctgtttgatatataccaatgatttttttaaaaaagatagaaatcttgggaggtctggacacaggtggtgtaggactcatggcagatttatttgccttacataagtcttaattttcaagcttcctggataccttaattgtgactgtcagtgttgcactggttcgtatatagaaacacattgttccacctgctacttacatttatttgaaagtaaattcacagtgatgaggaatttatgaaaagtatattttgtttattttgatgttataaaaagttacacatgtaaaactgatttattaaaacatgctatgtgtccaaaaataaagaccaaaatgacattgcagaaagaaaaatatgaatatagaaatctctataaatgaatttttaagctacctcacctaatataaatagccatgatgcattggtttctatttggtgtaatatttcccaggacttgttttagttttttcacctacccaaaacctgctcattttagcaaatggattttagttgtgtcaaacttgcatattattcaacatgaggttaaatggtccagtgctaaaaataaaataaataaaaaataaataaataaaaatagttcagttcctttcgtgtttactcatttttacaggatggtattagcacagaaaaggtctgatttcactgttctttgtaatgaataaaatacgtgggaaatgtgaagaacttatgtaagcccttttgtcttggtctcactgaagagctttaattttattcttactttataatcctggagatgtcaactggccccatgacacttttcatggactttatactttatagagaccaaggacttcaaagtctgttaggataacattaaaaataaaggcccaaggctagcaaacttcaacattactatttcctgtgctgctacggtgatgtacagagaagcatgttttcttagcattcaagcataatttaaaaccactctgcactaacaccggagttttcttataatattatttggatatatttttatatcccaatttttatgaaaaagccatctcttagatggaagcacaactttagtttaacttctatttcataatttttgtgactaaaatacaatatttttgctttttatctgttgataatctttacctgtctggaagtagaatgcaaattccttttttaatttacttttctgaagtctgggcatagttaggatttatgaaagaaaaaagaaatcagatgctcagatgaaaacttcttatttgtttttgatgcgaatcagtgaataaactaaaaatctggaaacacagaaaaagagctatgggcattaataccatttagagatatttaaattcaaaagataaatgatttaggacatgtttggaagggacatattattcatagatggtctcaattcattaggaataatattttttataggaattagattcctaaattaatttattgctgctcaagactgtgtagaactccacatccttttatatattttaaacctattaggtttctttataaaaagttcttcagtaatagaagaatggttaacataaacgtgttaagaaacaaaattttttttaaagattcaagataaagtttatattttatagtttccatttaagaagtatatctagtttatgttttcatttttctaagcagtgtatataatgttttcatcttttataattggatttgtgctgacagagccaaacatttcccctgttcctcctatgaccaaagacatattagtaactctaaggtaagaggcaaaccgtacggccagggagccaattaaagttagctggcaagtaatgagatggaattcatgatgttggacttctaacaagtgctccagccaactaacttacatgcttttaaagaattcgactttgtcttctctctcttaggcaaattctgggccatcatttcagttcattagaagagaacaaacccagagaatatatatggaaaatctaaagaaaatacaaactaataaacagttgcagctataaaaatctttcaactttttggcagagttttatccatgttggaagggatgagatacttagactgacctaagagtgctttgtgaagaagctgagttggcagtggtgtagagaaggaaggctggaacttgaatgagtggagagaagaaacaccttgtcttaacaaaaattaaaaaaaaaaaaagatgcccctcattgtggcaaaagcattatagaagtctaagagaatggcaaattcaatgatgaataaagttaaacattttgtgtaaaatattagaagtgtattcagctaactaggggttattaatcttttttgtgctagggacccctttggaagtctgctgtgtatggacctcatttcagaatatttttaagtgcataaaatacactactttcgactaccaaaacaactatttatattgagaatcaataactaaaataatataaaataaatttgtgatttactaataggtgttatttctatttaacacattaaataataagacctaacagtatgtctaataactaccatgagtttaagggagtgatgagactaagcaatgtttaaagctatttgcaacaattgtcatacagtaagtaaactttttttttttggtgacaatgtccataatactcttaaactaacgtgatttgttactgttgtttgttaccacacttcaactagaggttagtaaaaataacgatgtatatattatttttcttatccaagttcacagatccctgagttctattagggtaagaacctctgagctagaccatgaggtttgaataagagaatgtcagagatgaagactcaaactcagattaatttagagaagatctgtattcatggaaatactagacacacatagctagcaatatgaatttgactccagagaaaccagtttgaacttcttaacagggggatactttatcagaattgcatccaataaattattcttttctctttgcagtatagtttgatagcagagaatccaggtcaacaaggacttaaggcagagtttcagttaagaaatagatacacttgtgtggattaactgtgctcacaataagtatttgtatcatcaattgcatgacttaaagataatttgacgttctttgaaagtgaggttaggaagtgatggatggtaattttggaaggcaaaagaggttattacagttggtgaaacatgtgttataattgtccaaaagtgaataggagagaattactgaaggaagagtgagaagtcaaagcatctctaattcttaatcttttcataaaagatattattatattaatggaattagtgacaaatcttataattgaacaattactatgtacctgtgctaatctttatttttaacaactttattgagatataattcacatgccatacaatttacccatttaaggtgttcaaatcagtgtcttttagcatataaacaaacttgtgcattcatcaccacagtcaaacttaaaatattctcattaccctaaaaagaaattgtagctgttatacccaatttttccacttctcctagtcatagggaactctagtctaccatctgtctatactgcagatttagctagtctagacattttatataaatggaattatattgctctggctaggactttgggactatattgaatagaagtagtacaagtggggatccttgtcttttttcagttctcagggggaatgctttcaacttttccccattcagtgtggtgttggctgtgcgtttgtcatagatggcttttattaccttgaggtatgtccctttctatgctgattatgttgaaggttttaatcataaaggaatggcagttctgtcaaatgctttttctgtgtctgttgagatgatcatatgatttttgtttttaattctgcttatgtgatataatacatttattgacttgcgtatgtgaaaccatcactgcatccctggtataaaacccacttgatcatggtggattatctttttcatatgctgttggattcggttagctagtattttgtagaaaattgttgcatctgtgttcatcagggatattggtctgtagttttatgttttaattatgtcccttcttggttttggtattagggtgatattggcttcatagaatgatttgggaaggacttcctctttctatatgttttgtaatagtttcagtaagatttgtaccaattcatctttgaatgtctgatagaattcagctgtgaatctaactatttctacaattttttttgttggtaattcttaaattaccatttcaatctcactgtttgttattggtctgctcagaatttctatttctttctggtttaatctaggaggtttgcatatttccaggcatttatccatctcctttagatgttctagtttgtgcacataaaggtgttcatggtagccttgaatgatcctttgtatttctgtggtattggttataatatctcccattccatttctaactgagcttatttggatcttctctcttctcttcttcattaatctcactaaatggtctatcagtttggtttatcctttcaaataacaaaatttttgtttcatttatcttttgtatttgttgttgtttttgttgttgttcatttatttcagtttcatttaattcagctctgatctttgtgatttctttgattctgctggatttgggtttggtttgttcctgtttctctagttccttgaggtgtgatcttaggttgtatatttgtgctctttcagactttttaatgtagtcattcaatgctatgaactttccccttagcacttcttttgctgtatcccaaaggttttgataagttgtgtactattatcattcagttcaaatatttttttaatttccatcttggtttcattattgacccaaagaccatttaaaatcagattaatttccatgtatttgtatagttttgagggttctttttggagttaatttccagttttattccactgtggtctgagaggacacttgatataatttttactttgttaagtttattgagatgtattttgtgacctatcctatggtccatcttggagaatattccagataagagaaagaaataaagggcatccaaattggtaaagaggaagttaaactgttgttgtccattgatgatatgattgtatacctagaaaactctaaagactcatccaaaaagccctggatatgataaatgaattcaggaaagtttgaggatacaaaatcaatgtacacaaatcagtagcactgctatacaccaacagtgaccaagctgagagtcaaatcaaaaactcaaaccattttacaacagctgctcaaaaataaaatgcttaggaatatacctaaccaaagaggtgaaagatctctgcaaagaaacttacaaaacactgctgaaagaaatcatcaacagcacaaacaaatggaaacacatcccatgctcatcgatgggtagacaaatattgtgaaaatgaccatactgccaaaagcaatctaaggattcaatgcaattcccatcaaaataccatcagtgttcttcataaagctagaaaaaaacaaccctaaaatttatatggaactaaaaatgagcctgcctagccaaagcaaggctaagcaaaatcgcaaatctggaggtatcacattacccaaattcaaactatactacaaggctacagttaccaaaatagcatggtactggtaaaaaaaaataggccatagaccaatggaacagaatagagaacccagaagtaaagtaaaattcttacagccaactgatctttgacaaagcaaacaaaaacatcaagtggcaaaaggacacttgtattagtctgttctcacactgataataaagacatacctgagactgggtaatttataaggaaaagaggtttaattgactcacagttccacatggctggggaggcctcataatcatggtggaagcaaaagaggagcaaagtcatgtcttacatgatggcaggcaagagaaactgagagcccagtgaaagggaaaaccctttatctaaccataagatctcattaaacttattcactaccatgagaacagtatggggaaaatcaccaccatgattcagttatctcccactgggtccctcacataacatgtgggaattatgggagctacaattcaagatgagatttgggtggggaagaaccaaaccacatcattgtgcacttgacccctcccaaatctcaggtcctcacatttcaaaaccagtcatgccttctcaacagtcccccaacatcttatctcatttcagcattaactcaaaattccaaaattcgaagtttcatctgagacaaagcaaatccctttcatgtatgtatgcattcccatacatcctctgaaatctaggcagaggttcccaaacctcaatccttgacttctgtgcatccacagactcaacaccacatggaagctgccaaggcttggggcttgcaccctctgaagccacagcccaagctctaccttggcctctttagccatggcttcagcagctgagatgcagggcaccaagtccctaggctgcacatagcagagggtccttgggcctagcccatgaaaccattttttcctcatgggcctccaggcctgtgatgggaggagctacctcaaaggtctctgacatgccctgtagatattttccccattgttttggtgattaacatttggctcctcattacttattcaaatttctgcggccagcttgaatttctcctcaaaaaatgggtttttctttcctatcgcatagtcagggtgcaaattttctgctctttttcccttttaaaactgaatgcttttaacagcacctaagtcacttcttgaatgctttgctgcttataaatttcttctgccagataccctaaatcatctccctcaagttcaaagttccacaaacctctaggacaggggcaaaatgccaccaatctctttgctaaaacatagcaacagtcacttttattccaattcccaacacgttcctcatctccatctgagaccacatcagcctggactttattgtccatatcactggcagcattttggtcaaagccattcaacaagtttctaggaagttgcaaactttctcacttcttcctgtcttctgagccctccaagtctctaggaagttccaaactttcccacgtttatctgtcttcttctgagccctgaaagctgttccaacctctgcctgttacccaatttgaaagtcacttccacgtttttgggtatctttacagcagcacccaactcctggtaccaattcactatattagtctgttctcatgctgctaataaagacatacctgagactgggtaatttataaagaaaagaggtttaattgactcacagttccacatggctggggaggccccatgatcatggtgaaagtgaaggaagagcaaagtcgcatctcacatggtggtggacaagagagaatgagagccaagtgaaaggggaaatcccttataaaaccatcagatctcataagacttattcactaccgggagaacagtatgggggaaaccgccccccatgatttaattatctcccactaggtctctcccaaaacacgtgggaattgtgggagcttcaattcaagatgagatttgggtgaggacacagccaaaccatatcaacacactattcaataaatggtgctgggataattgtcaagccacatatggaagaatgaaactggatcctcatctctcaccttatacaaaaattaactcaaaatatatcaaagacttacatctaagacctgcaaccataaacattctagaaaataacataggaaaaaaaaacacttttagatattggcttaggcaaagaattcatgacaaagaacccaaaagcaaatgcaacaaaaccaaaaataaatagatgggacctaataaactaaaaagcttctgcacagcaaaagaaataatcagtattttttagacaacacagagtgggaaaaaatattcacaacctatgcttctgacaaaggactaatatccagaatctacaaggaattcaaaccagcaagtacaaaaccaaataatcctatcaaaaagtgagctaaggacatgaataaacaattctcaaaagaatatatacactctgccaacaaacatgaaaaaatgctcaacatcactaattattaggaaatgcaaatgaaaaccacaaagagataccaccttactcctacaagaatggccacaataaaaacagtcaaaaaacattaaacgttggcatggatgtggtgaaaaggcaacacttttacactgctagcaggaatataaactagtataacccctatggaaaacagtatggggattccttaaagaactgtaagtagatctaccattcaatccagcattctcactactgaagatgaaaagaagtcattacatgaaaaagacacttgcacacacatgtttatagcagcacaatgtgcatttacaaaaatatggaaccagcctaaatgtccatcaatcaatgagtggataaagaaaatgtagtatatatacactatgggttactactcagctgtaaaacaaaatgaaataatggcattagcagcaacctggatggagttggagaccattattctaagtgaagtaactcaggaatagaaaatcaaatatggtatgttctcacttataagtgggagctaagctataaggacacaaagacataagaatgatataatagactttggggactcagtggggagggggaaaggcgggaaggaataagagactacatattggatgcagtgtacgctgctcaggtgatgggtgaaccaaaatctcagaaatcaccactgaagaacttatccatgtaaccaaaaaccacttgttcaccaaaaactattgaaataagataaaataccaaaaataaacagaattatataacatgtggttcttgtgacagacttctttcacttagcatatttttaagcttcattcacgttgtagcacgtatcagcaggtcattctttattatggctgaataccattctatattttgtttattcagtcatcagttgataaagctcttcttacgcattagtctaccatcttccttgactgccaaatagaggattgttcagcagttttttcttaccctcagtttttccttattcttgagtcctccttattttgtcctcaatggtgctggaggacaaaggtcatcattctctgtctgggtagcgactttcaaagcaagtcctctcacccccaacctgccccaggccatttgtataattgcttttgagaaaataagtttaaaagcattctttttcatcttattaagcagatgtttagtattttttgcagggtatgtggttattcttcattttagtttgttctttgttttaaaacaatgtgcaggtagataagtgcttgttgtacactctggagaatcctaacctcataaaatgggaaaaaatacatatatcacatcaagcgcagatattttaaactgtcaagtaacaattctcatggtaggaaatgtattataccactgggtgaagtaagttatagtccagaaatgcttttaataagtggagtaggaggttgatactttgaattattgttgtttctattttctggatgttacatgaaatgaaattaaaatgtagtcctaaggctttcacacaagcatgctcacaggaatagtgactaacattttgactaacattccaacatattcatcaatgagtatttaataacccttttttttttttacaaccagatatggtatgaattaaataactgttccctcgattagtttatgctaatattaacagaaagcttcatcacacacaaagatctttcacataaattttatatattaatactgtgaagcaggtagttattattcccattgcattgttgtagaaactgagagccaaaggttcaaagcatccaagagcagtgaagccaggatatctgctaagaactttgtgtattttgtttcctttttctgcctaagagccatgacaaagctaaacaaatggacttagaaaaaggacatgtaatctctgattgaagcaacatcttgttgacagtacagttgtcccttgaacaacacaggattgagcttcacgggtctacttatatgtaggtatttttcaaccaaacatggatcgaaactacagaaacccacacataaggaggaatgactgcaacacttgagtattcatggactttgatatacataggtgtcatggaaccaatccccaggtatattgaagaatgactctattcactttctaatgccttgaaatttagatgaaattggatttagtattcatttgacatcttgtgaaatgaccttaagatacatgcaaattcctgagtccttagtttctcacattaatataatttgcacaattactccaaatctcctgccttttaactttcctcatcactccttcatcatatcctgacccctctattctttgacgtacctaagcagtagatcttccctcaagctttcatcttcccccaaacccctcacacaagaaattagtatgaaacagactttactaagaatttggagagaggggtaggacatttattctggcaacaaataattgaatactgtatattagacatcctttttaccaagtctttcagtctctgaagtatgagactttcccactggcttctttctctgtaacctctagcttcttcatttttcctgtatgtttatgactctgctctttttcccttctaaattttatgaaccatgacctagaggcctgcttatccccacttaaaactgcttctcaatgtattttattttttataagaaagaaaattttctctttaaaaactactcaacgtatatattctttgtcttgctacatgtattatctaattcagttatcataaccctaggaaataagatactattatcccaaatatgtagtgaggtaatccatgcacagagagttagataagttatctaagtttccacagtcagtcaatggtggagccaggatctgaaattctcaagtatgtgtggagaaaggatgttattctaacatcagtagagtgtcttcataagcttagaaatttctgtaattacttctaatttcaggtgacatctgctgtggaaaattattcagtaaagtagctttgtggctttattcaatctgctggcaacatgatttagttaaatatgcaacctgatgctgcccttttatctaggttgtaatttacatttggtggaagttaatatgataaatagtggaagtcaaagttttcccttgaaatatagagtattttgtatgctcatggatttttgtttacatcaggacttctcaactctggcactactgacactgggctgaatagttctttcttgtgggggcactatcttctgcattataactgcagccctagcctcaacccactaaatgccagaggaccccctggttgtgacaaccaggaatgtttccagatattaccaaatgtacccttaggggtaaaattgcccccagttgagatctgttacattatattacatactcacccaagcttaatattaaaacataacaaaaataaaaatcacattaagactgcccacaattctgatagtgattgtagtactcttgccattttcctgcctctaagcaattacggaaatagccattcattctttaggctaattgaaggtgctcatgtattatagaaaaaacaatagagcaagaatgtattatacattgctggaattaagcttaatacacttgacttaattaggacaattaaattatatgttcagctctcgtttatttaggggatgattagtctattttcctttcttttttgtgggtgcacactggatctatggcctgtctttagctttcctcattactggaaattgaaatcagtccacaaacacttatctagtgcttgacatgtattttaagtgctaacatttcaaaagataatgcacagaaagcttatggaatcatgatgctggggaaggatgttgtgaagtcctttcagaatcctgttcattgtcagataaatggttgacccatctacaataggtttagtatgttctcttttccttaattatcttcaaggacagaattgctgcaatataagtttctcattccagactttcattctgatggttcagatgattctctatatctaaatattaaaattgcttaaatttcagtctgtttcctcatataagttttctttgtgaatatgtatgtatgcctcatgacttcagaatcagaaacaattctgaagttgagataccttgataagtatattgactctttttttgcataaatgagatttttagttttggatagcttatttatgtttttgattcacaaccaagaataactataatggttttagttcatatgcaatatgtattataatctgttgtaatttagtataacgaaaattgtttcaagtgtatttatagcagtcatgaccagaagggaaatcagatttgcctaatctaaggagaagcaaagatcttcactcatgtagcttcaacctcaactagacttttccatctcacattgtttcattccatttggataactagtgcttttgagcaccctgtaagaattatttctatgatgatgtcaaagaaaagtgacctctttgaattagaagcttggttctaactaaaatattctaacaacatgatggtcttagaaactatggatacaaaaaggtttagaaaaaaaacctaatacatatatatgtgtaatgagaaaccactaagcaagatacatagccaactaggagtaaaacaaactaaaatagggccgtttctcacaggctttattcaatgtccaaagaatgattttcaaacatccagattaatactgtgaagagttaacacatcatctagggggcaagagttcagatccagagagactttatctattcagatttgaaagcaatcttaaactgacaactgataaggcaaggacacactgctattctttaattcaagaacaaaattgcatctcacagtggggtcatccttttccttcttatagtggcttaagaaagacatatataaatgactaacaagaagtacaggtttaagggagatatctaagtttatagtctgtccctgggaattggatggcttttccccgtaggttgccccatggcagcctcatcaatttctactttcttactgggtgacagcaccccccatctaaaatgaccctgcaaggcaagtctgatataatagtatgcctaatctattaagaaagcagatccacagatgaaccccatctcccaaaggaaaatacatccttgctggtgacagcacagctccactaccagaatattgaaagttccttttgaatctagcaactgtagaagccattatgaaagaatatgtaatgtaaaagccacaaactccaacctacaaaatcatgaaggtatagtcaaacagattacagaaggaaggagataagagttcttgtctagacaagacctttgttagaacacctggttccctttaatagtcaatcaagttgtcctgaatgttccaaccaagatttctggaactaagcacagtgattataattaggttattgccagcattctatttctgcctgccagtaataaatctctaagctgattctacttatcatgaaagtccttatggcacaaaaccagaggttagtgaaaaactcataaggataaacaaagccgggaggttctgagtctccctctaaactcagtttcttccattatttatagggccttataaaagataaacacagaagtagatatgctataatggatcccttaatgcttaacatcttccaagggtggtatgtgtatagtggtgccaaaaaccagatgattgattgcttctcaaaatgacaaggtttaggacttatgactcagctcattccagagcataaatgggcatgtgttacctgaagtaaaatttaaaagtgcattcaagttaccatgatacatctttcaattattcatgacaatgccaggagcgataaaagagctaaataaaactataaataaccctttaaacgtcattttagccaactgtttcaaatcttctctcatacaaacaactttagcaatttagtagaattcaaattaaaatgatttgaattttttttatatttcttccttatgaatatggtggtaagaggacacgatgaaaattataccaatctagtaatatatttttaaaagtaaatataaatagtaaaatgcacagaagcagaatatataaattaccacatttgggttatcatttgttcccttagtaacagacctaatagcctctagtaactgttggtcttagagaaattaatagaaacagtctagaacttagtaaggtgcttggaaaacaactttctgatactcttgaaaaaggagtctttgatttgaaatctaacatatttgaaactgaaactaaactgaagtattaaaacaatcatgaataaatgctaatgaatgtcttctgtttttttttaaaagaaatagatatcacattaatcaatgaagaccatcagtaaactcatcaaaatgcatttctaaagttagtagcaaactgtaatatataaaaacctccaaactgagctgtttctaaatttggtgtgtctctggcaaaagcatgctgtatattcagcctacctgcattttccctatttgttttaccctctttgccacctaaataataacatataagttcatctactttctatgcaaatggagtcagtgtaaaacacatctcagaggtagccacagaatgaaaaagaagaaaaaaagacacaactccttaagggagtataaaactaaaggaatggcctcatgactaccttaatactttaaaggaagaaaggaagttgattaggtgagattaggggtcactgggtgtacgcagaaagcttttattattcttagctttcttaggtgaaccacacatttatacttggaaatcatttgtaaatgtgtaatcacttctaattttgctacaagacgggtgagaggcctagtaaattagcttaaccaatttcacatatcagaccagtaactcactagactcttagaaaattgggatacttctaaatgtctctgaaagagccctcattaaagtatccagtgtgtcctgcctccttgaattagccattcctcgttcacataacaggtgtgagaaaggataccaaattatgactccaggtaacaaagtacagacactgtgttttgtttatcatttatgtctttctgtttacttaaaaaatgcagtgctttttggacggggtgcgatagctcacgcctgtaatcccaacactttgggaggccaaggtgggcggatcacgagatcaggagatcgagaccgtcttggccaacatggtgaaaacccatctctactaaaatacaaaaagaaaaaaaaaaattgcctggcatggtggcatgtgcctgtaatcccagctacttgggaggctgggaggctgaagcaggggaattgcttgaacctgggaggcagagtttgccgtgagccaagatgacaccactgctctccagcctggctgagcgagactccatctcaaaaaaaaaagcagtgctttttggatcattctcatctatcatatgacatcacatcccttacttttttgactgttgtgagtatattgaatttccagtgtttaacttagcctggaaaagatgttttatgtcaaaactgctatttctcaaatacaatctggctaagtgatttttagctattccaattaatgtgaaatacaaccttttgttaccagcactgattattcatatatacaaataatttatatacatatatgtataatttatacctaccttatcaaaaaaataagttaaacatgagaaaattaggcaaatataagataagatcaggccgggtgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaagataagatcaggaaaataagtttgaaccagaagtgagcttgtgcacaaattttaaactttggagacttacacaattctggctgtaatgccatatgaaaataggaaacataatttgttagaaaattaattgtcagtaaattgaaacccatcagtgttatatgagcatggcttttcaggaaagaagtggcagtacaactgagtatggtggtcgtggcagtgaagggatattcactctttcctatggggcgaatatcttatctttacaaattagttctgatgtaatgggtccatagatttcctttaagaaaccactgagctaaaacaatagtcctgatgttcctccttctttaaaaaaaaactccaaaactgtctggtagaattcttagtagtggttttactcgcatggcccataggtttctttctactgaaaatgtttaattattaaacccagagagtcagagaaatagacttgtacaaatcatttatttatgaaagttctttaggctttattccttttgcttttagatctattagtataattgacactagatctataggtcaagaaaattttacaaagcattgcaaaattgttacatattattctttggagtctctaccactaggctgtgagggctgaagaaacatcaaatgttggccagacatagacaaatggagaaaagtacaaagccattgcattaatctaggaagattggtatgattttctgagcttctattttcttctttggatgtgatctaaaaggttctctcctcaaccccccatagagagggaatctgaaaacaaattctttctccactgggcaaggggaaattaaaaacctctattaccctatattgttcttggttagtttctgtagtagatgatggaatattatgcttcaatgtcatctaataaatcatacctccatataaattataaagaaattatgccagtgataagagcaagcatttattaagcatttgctatgtgcagggcactgtgttaagaattttacctgctttatctcacttaattttgacaatcatccaatgaaataggtgcttttattgtatctatttcactgaggcaaagagaagttaagcaatttgcccaaggtcataaggccagtaaggaacagaaaagagaaccagaactaaacttttggtctatctttagatgatttataaattttttaacctctgtgtggtattctgtcctgtctctcattcttgagtggtagatgaaatttctaggggcataggtttgccactgaaaaaaaggaaggaaaatgccatgggaactatctgaagcttatgaaaagatgaatttaccggactgattttgatggggaagaattttctttcctacagtcaagaagtgaaccatgagaaagctagaatatttggccgtacctgtgtaagcaagtctttttaaaccttttgagttgttgaatttgttcattcctgactaatttctttacatacagaggggcatgcatacaccagtcaaaaataatgaggagatttttatggatttttattctaattactgcagaattctctcttcattgataccatttatgtgaaatggttttcagggtaggataatgtcctctgaagggtgaatcacgtaccactagtatatggattaaacttaaaatttaaaatatatatatttaagattttatctccatagtatttgaaaataattaatcagcacattaaacctcagttgttacaaagattattgcctagataaaaccaggttgattttaaaagggaaggagtgaatttaatgtcaatactctaaaaggttaaatattgcaggtagcacacaaataaaggaacaattatgaaatcaaagtataaaggcctgaagtttggcaaacactggaggaacatagttcctttcaaacacaagctaactctcttgccaggcattaagcttctcttctgtagactgtggataaataacttggagaaaaataggagaggagaagtcagtcaagaatggattgtgttgcctttttatttctatcttgattgtgttaggccatgaaattcttagtctacataggtatgactttcaaaaatatgtatttttttcatttatctcatgaataacatttgttttacttgcaggtaacaatatatacccagtatgtggtgttgccttagcttttacttcctttagcatttcattttccaagtcctttatcaaacataaactgtcataacacagctttcttttccctcaacccttgtagtttgttttttcctacagttaacattgcagagctaggaagcagataagacagtcttggccaagtcaggcaagatgttttaaataaaaagataccatgagcagaattaaataatggcaaagggtcaaagtaattcccctcttcataatagctgccttactaatgagaattttcaagtatgaagtgtgctgtagaaaatgtaccacttactcaagttttctttcagattcaaaattacgttaaaattggaattactgtggtttactaataacagatttggaataatattatgtttgcctgtttgtctctatattttcttgttgtttctttggatctcatatcaaatcttttcagtagtaaatttaagaaaatatgtacttttcttaacttccatattttgttttatttcttgcgctgcctcgtggtgactttgttttaattggtaactgcatttttacaaatgagcctaacactcctcttcacattaaaaatgcaacaaatgaagcatgagaaataatttatataacatgtttttccctcctcctttttagatggtaaggttgaagttacaaaagaaggtgtgaagttgtgtaccatgggtccaggaaaagtgtttggggaattggctattctttacaactgtacccggacagcgaccgtcaagagtaagactattttcatatttttaaaatattttcaatgtcttttccctaggcctttgagatgttgtttaaaatgcccattcatttaatctttatacttttatttctttgtattttaatttttgccctgcaatatagctgatgtatttgttttcctactaaaggtgattgttaacaatcagttttgtataattacattttcttgctgacttctgaaaattatcctttaatcaataacttctcataattaggattttttaaatcatataattttatacatttgaatcaaataagagcaagtccttttctctctttatagtctcaggatcatatttaagaaatttttacatgtctgtctattttgggttatattcttcacataaattccacttgtttactcagtggtttagaaaaattaagagaagaaatgtccttcatctcattcaaacatcattgagtaagatatctcctgaattctaaaactgcatctgagtatatttttgccctcagctgctcatcaagctgtatattatagcatttatcttttctactgattgagcttattttaaatcagggcaataaagcagcttgtttccctaattttacatgtatgtgtatatatgatttctctagcaacttttattgcttggcagaagcagctgcaatagttagaaggaaaaagatttttttaaaaaaaatctgcttcctgaataagtatataatgactgtataacaaacagagctgaattcaaaagtcaacaatgtaaggttcattgcatctttaggcaaacgtgtgtatttcatgtttgaaaagtccttctgacacattttcctgtggttgatttcagtcacagattactttgattaggttttgtcatttaaaaaaaatgctattggcaaaatgacaagtacattgtgaatttcaattagttttatctggatctcgttgactactttttgtattagttttttccttcagaagtacagcatataactgaaaatacaacaatgaaattggatttaaaaaaaacataagaatgcacggccaactggagtcccagaaattgtcttatacatcttattagtgaaatcacctttttattcattggattcactgtaacaccaattgcaaatgggccccttttaggatgagtcttccttggcagttgattcttgatctctgaaagcataggactcttttgattgatagatgctgccatgtttttacttcaagtgatcattcaattacatagctcaaagaatgagactcagtgaaccataatagaatctgccacaacttttaacttacttaaaaagaaccttaactatagaaagaatagtcatggctccattaagtgaaacaatttttacaatcatgcttcattttcatgagaaatatattccttttaagataaaaaagaccagaatagcatattttgatgatatctcagtattataagtatttttttgttttgaagtatttaaaatttttaaatatttcaggcttgtacactgcttgatactttaatctaattgaaactacaaaatttccaaaagccaacagttggtaataacatggtagttaatcttatgaaacatggaatttttattaaagaaatattttaagtagtttatttacatgaattttacagcaaagatttttaatgaaatgatttgtttgcttcataaacatcagttttcttattagagttctatataatgatgttcgtctgcactaacatctattgtactctgatttggcaaatttaaatagacactgtgaatctaattcaacaagaagaaactagatgttgaatgcaaattataagcctaactcttttggggtcagaacatccatcttcaaagaaaatgagtaatgggacatgttcttctttaacacagactcagagaaagctcaagaatgcatccgtgcatgtgtgtgtgtttgtttcttcacagtgcctacttaagatataaaagttgtgttgacaaaagagcctagagttggtgatgtgcaaatatatatctgcatttataggtacagaggttttgtgcatgaatcagaaacaatatctgtgcgcaactgtttcttccaaatgtttcataagcactatgaagcatgaataatgtttgtttattgtttcaggacttttttgtcctgccacctctgctatctagggagattgtacttgtgactgtaggcctcaagcaccatttttttctatatatttaaattaaaccttcaggctggatatgttatgattctaattagatcacattgtggatgctacttttacaaaatgactatgtaatataactcccaatgctgtcttattctttacatgtgataaaaacatgtcttcaaatttatttggtttttaaggttcatttatttcttagtattcaagattatatcaacttgtccatattttcctgtcgtcatgtcatttggagtatcaaatgacaagagtattgaccattttgagtatcattcaaaatggattcatccacttgggcgtaatagtctaattctgaggggaatatttttctacacaatagctgacctatccatgcttcttctttcttacatacctcggcttttgacctccttaaccctaacatcacccactttccttcatgattgaaaatgttgatgatcctttctcttttctattttccttgattagcctgaaagttatctggcatcttaatgcatttttattttcacagtggtaactaaatcctaggtagcattcaatagtttttcaatgtacattacttgtttcctgtttaggagagcagtttttacaattgtatcaggctgttaataaatacatttcagtgacttcatcagctaatgaatatgatcagtacacctgtggattttttctaagattaggttatcaagaagtagttttcttactaaagctctagattgacatatgctataaaatatgattatgagcttgttcatagtgatccaacagaaggaagcaccatggtagtttgaagcaagctctttggttttcatctgggaaaaaataaattggcattcttctgaaaataaataacatttattttcagtggttaccacgatagcactaggaggaagatctgatagcaccaggaataatatttttaaaaaatcaaaaccacagtgatatagaaagaaaaaaatcgtggtatgattcagatctatattcatagtctgctcctgtcttataaaataactattgatttttccctgaggaatgaagaaataaaaatatataaaattaacattatattggaaacaaaaatttaacaacagtcttgagtttgttcatggcttaatagcctcaaattttctttattaactgtgatctgaaaatgaccactttgtatctttccaatcacaaacattcccaatggcatggggatggggaaagaatcgcttgttatagttggtttccacagtaccaattaatgttttcagtattgtttgatttttttaatattttatctaaatattttgaaattgtatagtgaaaggagttttgccatccgttttcaaccccacaggggcaagaatgtctcacatgttgtttgaataccccttacttactcagttcccacacctggaagcagatcattatcacgttttcctaaagtgtcactcccgggtgtgatttcacttttactaccctcacagctatagcaatatcaatttgcacttaccctgggccttgcttctgtgcccaaagttcttcaaaataacaaaaatggagaagttgaagttactggaaacttaaaaggaaaaggcgtttcatttacaatgagagggattcagtgacacatgttgaactcagagtacttttgcctgtaaacattaaattgaagccctacttctcttactttgagtttcagctctcagtgcctccagacctttggtcatgtactattcaaatggtctcattcaactaaactccaatgaaacccaataaaaagcacttttcaggaaaacatcttggtgcctggtcaatataatcaccacagaaagttatctacaaagaacgtctatggtgggtgtggtagatattttatgacattacttgggcaaaatatctgactaattatttctccttaaattgttaataacaagtatttaatttttttctttattaaaatacttcattattaatgccaaagagcctaaaaagcctacaagaaatctgacaaattgatgactttaataatgttgggtaaaaaactatttttctgccttggtttgaatctttttaagtttacatacttaaactttcctaggatattagtaaaggggaagttgactaattaagatattttactaagtgtcatagatgttttaagagcaaagtttaaaggtctggagttttgtgtttatttttgtttttaaaataaatttgagtctatgtagtgaaatgtctttacattcccttgcagctgttttaagcattacattattcaaactgtatcagaaaaatctgctgactgtcgaaaacctaaatgatgaatgagaattaagtaataggagattcaactgaattttttgctgtaaatacttttacatgctataaaaataatgcctatacctaatacatatgatctatatctcattcatccacactatgctttttattggtaaaggaacaaaagacaagaatgccaatttttactgttaatgaaaaggagtcattgatgaagttcttataatagctgcaaacctgggaaatttcttaagatgcctaaaccaagaagtaagcaatcagatacttttttagaaaatatcattgtagagcaccatgaagtattagatttatgataaagacacatccacatgtgaaaatgaagcaacactgtccatcagcacaaacaattgctagaataccattattcctgggttttcatgagcacaagtacccaggtactgtcatgcttgctgtgctatagcaaaagagcagaagagataactgggctaatgagacagtctctgttctgcctttgagaggtaagttgaagagaagcatgtttgttttctcccagtttaatacatgatttttaccaagaatcctgaaagaaggggagaagacacaaattaagtttgggccaatgatgagtggaaacatgaccctggttgtggaagggatagttaagtgacttcccacaaatgttatcatcgcagacaatgaagcaaacatagtatattttggcagcatcttggggaagttgttacacttgtgtagtgagttaattagacaatattcttcttagtaaaattttcattgcatttatctattaaagaatattgtgaaattagtaacataaatccaattatgtaatccctgagaaataaattaatttctttaataaaggaatcaattcactaggtatcaatgatgctacataacagactaacatgaacaaatgtacatacaaaagccatgttttaatctcattttttttgttgtttaagtagacgaaaaatgaatttcggagaagaggcaaactattattgaactatatttttttctacaggttgagaagatttttttccttaggcttgagggaaactgttacaatcaaagtgtatttataatttatatataactactttcccaaaaattcatgtccaatttctatattgaccaggcctggtagatagtcatacattagcggtgcttctgaggcaaaagctaccttccatagtcaaagaaaggcaataaacttaattccttctgaaggcttgataaattattctccctctccttttaattactaaaacattgaatactttgaatattctctatttctaaagaagagtcagactttagctgatagagtgttatgttttaaagatcacaggtaatttatgaggaaatctaaacaataggcaagaaacactgatttttttttttttagctgtttttgttagttaatcctgcagaagcagcagttttcccacaaaaatctgcaccataagaagctcccacacatgtaaagcttgagtcagtttttggtgtaatgaatcttcattcattcatttaacaatttgcttagaggcatttttagtatttattcaactgatttgaggaataaaaagtaaactagtaacataggccaatactgtattttctgtaatcatttttcttaaaggaaaccttcctgcctataggtcagggtcaggatgaattcctaatgaatgtttccacagtaacaataagtaataaaagcagataacatttgaagactgtgaacaacacatgaggctcagagctttagggatgggtgttgttgttacccccattttattgcaaaagcaactaagacctaaagcagttaaacaattaggcccatgttcataactagtgagaaggaggaccataagtctgacactactttgctatattgctctactatcacaagcttttaaattttgcctgcaatgtttcattttgcttttaagcaccagtgtatctgtaagactacttctattggtctgaggactccgctttcacaaaaacttatacagcatgttatggtttcgaaaatttttaaatattagcacttggacccatgttaagtacatctgttgtaaaaagatgaattctgtaacataatgatgagaaggtcataagtttaatgccttagagacatacaatgggcaatcagaacctattgcaggatctactttttgtaatgcattgaaacccttatggatgtttcatgagatgaaacttcatggttcagtgtttgagacattactaagtagctacatttttttacataaaatatgttagttaataaatttcttcaaaggaggaattaggaaaatttaaacagcagctaaagacaatgaatgaagactgggaaaaaattattatgttttgttatataacaaaataaaaggataagctgagtcatgacaagtgtgtttgccttcattttccccttcaatttcctctgactactgaggaaatgtaaccttagcacttcgttggtgaatctgaaaagactgctttgcttatgagatgttctttgttgactaaatttctaagtcatcatgataataatgctttataatttacaaactgtcatcccatgcagtcatcccatgcattatgtaatgtaatcttcaaaatacctcaatctagtagatgaaagaggttgtccctgattttccagttgagaaaatgcaggccaggatcatgaagtgcattagtgtagttcattaacagagtctctgatgcaaatttaggtagcagtaatttaaagcccttgctataagcacctctcctttactccttctgctccctacctctatgtgtggactcctgaataaggctcttaatatgcctactacccatacctaatgtatgaactcttggtaagggaacttcaaatgtttactctaatgtctctcaaagtgtggtccctggaacagcagcatcagcatcacctaggccctcattagaaatgcaaaatctgtggcccctgctctactgaaaggaaattttgggggtgggtcacagctatccgtgtgtaacaaggccttccaggtaatgcccctatagtttgaggactgaactataccctatagctgcccagttagtgttaacctacacatatgcatactatcatgttcatcaaattgtctatattgaggaatttaaaagaacattacagacactataataagtagtcagtgttattattggcatcattgcagctttatttttgttttgttgctgttgagcagagatatttaaggaaagttgcatttttcttttaaggagtaaaacacagccttagtaaagagtaccagctttctacatattattaatatattcttttgaagaatagtgagaagtaaaattaaaagaagaacagattgagagggagggaaaaattaaaaaatcatggactgtcgagccatgttgttaacaaaaatcacttttagatttattaaacttgatggctaggatgttggtagaaaaacagaacaaagaaaaaatttcgtttgattttttgttgttccttttcctggtcatgagtgtagtttggattaagtgataacaaaggtgaatggacatttttaagaaaacaactgagttgataatgtcttcatacattacaacatcaaaatacatttctcactaatgtattaagttcaaccttttgtactcatagtggaaaggtctttggtactttccataggtggccattgacttaattcatagtgtgatccaggtagtcttaggtgggttgcataactctttgctttcaatagttagaagatgaaaagacatccatatatcacagtcattgagaaggaaatgggaagttccttggaattgagacctgtagagatcggaggcctacagtattgaaggatacaggcaaggacgtgagccagtcaatatttgcaggagtcctgaagaattgagttttcactgtgaaggtgacaatagatcctagagaataaatattgacttctcagaaggcaggtaaaaaaagattcaagaagcaatctggggtagctgaacattttcctttaaagctaagtattctttactgcttgttttctctaaaggagaaacagtctgcctcattgataaatactcatgttataccctcataattccttccacttccagaagagcaatactttattgacctgaaagtatggttgtctataaccttctgagtgggatcaaacagcattgtttaaattatcttcctaagtggattatttgttgttgttgttgttgttgctttatttctaaagtaaaatttcatagagtacttctgtttatgaagcttataagaacagacttttctggttacagaataggggaacagcctccaggagctccatccagttgccctaaattcccttgctattcattcgctctcattcctccccctggattaagttcttctctggaatttttgagttcaggtcaggtaaaatagtttgaagaccacttttctagttgaatccagggttactctgagtacctaagtaatgataattctttatcagctgtatactatgtacatgccgcttggctatgtgtagaatctctaacctttacaatagtcctgcactttagggatcgatactacaattgcataggtgaggcaactgagttttaaggagcttaagaaacttccttaaggtcacacacctggatttctaaactatatctctctccttgacagtcaccagcaaaacattgaactacatcatctcaaatgttgtttttggcagttgatatatgaaaattgaattttagatctgcactgtcatttatcaagaatttctaagactcacaccaaattcatgtgaggtactgctgaactctctggggagcatcactgagaaagggggcatagccctacaattaagatatttataatctagttggaaagaaaggaaagacagaaagattacaaggaattcttggcaaactagatcgagacaaatagaagaatttggaaggaaagaaaaattattctcgactctcatggatgggtttagtggaggagatagaaactgacctgtgccaaaattaaagagaagaatagttccgagcatttgtgtccagaagcatattgcttgggttctcatcctttgccatttactagctgtgtgtccctgggaaaacaatttaatgttcctgggcctcagttctcttaccttcaaaattgtaaggacccaccttatgactgtggcaaggattaaagaagggaatgcctgtgatgtgcttagtgcggcaacgaacataatggagtcagtaaacacttactgttctgtaaaagttgttatcctcacagttggtgctatgaaagcaagaaataatctggaagggagttcgaactttcgtcatttgccgaacctgaggaactaagagcacaatttgaaacccatagatacagaagtataagaaaaaagggccacgatccagagactggaggtcctggcaggatcccagaccctaattttttcatcacagcccttacttggggaagttggttcatatgcatgctttgaattaacttgtacatgaggcactgataccaaaaccaaactacaggtaaggatatagtggcaaagattgaatgacacaggctgggcattgaattcaatgcttctgtttggaggtatgactttggtctgtgaagaggtaaagggtattcatctgtgttgtcccatagtcctgttgccatcacttctctcctggccagatttcttaggacttcatgacaagtgtttgtgtattttgagtctgtgtgtacacagacctgaggaggcgccaagtatatcaaggctttggacaaattacgaatagatggctattgagcatgcctttaaaacagtaactattttaaaaagtactatttcagacaaatgacaaaagtagattgtatcttaagatgcagcctggaaattcaagacttgtggtgttcaatttatctgtcttctttaattgccttaaggaagaatctgaatctataatcaccacattccttctgggtaaagctgctggtgatggccataatttttataagaatgcaaaaactggcccccttgatgattcaaactacttctggccaaatccttgaccagatagataaaattgtattgtataattttatatccttaatttatagacaaaatccttttatctaaattttgaatttaccaattcccagtttccctaaaactgtagtgaaccaagttcttgaaattgctcatattcattgccttttattgtcgtttaatactgtgaggcaaaaatctatcaatttaagtgcaatttgtctctgacacacaaccaataaaagttatccatgaagcttaagcataacatgaagcagagtgagatactgaaaaaaaaaaatgggatttttaccaatgtgaaatggcccaatctacgtggaacccaaaatgtaatacatgaagttttgaggctaccaaattattaaaatatcaaaagtagaatttctgaaatgctaaatatcttctgaaactcaaatttgagttggaagagatcttagacataaaaaaatcgactccctttgtctatttgtttcatgactaataaaaacagaaatgagctctagatgttttgggactctgtttaaatacgtcaagataccttaaaagtctcagaagcaaaaagagagaaaaagagaaaatactaaatgaaagatgtaatcttttatttactcattatctgaatctcctacctgtgctttctttttttttcaatcagaaaaacttagaccatggacaacagtaaacaatgataaaaacagcagaatatttttctgtatagactgttttccttataattatttgaatgccttttaaaatttttcgtaattttctgatcataaaagtaatgtgtttataaaatacatacatgtaaagattttaaaaatcacttataaccccactcccataaaagaatactttgacattttggccttcattctttctcttcctaaatatctgaaaagggaagatcataccacttcgctttttaattatcatgttcagttctgaatattagttgtttgtttatagttggtaggtgcttttgtttttcttaaggttttattttgggtcaaagtagctggattttgttttcattttccctttgagcttttcacttatatgataatattagtgtcctttttcttctactcatcttccaatttttttcaattcatttttgctattaaaaaattgtttcttttccactctcgatgtgcatattctcattggtccatgcaacttaataacttgaactagaatatttatactttgtattgatgtttcatgaatactttgaattggaagctgttatgcatgccctttgttaacagggctgattaaattggaatagcaagtagtgatgagagaattggtgtctttctaaagatatgttcaacagtaatacatgtgtggtggttgacttggcacgccttcacagcatttgaattttaggtttctcccgatttttgtgatgacagtctggcattctgttttaggacttagatgtttcattcagttgaatcaccagtagcttaaaatttatggaataattatgttgattgattttaattgctcagcagagccatctcaaaaaaaaaaattaaatgttggcaagcttgatttatttacaaccgtgtcattaatgtctctgagcattagttaagtaggcactagatttctcttccagatgagatcttaaggcatataaattcatggcatttgggtgagcatatttgcactgcttctcctataaactgattctcaattattattaatgtttgagaaaaatgtgttagtccatgtggtaagctacccaggaaagttttcaaattttaagatacatttcgtaaactgacactcacagtacaggtaaggtgtcttctgatataatctctttgccaaaggtgttcttataaagtaaaccattttataaccatttagaatattcctacgccttatctataagaagtgtccctctacttaaactcctcaagagtgtaatttaatcatacttgacttatacgttgggctcgtaattaaaaattggaccttactgtgttctccataccgttttcagagttcttcaggaatcatctttggaagtagaatgatggtattgtagctgagatcacttccttggcacctaaaaaaaaaaaaagcttaaaaggttgtgtaggagacccatggctaacagccttttgggtatgaccatggtgaagcagccgtgaaccttgactttagtactggtatttaaaaccttataaaacacattttatttttaataacagtattaagctcatagagaatattgatagaaaagtactgataggggttattgataatatgggaagatttgtaatgtttttggccttaaaattttctaaataaatgtggccatgagatgtaatggacagtcaaaaagggttaaggaaagatttcagaagatacgttaagaaatataaacataaaagcaaatttagctaggtatatgagggactggagaatgggggaggtggtggtggtatgagtctaggaaataccaaagcacatgggtgtatctacaaataaaggaaatcaaacaaaatatgagccatacatataatgtctgctgtatatggcatttaatgaaactcatacacagtagaattaatctatctttctgaaaaaagtcaatttgctataaaggaatattaccgagaaaaagaaaaatgaaggaactttgactatttctttagcatgaggctattttactcttcagtctctccctccttccctccctctctccctccctcctttcgttccttccttccttccttctttcttgctctctctgtctctttctgtctttctttctttctttctcactctgtcacccaggctggagtacagtggcatgatctcagctcactgcaatctccatctcacaggttaaagcaattctcgtgcctcaacttcccaagtagctgggattacaggtgcccaccaccatgcccagctaatttttgtatttttttgtaaagacaaggtttcgccatgttggccaggctaatctctaacccatggcctcagatgatccgccctccctggcctcccaaagtgctaggattataggcatgagccaccatgcccggccagactctttggttcaatagaatacattattttagtgtacattaatttaaaaattcattaattttggatttatttgaaattttaaatcccaagtaactcattattggcgtaattctctcagttcttgcttttatttctcttgtgagaaatcatagtagctttggaactcactagtaattgtaaaaaggctcatttttttttttttctgttagtgctaatatcttctgcttagcatttcaagtgcctctttaaagagttaatgcacttcattatttcgccttgaaatgatttttaagtatcttagcaaattgtgaacagaacgtcaagctcatttgaatcacagaaacttgccagcatttaaaggcctttttaagagggggttatatatcaccatgataatttttttttagttcatatacaataattctgttgtataacttgaaggatacattagcattttctactctgtacttcgaaagcattattaaattcttggaaatagtttgaaaaagatgcacacatgatatataaagtgacataaggaattggaatgatttcccaccttccctttcaaccttcccttactccagttcttccagtacaaactactcacctccacagactggggaataatggcaagaggcatggactttaaactcaagtatgaacgacatccctgttgctttggtatttttaccctaagtgagttatttaccccctctgaatttaaatttctaaaatcaaacactatgagatttaataactgatatgcagtattaaatagatacttaatgaatgtctatacttttccttttttacagagcacaaggtaggtgaaaaggaacagacagaagggatacaaactgtggaggaggagaatcaaaaccacctaagtgaatagtgttttgtgtccattggctctatcatgcctccttatccagactgccattggcctggctcactaggactttccctttcccttgaagggtaacaatggcttctagtcttttcccccttacatctaccctggacatggatactgacttaatcctattattttctaacctttctaaagaggtttctgtttatattgctcaccttcactccccaagctgtggttttaacccccatggttctcctaggcaagggagtatggtggcagaaacatggtcatccagtctgggttgaaaattgaatatactttgggccttaacaagcagcttaacttctctaagcttcagtttcatcattcatgaaatagggataataaggtatatttcacgggtaaggcttacatcaggtaatatatgtcaaatgtggagtgtcattccagataaaatatgtaatcaataaatcatgaaatcatgattgttataatgtcttcctgttccaggacaaccatttttaattacctcataactttagagatttctaaggtttcctgaatcttttcttttctttcttttttttttttttttttttgagatgaagtttcactcttattgcccaggctggaatgcagtgattcaatggcacaatctcagttcactgcaacctctgcctcctggattcaagcaattcttccgcgtcagcctcccgagtagctgggactataggcgcctgccaccacgactggctaattttttgtatttttagtagagacagggttttattatgttggccaggctagtctcaaactcctgacctcagtgatccacatgcctcggcctcccaaagtgctgggattacaggcgtgagccaccgcacccagccccctgagccatttctattttggtgcccttatgcaggggtttctttccatttaatgccttccgtgtaaaatttctttttactccatctttgactattatactcacacctacttttagaaatcccattcaacttcctcctccttttttctagttcctttattatttgtatctcaatctgaatagtggaaatttcttcactaatttgtcaggtctttataggtgtagactatgccttaattaacttttttccacaattccactttccagtttttcacatttctcaggatacttgtattgaacctggaagttggagacaatacttaggaaatgaagcgttcaatgtgtgacaggccttcaaggttgttgacttcttagaagctaaaatgctgatagcaaggcattccttcatctaaactatgaagatttcttagtgatgatatatttggagtattcattactatttcataaggctttatcatactcttttgcagggtttcaaacaatcagcaggaaatatctgctgaaaccatgatgttttcatttatacacttaagttttgacactgcttttcaaagtttccctcctttaccttgacagttagctaatttagaaaactaataatctaagcaaattcataaggcttttttttctgacacgtgaaagtggaggaggagtagctgtgaaataattacttcctaagctttgtttttatctgattctactagtgactctgaaaatattgttgatgcacgaaatgatagagttgaagtaaattttgatggatgagctgaattaacttgctaatgatataaaacctttacttggagtagtctatagcatgaaacaggattcactaatatggtttcaacctgcacttgccttttttaatgccctttcataggggatagtaaattatcaagcccgtgtccctttacctgagccctattagcagtttccgcgtaataaaagcaatcattgtctttactaaaggccatcgactttcttccctgtaatctcaaagagaaatcccacatttatttactttttaaaagacattttatcttatttttaaattttgatctatgtatttatgcattttgggaccgggtcataagactgactaatttttgtatttttggtacagaagggattgcaacatgttgccaaggctggtctcaaactcctaggctcaagcgatccacttgcctcggcctcccaaagtgctgggattatagacataagctgcagcgcctggcccccacatttattgtcattgagcatttttaatgtatactctgtttcaatcaaagttttattgagcacctactatctccaagcccccacgtgagactcaccacttaaggcagacttcctctactagttaaccctagagtgctaagaatgtgccctgtaaacatgttctttaatttgactcaacaaaaaattgctttttaaatctgaattgttatgcctgagtattttttgctttgtacagaaagtcacagtcagctttttccttcttagaaatacttgtgttgctgctgttgttgttctgttaagtacgtccagattctatctggcaatatttcttctttcttttaaagatagagataattagcactgattagcaaagagatatatgtactaataatcttaactaggtagttgcaaaatccaaaacattgaatactagggaaatttgagcttcaggctgttccaggttgttaaggaatagggccagaagtttttttcaacaaatagaaaatctaatacaagccttttgctcaacattttaaatgaagttgagtttcttaatactgaggtaccttttgggccatattagtaaatgccaattaccttttatttttattttttaataaagagtatgcagtgtcctggttatcctctttacattcttggttaactgtagttacattgataagtatctgaatcaattcctttggagttccaattattgggaagaaactacttggaattcttcacaggataagtgattatcaagcaaggttcctaccttgaacattttcttgttttgaataacaaatcttccgcggagggtggttagacagaactcatttgcagtaagtgtctgtgtacccagtcttggaaataattagatagctttgtagcatagtttcacaagcctcactcagtatatggattcttaaataaacaataagaaagtgatattatgaagaaagacagcccacatacaaatcccctagtataataaaaagtgattaaagtcattgttcaagagaggcaagatacttaagaatctacttatgaggctctactaaaatgttatattgctactaaatatcagaacatgttaaataacattgtttgcttttgttattttttgtacgtcatataagctggcaaaaagcttctttggaaacaaaaggggcaagacactttcttgtctttgagtactgatttgagctatgagctacattcaggaattcttattagggtcatgtgacatcttaaatgtgctatagtgtagcagcttgctaacggtgtcaacttatgttgttagcagccattcacacctgttgatgcatggcaagatagactctccccagccataggcaacagttctcattagaacaagaagtctcttttcatctcttcattttataaagatgttcgttaccgtcatttatcaatctatccctccaatttcttgaggcccctctccaaagtgtttccgttcatcttgtaatcattaagtacagcattataaaatacattattattattatttttgtttgcgataagaacacataccagaatatagtattgctaactgtaggcactatactttacagtagctctctgggacttcttcattttgtgtaactgaaacttatgtcccctttcactgatacctctccatccccctttcccccatcccctgacaactaccattccactctctacttctgtgagtttgacaattttagattcatcatataagttgtatcttgtaaataagagagcaggatgacttttggaggttatggataggtttatggcataaatgctggtgatggtttcacaattgtatacttactccaaagtcatcaagttgcatgtattagatatatacaacttttagtatgtcagtcttaccttaataaagtggcttttaaaatacactaaactttgccaaaggtttgattggagtgtggcatttccattctttctggcttttgaatggctacatgtgaatagccctccacctattttgagtaatctcaaaatcaaaatagctttttggaggaaaatcttccattccgtactatttgagtttctcatttaaggactggcaaagctttaacttttcaagcgactgctgagtaagaaaatattgagctttcttagtatactttaccatcattaacaatttagggttcattggcttgaaataatattttgcttatctcacaaaaggattttaccttctaaatcatttaactcaattcaccagtgcttgctatattgtcactctgtaattcctaatttctacagtgcggtagttattttttctgaaggatattgtccttcaagaggtgatctgttgtcaaattccaattaatattcagattgccacaggcttttttctctctctttcacatttgttaaagggcatcactagatcttgagagggtattaaagagcatttgctagatgtaaagagtgcatacaccaataacttgacttagtaggttgaaaggggaaaaagcaaagtgtagagttaaaagtacgtaaaccttataaatactgccaagccagtaacacctgttcaagacattaaaagaaaatcttataatattgagaatgtaaacccttaaagcttagaagttttaagcttctgcatcttgcaattaagaaaataagaatacatgtttaaaatatgaatattaatctgacatatttctgctagaggagattatattaataatttaccaggatattttgagttagtatttttttgagtgggtactcttggtatttaacatttactaatatataagcatcttgaaaaccagaattgtatttacaagtatgaactctatagtcaaataaatattaagttagcaattagtaagggttagagacaagattaaaaaactcagtagggagttgcggtagttgaggtggatgtggccccccagaagccccacctggtgatgttcacacccttgtataatccctttccgttgaggatgggctggacctcatgacttgcttctaatttagagaatacagaaaaagagaaggaagagccagattactgaaaatgggccaaacaattattaagaatatcttaaggagtatgtctcatcaacggacaaaagctaagccaaaaacaccctggacaacgaagctcgtaatttattggcatataattcctgagagcatatatctgccagataaaagtactgcaattggaaacacatcagaaatcactttatggcagttatcctgaatatatactcaaaaagtgttttatttcagtttctaatgtttggagactgtagagagatgatgacgaagaaacaactgaggatttcaactatgttaacgtagttttaaaaatagacaatcagcttttaagaagaaattctaccaccatttattgagtgcctgttttctactgtatatcgataatacatggttctaggattaaaatgagactacattttaatcaatagagtcagtggaaaaaatagtcatcatctaattcaaattctatatgacatgtatgataaatgccaaatcagctatggctgactgggtgactgtgagtccagccctaaatgtgtgaaatattgacaggctgaatggttttctaaaaattcattcttatagttgtcatccttctttaatatatggaagttgagctttgcatataacattttaacgtgacaattctctagatgtactttggtcattctaggtttttaaatggactacaagttctaattcctaactaatgccctttaaagagcttttgggtacaagctcaatcaatacaacagtagaaagacattttaataaaaggttcttagcattggaagtgtgaaaactcattacatttcaggaattagattttctttctgaatataattggaatggaaatattttatttggctgatggcagcactataaaccagctccgtagtagactttgacatctatatttactactagatgatgtttgtgcagacctttaatttggcttgaaatgtaatcatgcctagatgtgtttaactaggatcctaatctttgaatctactatccaatactaagtagaatgtgaacgctatgtggcattaaaaatttaaacacacacacacatcatctagacaaactagataataaaactatttaactgggagccccgcagagggcttttggtagcttagatctagactggctctctgcgtccacctcttctcttgttatcccagggattcaggctgcattcttcctctactattcatccgtttcaggttttctctctgatatgtcaagagtggactacaatctcttgtttccatctcagacaacaagcacacaggccctcttcttctaggatatttctactaatcactaaaggaaagtgggatactaaaacaaaacaaaacaaaaaaactgccgttggcaggatgtcaaggtattagagtcattctgctaactctgtagttagcaacatacattgaaaaattatttgaatgtctttctaggcattttgctaggcattgaatatacagagataagaaacagctagccttcaaagacttcaccatagaatgtaaataacacagcaattacagcccaatgtgataagggtacaatagaaaagaagaaaatatatgctatcacaggaacacagaaggtgggaaatgattaatctgtaggcagacgggacaggcatgccaggtagaggaattagcatgagcagaaacatacaggcaagaaagaacagaatgaattttgggatttgaagaccccatgttgagcaatgaggcacagtgggtaggcatgaactgcgagatcactggttctcaaaatgtattcccccaactagcagcatcagcatcacctggaaatttatcagaaatgccaattatcagaccccacccaagactcctgattcaaaaagggagatttaactagcctttcaggcacttctgatccacactaaagttggaaaaccactgttctagattatgtcacagctatagactgaagttcttattttaaagccaatagattttaaacaggaaaatgacatgtgttggatttgatatttttatatcaaaagagctgtctgaaagcaatgtggagaataaattagtgcacatgtgatgagaggtgagggaatgggatggagggtagggaacaaaattggatgatgcttaataggctgttgcagtaattcaggtgaaaataataggacatgaactgaagagctgtgatgaataaggatttgaaaaatattcaatagctagtcattttcagattattaagaatgttctatgacctgtttactatagttcaactgaatgtggactcacttatcatcactacccctcttcctatcttttggccccacttttagggatggccactggaaacttttctttgaagaacacttaaaatgtaagtgttcctcccatacaagtgatcagtttcatttctaaacaagatgaaacagttgtttaggtatttgtctctggtatccagacacaattatatcagagtatttcctctggtcttgaatcagaattccctttacagctctgactgatttgaacaaagttacatgtatagcagagaggattttctttatggtgtaagcaataattttattatttttctgactaaaataaaaacaaataggaaattatttaccaattcttctggtgattccacatttgtggttcttgcatttataggtaaacacttatttattacatttactaatatgtatttagcacgtactataatgcagcaacataagtgaaaattatctcatgcatactttaaatatgtaataccagattaggatgatgatgaaacaggattcaagaatcactgtgttctcaacatctattgaactctcttatgcatcagtctctttgttcagtactttacatgcattattacttaatcctcaaagctcatactagtgttttttatttcaataaagatttgagattatagaggttaactagcctgtcactcctaataaggagctgagactatttgagcttcagaacagtgtgacaagaaagcaaagagaaatactgtccgtttttcatagatcgttctgaaaaagaacttcaagaccatgttaatacaggtgcagagagatatgagctctcacatattcttggtgtgaatataaggtgatatagtttttcaggaaagcaaccgggctatatctatctagatggaagcataaaagtgtccatattgtttgatttagaaacctcatttctgggatttctaggaaactagtttatggaaataatttgagatgcatcaaagaaacatgtattctgatgtttttcagaaacacttgaaatggaagaaagggtttggatagaaaggaacaccccaatatgaaaagtgaggccctacatcagtggcatcatgggactccttctaggtgatttcatagaactaggttctcacttttcatgttggcgtgcttctgcctatccaaacccttgagatccaggaagactttgatatgtataatagggtcattaagtcaaggataaatctgatgaatctccttgaatcatcaacttaagttgatgatttggagtgaggttgattttatattacacatagatgttgtattagtagaattaggaagtatataaatgttatgacaaagtgatggacttcaaaaaactttccaaccactttgagatacactactgtcagacctcctaaaggaattttctctcctttgctattaagcatggcagatacctcagatggaaaatttgacaggtgtgaatttaaatgaataaatgttgttattaataaaacaataacatttccaagaattaaaaagtagagttataaaaataatacctacggaagccacagagtcatcaaacccatttgacagatgaaggagctgagagctagggaaagtcagtgacttattcaaggcgttaaaaatggttcagagcatgactataaccactacttggatctccatatactcagtactttgttgagctgcctctaaattcctgaaagacgggtagcattactaatactatgttagattattttctcagcaaattagcaatatttttcatgtctgtgaatgatcgagtaattcagctgggatcatttaggaggcatcagattaactgcaaaagtgacagcatgttcaaatcatactctcatgaaatcacatagaatggacagtggctgaatattttgttattgtgaggttttgcaatttggtctttatatacactaagtcttgtagaagtcttgtagaagtcatcctattttgcttgtttttctcctctaaacacctatgccctctccatgaatactgagtgaaagcgatggttttcttgaggaaagaaccacagctttctgattctaaacctagtacaagccctggctctgccaatttcaattcaacaaatatttatgccactctctaatctaagtcaggtcaatttatctctgtcctcgttttgctcaaccatgatgtgtacgtgcttaaaagggaaattattcatttgaaaatctctatccatctaaatgctggctctaaggtagttttgagctggatagatgacaccactggtccaacttgaacaaagttgtgcttctagatgtctcttcatgtttgcagaggcagatgctaacacgtagaatgtttttataagaatattcttttttctttcttattgaagaaagagctcttagaagaaatattaatcttattaatatacaaccaaataatccaacttttaaaagccaaggctatttgcattaggtgttgaggcaacatatgacatgaatgataatttgcaattgatctagaaaatcaccagtgaaagataagatgattaagtccaaattagctgatgtaatgttctaagctaatccagttaatcagaaagcaggcacttttaaacttccctttgtgctatgtaaatacagtcttttgtaatactaatttaattccttatttacataagcatgtaaatttctatttgttttgactggctaaatttaaacacagaaatatacatacagtaaagcaatcaaaatgaatgaaataaagagtcctatgccttaatatccttaaacggttagcataattgaatggttttcttgagacacttgaacttacaggaattaaatgagaacgatatgtatttcagagttattttaggatggcatgaaacttgaataaattttgaataaaaatttgaataaacgtgccatgattattataagtgacaagtgttagcctgcacatcaagtagaaaaaagattattagatcttttaattatctcaaaatgtgggaaatgtgttaaaactgatggtatataaatttccttgaaccagtaattagtctgtttctcttaaattacctattatgtcttcatttctccctaagaaatagctcccatttccatttacctagtagtagaagactttaacaaggttatatcctattaactcatgagagcagagcttgagcattaactataggtcattaccctgatcttattcctattaccactccccttgaatatttagaaaaatcatttaattgctgtttttaaattttactccaaaaaaggattagcaattttttaatctactcatttccaaaatacaaaaaatatgcagaaaaattttactttgtccaacatggattttgaccaatttccaaattccaggtgttgtctatatttaaggtgataattttaaaatttgttgtaattagtggattgtttgtaattgccttttggggcctccttaaagtaagtcatcactattatcataataatgtgtgacaaaacaattatactgcatatgatgacattttttccatttctattgccagaaaatattttttagctattgactgatttttttagatgttgactaaacagacacaacatactataacttaatctgctgctctgctttgagagaataaatgagtcaagattcttcgcttggattgatagtggttccactggcaattgtaggaaatgcaatggaattttagtgaaggaaaaaattgaaattgtttgtcagcatgtcaagtttcagctgctccacacgattcaaaattggagctttgaccctgcctaagaccatgatgaacagtcatttcttatttgtgccctgttttacctactagaattcaaattctattagagaatatatcatcatttgctcattaaatagttaaatgaatggtccattgtgagaaaactgaggattccttccaagagtttgaaataaacctctggagagctaattcagaattacagggactatagatttcaggttcttaggcatgggcaagcaactttgaatcagataggaatggacaccagttcatactgtagctattttttctacttaaaattgtcttacctgtgcttatatattgattgattttttaatttattatttgttattctctttttagagttggggtcttgctctgtctcccaggttggagtgcactggcagaatcatagctcactgcacccttgaactgggctcaagagatccttccaccccactctctcagttcactgggattacagacctgaggcacagcactcagctctatagctttgatttagtcttagagaaacacagaaaaactagagtgatttcaaatccattgttctattttctcttgaaaggacacatttttctgcacagtgtattctaaatagttgatgatgcaaaagaaaaagaaaaaggagctcattttaaaaaatgggtaactattgccagtatctgttaactactggtaaaattgtctttcaacagagaaaactgaaagtagtataaatgatagtagggaagttttaggaaaacttaatgtagatgtgaaatgtgtctgtttgcctcttactgctatggtgagaatggagttgcagagaactgtaattaactgtccagaacaaatggagatagcaaacattgccaggcaggcaaaaatggtaattacaaactataacttactcactagttaattggaataagaacctacatttgaatcatcttgcatgatttagttctagtctaatgtgtttgctttgtaaagtctaaaaccaggatagtttcagtagacttcaaaacaatgtgtgctctctgtatttttctattaatggtgtttgtgacttcgaaaatttacaggttttaaatttattctgttcattttattatgctatttattctgttcattttattatgctatttgtaattagtcatttatctagaagaataagcacattatggtttgctattattcttgaaaaatcaggtaggttttgttgaccctagaacactttgtaaatgtattgcccatttttgctgaaagtcaggctctttcaggagggaagatgaagattttgatggagaaaattgtttttgttagttttgccaaattaaaattgtgttcaagtccatgggatgtaccaatgtgatatctgaatctttttttttttaagacagagtctcgctctgtcacccaggctggaatgcagtggcacgatcttggctcactgcaacctctgcctctggggttcaagctattctcctgcctcagcctcctgagtggctgggactacaggcgagcgccaccacacccagctaattttttgtatttttagtagagatgtgtttcaccatgttggtcaggctggtcttagacgcctgacctcaagtggtctgcccgcctcggcctcccaaagtgttgggattgcaggcgtgagccaccgcacccgaccctgaatctttcacaatgactttgaacttgaatactagtattaggctgattttttcctatagcctcatttcagatttggattaattaataaggaaagatatcattccatatagcgcaagaacttcaaggaaagacgctatcacctggtttatgaaaacagcaagtggatgggtctcaagcaatatttaaaaattgaaaatagactaatttatatttctattacctcagttcccagaagggatatcacattgactaagatatcaaatgcttgtcacttattctctcaaacatgcattgcttttaagaaacttaaaacattaatgcaagactttggcaacgttgtaaatgtgtcctcagtaaggaggtaaatgtatattccgctgagttaagacagcatacttcggccaacatgaactataaaaggaaagtaatagttttgtcttaaaagtgatgtaggtatgattgaggggatagttgttattttgtctacccagtgcagaagccgtgtggccaatttgatcaactcttaaaaataaagtaatagagacacaagttttaagctgttttgtataaattaatgcttgatatattttcaaggtagatattaagtaccttagatttttttaaccaacatatttaagtgtatactgtagagtatccagtaagctctggtacattactctttgtagcaaacaaagagtacatatttgtttgatatatgaaatacactggtacaaaattcaagaatgaagtgatgttctgctcttaggattggtaatgccattctatgtaaagttattctgtatgtcagaatttcatcttatgactgactcaatgtgtttattgtgtggaagaatagagaggttcattttagtgtataggtgttgccttgtacgattagaggcaaatatctgatttacttaggaactaaatcagagacacgttgggatgatgtgttattgggttgcagacagaagagttctgagttagactgtgttaaacttatcagcatgggttaatctacagaagtttgtaaccagctctacagagaatgaaagaccttcagcctcactttcaagtagagaattttagaatcacccttgggccctgttttgttaatggaaatgttcacagatccagctgtcccttggcaaaattgaaaagtagataacatttaatgccctttacttcaaagggtatgacttcttttcccaaggtgctcactgagtcattgttgatcagaaacgcctcagtgttcagaccattactgatggccatcttcatccaaatggtctattttctcaggcctttgttttctgtaagtgtcataattagtaataatgctcatattgataaataatatttttgagtgctgtgtgttttgggttagtaaaaccctgttaaattctcactggttcccagttctggaatcactttgaagctatattctgagttgtcttgtcataacaaattaacagatgtaatctaatcattctacgcaccttctaaaagtaagaatttttgaaatgaaatgtaacttaatatttccttcattctaaactgattcctgtttattttagcaaaatgacttcaataagttaaatgggcctgtcgtcgtttatcagaatgagccatttgcttgtatttgaaaacatgtacttacggaaagatcatttgaatgagagctctgagttttagacccacatacagtactagctagttgtgataactacattaagtcaattcacctttctgaactttagtttcattattgggataaaataaagggttttctttgatcatcagttttcttaaatttacaactaattcttaccttacaactttagttgacttaacatagttatctttcctctttagattttctttcttaacagtccttggacacccaatacttttcccgtgaatcatccatccaatcatttgataaacactaattgagcacctattatgtttcaagcactgcatgagatgctaaggtcacaacagtggaaaaaaataagtggcccttctgcagcttgtagtctagtgggagaaaaaaagattaatgaaaaaaatcagactatttaatgtgaaattacaaatgtgatgcatgctgcaattagagaagagtgtggtcgcatgataatgaatacagagaaattttcaaaaaagaaaggtaattgctaaggcaagtgttaaccagtgatgtgtctgatggatgtgtctgtgttgatatttctgacaaagagcaaataggagcaaggtgtgcaaatagattagagatcaggtaggagtcttgtaaagtatcagttttatgatcctgtctattctctgcagaaatgttgatttagtgtttgggacaaaatctaactctcacgggacttataatttagaggagcaatctaattaacccaaatttggttatccatggctttctgtgagctctttcaattacatttagaagaatagtatgggaggaaaatccacaaattctaggcatggttccatctggatgtgtttgtgtgtagagattatttctggtgccatattagtatctactaatatgtattagtatgtatggctacctgtccttatctctcaagtctgattctgttcagcataggtaagcctttttctgaacctcaaggagtgctttaagcagtgggacgctaggagtttcttgttcatgggttagtgctaatcagtttaacaaatatttggagaacctattcggtgtcaagcactgtgctggcaataaaggctatgtagatgattaaggatatgtgaagttcataatttagtaacttcctaatttaataagctcaaagtctaattatttagcaacttccactatgtccttgtatgtggaatttgagaaaatacggaaatacttagtcttggcttttagaaataatcacagaaaaacaacatggagtagttatttataaaataagatttaatttcaaatggaataatctagctatgtttacatttctcaagaaaaatagaattgttcccttagaagttttaaaagcaggcactatctgtcaaagttttaccatggctgaaatttttaacattgaatttagtactttaaattggtgaaactatgggaggtaattcatatgtgtaattagctagacttagtcattccacaatgtatagatacttggaaatatcatgttgtacatataattttctctgtcaattatgatgagtgaaggaatgaatgaataagtagataagtggtgtctataatccctgagtaaataacatacataagtgaagcaagttttttgtccctggaagttttggttgaatgagtaaatctcttaagtgggtgaggaagtgcactaaatccgaatgtactgaggttgacttgggtctccgttctctgaatactcttcttctgcattacagcagtagatggttctcttacctaatactctttcttcatgtttttttcctaaccttctttagctatcatttcttaaatctatttacccttactctgtcagaaaaaaaaaaaagccagcacatatacacaaggaaaacatcttcttgcccccagtagagtagacctgacctgtcttagaggaaactagtcatgactctgttctgtcaagctctgacctaagaggtaaagtgagaagaatgttaatttataatattgaaacaacagttttgcatactttttcaggtaaggaggctttggttcctgtaagtcaaaccaaagagacataacttaagaacactctatgagattcctctgggagttgggacaagagctctgagtacatgcagaaggggtcagtgctgtggtcaaagatacttggccttctagaagaggcagctgtgcaactctatgagtgtagaagagaactacaggtatagccaatacttggcattaccataggatgtgtcaggattaactagaaggcactctcaaagccttccagtaaaataaccaaaacatcaggagaaaataagcgtaagaaagatgttgatgagaggcactcagaaaagggaaagatattttgcacattataattgagttttaaatcatctagtggaattaccccttaaaagggaattttatatcatgtaattttatctaattatctacttaaacatgggagccaaattcacttatccacagcctctaatgttcattttaagtgtgaaaataggcaacaaaaaagtaagcatatgagtacaaactaaacaatttccccgtaatattttggtagtacacatcactgtgagccaagtgtggtggctcaggcctgtaatcccagcactttggaggctgaagcaggaggatcgcttgcagccaggagttcgagatcagcgtacgcaacataaagaaatcccgtctctacaaaaaatttaaaactattttttaaaacaatgaaacattagttgggcttgttgatatgtgcttgtagtccagctactcagaggctgaggcaggagaatcacttgaacccaggaagtcgaggctgcagtgagccaggatcatgccactacattccagcccaggtgacagagtgagaacctgtctctaaaataaaaagaaaagaaaacaacaacaaccagcaacaaacaaaaacataatcttgggcacatggaagatctctctttctttctaattatattcctgctcaaatattatgttaaggattcaatatttatttttttattgttcatgaaagtgttttttattgttctaagattagatgtatccaagtttattctttcttcagcatttgctttttcttgacttcatgtcagaaattaaatacatctgctttcctagtagcagagaggatttgaatgaagatcgacatttctggctgtcctttctgaataatgtttccacttgaacttggcagtttaacaatacttccaataaatagtgccatagaataattcacttactgtttaatgccactgttttaaaatctcctgctaccacctttctccatatatggtcttccctggatcatattttgtatttgtgagcactctgattgaaagttagtgtgcggaaaatcttgagctattcaataaatacagtttagttaccaaaaacttaggttcaggtatcagacattagattgtagtcccagtttctaccaatatccaggcttgcttagagcttttcacacactgcatgaaccttatattggggctgatagtattatatagagcctggttatctttcaagtgatccccaccctatctccctgggggaaatctctgcatttattctgttgttctggctaccaaaatcccctttctctgttttgattcagcatttctccctttacattggctcacttcatgtggtcctggaggagctatcaattaaggtgttgccatccccaaagggtaggcacaggactcaagcttggccacttggattctcttacttctcaatttggttcttaaagtgacacacaaggatgaaaacaattggagctgcatttttctttaaagtgactgtccattgatttattaggttgatgcaaaagtaattgtgttttttgccattattttagtggcaaaaaagacaggacccagggaagttctgagcgctacgtttcacattattttggttcaaaagtaattgcaccaacctaataaaatatttagcactcagaccttccctggttcctgtctttatgtggccattttgttcagttttcctgtgattctgaatcacgcagtatccttccaacaaatcccttttatttttgcttaatatggaatcatattcaagtttgcctaaatttctgtggtttataaccaaaggattatagcagtattgggggcccactagactggaattatttctagtctttaaaataggttgattgttttgtttggctaagggaacaaccagataaattatatttttgagatctctgaatctgactttgcaattaaagtgcttggactgaatctagatcataatttcgaagttcagggagaagaaggtttctgcgggtatctgctggatacttttcatcttgggtaggctatgcaacctgctggatggattcctgtagaacatcttccactgtagctggcatgtgtcttgtctaatgggagtgctatgctgacatccaagctctctccatctgtgcttctccatgaatctctcctttgtttatttctattgtaccagccatgtttgtgctggctccttgtccatttcccaatttagtgaaattttcaggatagcttacatagtatttgttatttggcaaaagggcttggcattcctttagaactgatgttattaacactttggcaaaactccctttctttattcaagagggcagaacagagtactctttatgtgcaagcaaattcacccaactttagtttctttttttttttttttttttgtcagttttggctcttctcaagcatctatacaaagttatatcttgaccaaatatgggcacagatgttcttttactgtacagcaaaactgctgatcgtgataagaaggtatctgtgggtaggttgtgtaggtccaggaattctttgtgatttcatgcagcatttgatgtggcatatacttttataaaaagagtcagatattatgagattttcaatgtttaataaataaaaacaatttaaaccacaaataaacaaaaaaatacttaaaaacttgacttttctattaggctatggaatatttaatgtctgaatccgtattaggaatgaatgaatctctatccaggcctgaggtcattccaaatttgttagaatagaagtgggcagccatattccgagggataacatgctggatctctgttatgccaccaatttaaatacatgccagggaggtgtagaaaagtttcctggggcactcagaataatcctatccctggtgtcactcaactgcctttggaggcattgcagcataggttcttgtgctcagtttcatcaagtgccagctctgaggagcacaaattgctatctgaacacatctaggttatatatgaaaataacatttttctgtcattagagagctgtatcttgagctgtttgctgatacaaggaatgagtctatgtttatttccctacattcttttgtaccagttccctagggttcagaaaatgtataggatttgaagtgagaagaactaaaatcaatttaagcttcactaatttaatagtggtgtaaccttgggtgaaacatataagcactctgagctttaattccttagtctgtgaaatggggataatgatgctatccaaatcccacagttactctgatcatcaaatgaaatcatgcatattataaaatgtctttttgagttattaccagcagatggtatatcatgcattttgaaatgattagtcaagtctagaggtcagcgttgaattatgaatctaagtccttctccttcttgaatgaacaaactaaattacaatgccaggtttgctgattatcagatcctgatgcttggcttataaatcagctgtaaggctatatacctatttctgtttttcaaagatgagtgcatttgaaatccaataactagaaattttcttctgagacagaaatggatttttagggtaagaaaggtcacatttcacttcatttttaaattttaatctcaatttctgaagtccctaacttctaacaaatcatcatgtaggtcatactctatccttctttaaaggaggagggaaagtgcgcattgttagccatcttgaacgtaccaagtcctgtaatatgctcagcacttttcctgagtgctctcactacatcctcactctgccaccatcatctctttccaatgtttgttcccatagaaccctcctttttttatttctttcagttctttccttttatatgtaaaacaaagaagatgaaggaaacattttcttataaattaaagacaaaatacctcccctgtagcccacatatctgtaagagttcaatgaaatcctaggtgacaactcttcaaagaaaaccccattgaagagcattgtttgggtgttttgtgtaaaatgctggtttgtttgtagaatgtcctcaggagagctgcactgtcatccctgtcttattgcaatggagctgtaggaacttaacctcttcaaattgcattgaccttctctataacagaacattggcctaagccaggtctgtatccttagccagcctttgaatcatcaaattctgggcctttgcctacatgtaactgttgtgaaagcaatacatatgcacctggcttatcagctgagacgtcaatcagtcctctaattctttaacctcttctcttttgcatctgggtaaaaataaaaaggtaggaatgtttgtagagtacttgaaagagctttatttttctttacagtgttcatggtaaaatagtagttaaaaaataggaaatcttgaaagagctttatttttctttacagtgttgatggtaaaatagtagttaaacaatagaaaatcagttatttgaaaatgcttgagaattttaaacaaataatccagaatttagaattgatatttcacagtccatgtttaccaaaaatattgctgggttcattcactgttgtttgattaccaaaagaacaaaagtaagacagaaagattacagattctttctttagcaaagtttatttattgggataatcactgctttcttataaagcggagccctgttaggataagaaagaggtggctctaattatttcagggcctcataacacaaaagatggaaattgccttagctattccattcttattttgctgcctagattttaaaggtgcaaagaatctgattaactggcacagacctcttgacacaccaagcatatggaaagaattcaggcttgtcaaagatcagatggttgtagacatgtggcattatttctgagggctctgttctgttccattggtatatatctctgttttggtaccagtaccatgctattttggttactgtagccttgtagtatagtttgaagtcaggtagtgagatgcctccagctttgttcttttggcttagggttgacttggcaatgcaagctcttttttggttccatatgaactttaaagtagttttttccaattctgtgaagaaagtcattggtagcttgatggggatggcattgaatctataaattaccttgggcagcatggccattgtcatgatattgattcttcctatccatgagcatggaatgttcttccatttgtttgtatcctcttttatttcattgagcagtggtttgtagttctccttgaagaggtccttcatgtcccttggaagttggattcctaggtattttattctctttgaagcaattgtaaatgggaattcactcctgatttggctctctgtttgtctgttattgatgtataagaatgcttgtgatttttgcacattgattttgtatcctgagactttgctgaagttgcttatcagcctaaggagatgttgggctgagacgatggggttttctagatatacaatcatgtcatctgcaaacagggacaatttgacttcctcttttcctaattgaataccctttatttccttctcctgcctaattgccctggccagaacttccaacactatgttgaataggagtggtgagagaggacatctctgtcttgtgcccgttttcaaagggaatgcttccagtttttgcccattcagtatgatattagctgtgggtttgtcatagatagctcttattattttgagatacatcccatcaatacctaatttattgagagtttttagcatgaagggttgttgaattttgtcaaaggccttttctgcatctattgagataatcatgtggttttgtcgttggttctgtttatatgctggattatgtttattgatttgcatatattgaaccagccttgcatcccagggatgaagcccacttgatcatggtggataagctttttgatgtgctgctggatttggtttgccaatattttattgaggatttttgcatcgatgttcatcaaggatattggtctaaaattctctttttttgttgtgtctctgctaggctttggtatcaggatgatgctggcctcataaaatgagttagggaggattccctctttttctgttgattggaacagtttcagaaggaatggtaccagctcctgcttgtacctctggtagaattcggctatgaatccatctggtcctggactttttttggttggtaagctattaattattgcctcaatttcagagcctgttattggtctattcagagattcaacttcttcctggtttagtcttgggagggtgcatgtgtcgaggaatttatccatttcttctagatttctagtttatttgcatagaggtgtttatagtattctctgatggtagtttgtatttctgtgggatcggtagtgatatcccctttatcattttttattgcgtctatttgattcttctctcttttcttctttattagtcttgctagcggtctatcaattttgttgatcttttcaaaaaaccagctcctggattcactgatattttgaagggtttttttgtgtctctatttccttcagttctgctctgatcttggttatttcttgccttctgctagcttttgaatgtgacaaacctgacaaaaacaagaaatggggaaaggattccctagttaataaacggtgctgggaaaactggctagccatatgtagaaagctgaaactggatcccttccttacaccttatacaaaaattaattcaagatggattaaagacttaaatgttagacctaaaaccatgaaaatcctagaagaaaacttaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaaactacaatgaactcaaacagatttacaagaagaaaacaaccccatcaacaagtgggcaaaggatatgaacagatacttctcaaaagaagacatttatgcagccaaaagacacatgaaaaaatgctcatcatcactggctatcagagaaatgcaaatcaaaaccacagtgagataccatctcacaccagttagaatggtgatcattaaaaagtcaggaaacaacaggtgctggagaggatgtggagaaatagggacacttttacactgttggtgggactgtaaactagttcaacccttgtggaaggcattgtggcgattcctcaggatctagaactagaaataccatttgacccagccatcccattactgggtatatacccaaaggattataaatcatgctgctataaagacatatgcacacatatgtttattgcagcactaatcacaatagcaaagacttggaaccaagacaaatgtccaacaatgatagactagattaagaaaatatgacacatattcaccatggaatactatgcagccataaaaaaggattagttcatgtcctttgtagggacatggatgaagctggaaaccatcattctcagcaaactagtgcaaggacaaaacaccaaacaccacatgttctcactcataggtgggaattgaacaatgagaacacatgaagacaggaaggggaacatcacacacctcggcctgttgtggagtagggggaggggggagggatagcattaggagatatacctaatgttaaatgacaagttaatgggtgtggcacagcaacatggcacatgtatacatatgtaacaaacctgcactttgtgcacatgtaccctaaaacttaaagtataaaaaaaaataaaaataaaaataaataaaaaagaattcagaattgggtgaaaaagatatgtcaggtctttttctattcccaaatagttggctaaatgagctatctgaagaaaacgtgtgtgggaatttgtgcttgtattcttgctcataattctgcttgtgtgtataactcaataatcttagctagctgtaaaattatttcatatttggttggcttgctttgtatcatgagtacagtgtttcagagatggaaagtccttagttgcagttaaagattttgtaagtaccactccctaggacactgattaaacttttacactaggtttgttaaggaggtaatccttctgcgggtcatgagtgacctggttgagagaaaagagctgactgggcacaaatccacttcccaccccagtactctccacacagtgaagatgactggaatagccaaactgatgtcgatggagcactttggaaaaggaaggctagagctctttcaattacaccatcgaagatgttctccctgaccattaaatgcttttgacagtttccatgtctatagcttacagtttattctgcttttctaataatgaactcttctttctgttttaggaaatacaaaggtaaacagttaaacatgtgtaattttttttaaacttaaataactccatgtctaaaacaaggaattgtgaatatactattgagagacagcaatttaatgattaagtgtatgggctgtggagtctgatagtccagattcaagtcctagctttgtcatttactgtgtgactttatgttacctcatctgtaaaatgcagatgacttatagataccccatagagctagaacaaagattaaatgagacggtacatgtaaagcatttaaacaggacctggcaaagtgttaatgctcaagaaagttagttattgatattgtcagtataaatgtatcacaagaagtgcaattgccacacaatatacctatttatcattaggttttactttctatgtgaaagaatatacgcatggtctgccttggtaattagggactttcatgataatatttttaaaaataactacagttacttaagctggaaagaaccctgggcaagggtgtggctatgccatgcattaatgacaaactatcaaggaatatgtgcagcattctattaattttaatggcatagatatataaaattagcagattgccttgaaatattttttaaagcagtcacttttatcttgtgagaatgactttttttaaaaaaaaaaccttaaatcttttgctacagccaaataatctaatcactcttgtggatatggccaacagacataaatttttctcataatagatctttctcaaatgacagaaaactgtctcagtacttccatactgctattattttagctctcttcattcccttccaattctgttctgttaattcaatgtgattgaaaagcattgacatttattcttacagatctctttacccaaactgaccaaattagaaggcatttaatctaccttgtataaaagtggaagcaatagaagggggaaatgagttgtttttaaatcccattttattattacattattacaacggtattgctattagctatattgatcacagctgacttcatggctgtgtgttgaccacaaaatgtaatctaaagggcatttcagatttcaaatgactttctagagtatctgagttaaaattgttaacactacatgacaactgctattatttcagtgtcagccaaatataaaagaacattaatattcattagtaatgttacagctggtgactccttaacaacattgtaatgatttgaatagttatttcaaacagtgtgttggaatatacacacaataagccctgattgacacaatgcattaaaaaacaacccagtaatgtcaaggaaaaaaattaatatgtatgcctgtatattaggctaagtaactaaatgctttagaaatacacttcagctgataagacctaccagtatgcaaggagtgactaatttttgaatgtgttacatgggggaatcatcatggtaaatatctgaaacacaaattcaagtctcaattttatcacttaagttcaatgtcactgttttcatttctacaaattaagctttgtgtcattaacgtatctgtagaggtagtggtaaggataaaaacaggacaaatttaaggttggtagcagaggttataaaatagcactaatatctcttttcttttttattttttcattcatgtgtagagatggggtctcactctgttgagcaagctggtctcaaactttggggcttaagcaatcctcctgcctcagcctcccaaaaggctggattacaggcaggagcctagccagcagtaatatcttctgaatacctaatatggtccacacacgatgttggggttttgtatatgctgtatcatctcattagggaggtggcttcatctccattttatacatgagtaaaccaaaggcaaaacaggtgcacatgactgaacaatgtgaaatcctagtgttaggattaaagtccaagtgtggatatcctttgaaatataacaagatgcttctggagtttgttcaagatgatgcactgtggtgagtgttattggggttgaagttgggtgggagacctagaacctgcttttaaggaatttctcatctcactgagatgataagactgagatgcaggaagcatttaatatggaagtccatagatcaattgacagcaacagcataataagagcatttattctttgtgttctgaaaaagttaagttataccaacctccctttcctttcactgcttttttgtaaacgtgatctgtgaggaagaaaaattgacctttcctcattctatttttttaggaatttaccaataatattattttaattttgattggcaaataaatatagtatatatttacctgtacaacataatgtttgtatatgtatatgcatagtgaaatgattcatctgaactaattaaatatgtataacttcatatttctacgttttccttggtgatgagaacatttaaaatctactctcttagcaaatttcaaaatacaatgcattacagatattgtggatttggttccagaccattgcaatgaagcgagtcatatgaaatgttgctttctcagcacataatgaaagttatgtttatacttaccaaaagtattataggttcttaacttttaaagtataattttcttgactttctaaacaggtctacaattttaattattttcttcaagaaatgatctgaattatcaaattttgagaatattgtacattttaaaataaaactaattttgtatttcctatatgattagagaggtcactagtaaataatcattgcatatgtatatacactagaatactaatgaaaaaatgagttaaatattatatgcctttccctgcattgtactatttttttttttttttttgagacagagtcttgctgtgtcgcccaagctggagtgcagtggtgcaatctcggctcactgcaacctctgcctcccaggttgaagcaattctcctgcctcagcctcccaagtagctgggactacaggcgcccaccaccacaccagcttatttttttttttttttgtatttttagtagagacggggtttttactatgctggccaggctggtcttgaacttttgaccttgtgatccgcccacctcagcctcccaaagtgctgggattacaggcgtgagccgctgcgcctggcctgtattgtactatttgtaacagaaatttttaagtgtttcattatatagtttaaaaatgagctgaaatatactatttagtatacaataatgcaatctttggacacaagatgttgctagactcctataacatttacgacattcactcttcttggataaaataaggcttgttgcgggggatcaggcctgaatgcatcatcaaatatacaccaagattcaggaatttatgaaacacccagctaattccactggattttactgatcaaaaacacaacttaaaggaaagactgaaacattagactacattaaaattaaggacttctattatcagaagtcacaattaaaatgaaggtacaacccacagattgggaggagctatttgagtgacttacttcccacaaaggatcatatacagaatatttaatgaagccctgcaagttggtatatgaaaatgataatatgatacaaatgaacaataaacttgagtaaatactcataaaaaaagaatatccatatgctcagttaacatatgaaatgtgggttaaccttattagtcatagtggaaatgtatattaaacttataatgaaatatcagtaacactacaatggttaaaatgagaaagactggctctaccaactgctggtgagccactggaactcacatccattgcttaggagaatgtaaattgttaccctctcttttagaagccatttggcagtatctattaaagctgaacacataccaacagaaatgcatataggtagcaacgatcatagtcaagaatattcaaagcatatctgtttataatagtcataaagtagaaacaattcaaatcagtgatggtcgaatatataaattaactgtggtgtattcatacactgaaatactgcacagcaatgaaaataagcaaattgctatgcatgacaactcaaatgaactaaaaaatagatattgagcaaaactgtcagtcataaaatagtatatgtcatgtgattccatttatacaaagtaccaacattggcaaaactataatccagtagtcagaataggagttattttctttgggaaagagggtggtggtaggactgtgaggggacacagagagtacttctctcattctaattaattttttttttttttttagtttttttttttttattatactttaagttttagggtacatgtgcacattgtgcaggttagttacatatgtatacatgtgccatgctggtgtgctgcacccattaactcgtcatttagcattagatatatctcccaatgctatccctcccccctccccccaccccaccacagtctccagagtgtgatattccccttcctgtgtccatgtgatctcattgttcaatttccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaagagtgttcctatttctccacatcctctccagcacctgttgtttcctgactttttaatgattgccattctaactggtgtgagatgataactcatagtggttttgatttgcatttctctgatagccagtgatgatgagcattttttcatgtattttttggctgcataaatgtcttcttttgagaagtgtctgttcatgtccttcgcccactttttgatggggttgtttgtttttttcttgtaaatttgtttgagttcattgtagattctggatattagcccccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatatatgcacccaatacaggagcacccagagtcataaagcaagtcctgagtgacctacaaagagacttagactcccacacattaataatgggagactttaacaccccactgtcaacattagacagatcaacgagacagaaagtcaacaaggatacccaggaattgaactcagcgctgcaccaagcggacctaatagacatctacagaactctccacctcaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagagctcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagaacaaacacattcaaaagctagcagaaggcaagaaagaaccaagatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctatgcaaataaactagaaaatctagaagaaatggatacattcctcgacacatacactctaattaatttttatttctttgtctgggtcgtggttatactagtgtgttcactatctgaaaatttcttgagctttatacttaaatgtgtaccctttgtgtgaatgacctgcttttaaaaagtccttattaaaaaaacaattgatcacaaaaagaataaaagtaaggatgtgactccagggtcaccacctaagtaagatattgattagcctccctgtagctcaaagaaaggcagggagtttattccaaacttaaaggcaaagcatggtaaatatgcttcttaaaagccatgatgtggcttccaaagacttgaagtcagtctgaatctgtagaatatcaaattatgtggcaaggtggcaagtgctgatgccacagctgcgaggcatgtaccgaagtcaataaggagaagggtgacctgctttaacagattttaaatctagatgaatctggactgtttcaggaagagatggtcaagagttgtacatcacaaagggatgagtgtttccaggttttcagtcttcagaagactgactcaaacttttattgctgggaatttatccaaagacttaagtctaggcactgcagacttttacataaatctgagtttctcggcctcagcactgtgaacattttgggccagataattctttgctgtgagaggctgtcctgtgcattgtgggatgtttaacagcatccctgacctctacccaacagatgtcagtagtatccttcccccagttgtgacaagtaaagttgtctctagatattggcaaatgcttcctgggaagtaaaactgacaccctgcctcccatgagacaagttggaataaatcgatttatataaataagtaaaataaataactttaggtttatactcaattatatatattttataaaggcatataaagtatttaggttacattaacaaccaagaaagacaaaatagggaatcagcagttttatttcgttcacaagtcattcaaagacaataccatttatagtactgacacccttacttattactaatagacctaaattattctcaaattttaggtggatcatttttatcgataaagaatgagaatgatcagcataaatgggcaaaagtctgatgacaagttgcagcatggatagtgtggtatatccaaataatataattcatggttgtgtctagtagtaaaatcagaatgagacacgtgaaatcttagtactattcaacctgaaaattttttgctcatttgtatgaaattagcggctacagtaaaattcctgtttatctgcttgtttcaaaatgacttgacctggaatttcaagcatgttactaaattgtccttacctttctcctcctctgttgaattttaatattgccatttttcgtcacagtcttttgcttagcccaattcttcacacacaatgagtacccaatcaagttccaatcaacgcaggatattttcttgactcctttgtgaaactcgcaacaggggtcccctgtttatttagcctggcccactcaaccccttgcaggagggagtacaggagcaaatgagggcaggaaccggccgaccactttggtgcctgcaggagcaaactccatgtgggccccgtggcagtgtccaggtgggatgctaaggccccggagggtgtgttaaaatgctctcttagctccactgtccacagacagcattgtgttatcagctcagtgggccctttgccttgtcatgtggggcagctgccttctgccagggaggtcaaagggccagtgtgacagtctttttgggtacctgcacttggtgcaacctgaattcttgtctggtgcccaagaggaatggggtcacgtggatgaattgaaggacggtgaatgcagagaattttattgatctgtgaaagtggctctcaggagagaagggagctggaatgctggaatggggatgggaagggaaggtcgctctcccctgaagtcaagccacctctctgcctctctcttctgaagccaggttgcctctttccaatgtctagctgctgtctccgaagtcaagttgcctctcctcaatgtctagccatttctcctctctactgaacctgcagtctttataggcacaggatgggaggtggagtgggccatagactgttttggaaaagaaaacattcaattggaaaaaaaaaaattcaaaaagaacaatcgggagagagcaggcacacagggatagaagttcccactttgggccatgggtttcaagctttttggcttgaaggtggggttttgccagggacccactgctttctgcctagaatttctctgcctcctgtcgctatcacagtgacactgcattatggaaggataaataagaaggaaaaagacacaaaggaatgaatacctggtgggtacagactgggtcttgggactgaaacaccttctagctgcaaattttgtcaagtcaatgaagacctgtgttgactatgctgatgtgacaattttttcaacaaatgatttttgactttccattatgagctcagtgcccttccaagcactggaaatataggatgaataaaacagaagaggtttgtacattcgttgagcttatattttagtgggggaggtaggcaataaacaaatatacaaaaataagttatgagctgagaaaagaaccataggaagaactattgaagaaaattaaggaacctattttatagaaaggagaatcacaaaaattctctctgaggagagattgtataaattgtaaggtggaaaaaaatactgtttttttctaccctcctaggttctacagctaaagccctataaattagactgacaaatgacaaattaagaagagaaaagcatgcaaaagaatgtaagttttacacaacacaggagactttctaaggaaacgaagatcagaagaaacagttacaactgaatgtttttacacaaggtttgataaagagtggaaagttgagaaatgtggtaggacaaatgggtttgaactaagagcagtaaactgggaaaaatttagctagacctatttgttcaggttcctctcagtggccttctgccttcagagataagtgtttctctttcttctgggtatgggaaaggaacctctagggtagtagcagtggagatagagaataaacattaaggaatgtgtacctgagggggtgtcaacaacacttgctgatgacctggatctggggattgcgggacagcaggcgtcaaggatgacttctaaggtttagcttaatctgatagtggtgccattccccaagattgacaagacagaaagatcagaaaggcattgacattttccatcttcttctgtcttcgtgaacatgcaaatcagttatttaaagtctgtgtcttatgactgtagtgtttggcccacttataggtctatttctataatttatttttttcacttgggcttgtttcctggcatgcctaataatattttattagattttgactaatgtatatgggaacactgaaaaagttctagtgaatgttttcttcctccagagaggattttcattttcatccagaaggctgttagagaaagaacaggtcagtctaacccagctagggattgagctgactcaggcctgggtttccattttcataagttctgatctatttctgtttcacctttattctcatgatgcagccctaaggaacctctggttaaagtctggcatgtgtgcaagggttacttcctacttaacaggacctggaatctttgtttttttgagacaaagtcttactctgtgccccagactagaatgcagtggcgccatcttggctcactgcaactctgcctcccaagttcaagcaattctcctgtctcagcctcccgagtagctgggattacaggtgtgcaccaccacactcggctaatttttgtattttttgtagagatggggtttcaccatgttggccaggctggtctcgaactcctggcctcaggtgatccaccctcctcagcctcctaaaatgctgggattacaggtgtgagccaccatgccccgcatggattctaatttctgtcttcttgaaattgtgagatggcctaagattcttctaatttcttagtctttagccccaattttctgctgcttgttcaatttaggattatcaaaccacacaatgtcaggctcacttatctctgctttccttctcttctgggtctagagtcttcaacatgagactctcttgtagcattgacatcctgttagcatagtctgacttgtctcttaaatagtttgctccattatcttcaatataaaacatgcattggagaggtagcatatagagctgagaatccgggaaaacagatcctttaaattgccacattccagtgggagataatgaggacctgaagtagggcaatgagcttaaaatgcagaagaggaaatagaagcaagaaatacttagggggtggatttgaaatgatggcaaatggaaaatttagctgtcagtatcgcttaaatattatttctgtgtcaaaataagaatgacatattggctcattaattctgtgttcctcataattttaaaggctggtcaagaatgactggttgccaaacaatataatctactctttgaaatttctcatggttctgctattattcttagctataaggatttgaaggggaaatgtattttaatctgctttcattgttcaaaataagaacttgcttaagttagagcctttatgtgagtgatcattttgaaggaagccatgtgctctgtaattcagaaagcatcgaaaatatttaaaaccaatcttccattattattcagataacaatattttatggaagaagtttgaatcattcaacttgaagaaacactgagctgggttggtaatatacatcatttaacaatgcatttgatatgtggcattttttctaaataaataatattataagaggtagaagagtgattatttttagtgcctgctatagaaccaggaacccaatggtgactgctgtaattacattctcatttaaccttttcaacaacctataagtaaggtagatatttcccatattttatagagccaagtctcaaaaatttgggataacttgctgaaatcatgcaattagtaaatggcaaaaccaggactgaaaactcattccattttgttctattccatcttctcctcttaaggtacaacaaatctaagaactttcttacattttgagaaacacttggaaaaaaacatgaggggggaaatctgggccagaattttagatttatttaaagaaaacttttcattactcaataaaataaaaataatctcaattaaattctccaagtcgagcaatatttttactcatgagagtagaatgctgctcattctcttattaacttgaatcctgaggcatctcattatatattttctaaattcttaagtatgatctcatcccctgaaagtttagtgtacctattgtcatcatttatataggaacagcaaaaccagctattcaaaaataactcaatcacctttcttttatttttttcctgaactgggacattctacttcatgcgacagctaaattagcagaaacctgacccagatgatacaatgactagatgagttcacagctggctgtaatcttatctcagaaagaaacaggaaatttaccagttactgtatttctactctgttctaggcacttagtatttaactatctcatttaatttttacaacaaacctataaggtgcatgctatatttatagatgatttagttgatatccagagaagtcaaatgacttgcctactatattaacaaatcctggtaaggagtagttcattctcaaactaatggtaaaatcttttgagcctaaagaactccaatatcttggttaacatagatttagacaagtcactagtgagacactgtactgaatttttaatactacattatttatataatatatacaaattaaatgtatattgtgtatatacatatatggatatacatatagagttatatatatgcatatatatgaaatatatattaaattaaatagttggcttttgcaatacatattacatatttttatatattatatgtatatttaaattatataggataatgaatgtaaaatagaatgaagactctagattatataaagtataaattaatctctaaatttcatcaacatgggagaaacaatcactacgccagtctgtaaattgcatgaggaacgcagggcagtctgtactgtatacagttatcatcaatgtctagcagagtgcctgacacaaaaatgcataataaacatttttagatgaacaaataattgatatgattaaaacccaagcaaaactcccagattatctagaaattcacaatgatagctagaggaaacctggtatccaaagaaaagaaagttggaaataaattaaataatatagataatactctacaatcctatgaatgatttttgcatattgacctcatgtttttcatattcatgaaatagccggcaaaaagaattagagggaattgtagaatgaattatgtcatacatggaagaattttctgtacattgaaagtggttagtacttggatgtattacttatgaaaaacatgcagtcttctttagacatatataaaattaggggaagatatttcaacttaggctagtttaaggaggttttaatcagaagctcagtgtgtataaggaaggaccgcacttggtttgctgattattaaaactgcagtgcctcctgggcatggtggctcacgcctgtaatcccagcactgggaggccaaggcgggtggatcacctaggtcggggttcaaaaccagcctggccaacatggggaaaccctgtctctactaaaaatacaaaaattagctgagagtggtggcatgtgcctgtagtcccagctactcaaggaggccgaggcaggagaatcgcttgaacccaggaggcggaggttgcagtgaggaaagattgtgccactccagtttccagtctgggtgacagagcgagactctgtctcaaaaaaacaaaaaactacagtgcctagaatattgtccgacacatagcagttacttactatatagtaaataaataattgaaaataaactaagaaaataaatgttcccaaaaatgcctttcaaccctgtgatttatatgaaaggtgaaggctgttaaattttgtgcattggattttgactaaactgttgggccacatgagttgtatttaaaattaattgctgaaaatacctaggattaagcactgagtctactctctactggcccaaaatacactttaaaacaatacagaacgtagccaagggaaaataacacttctgaactaagctttaacctttactcagctgatttagttcacttctctttgcctttaatttttttccatgagaattctaattgtacaaatagctttagcatctgtaaagtggcaaagatcaattagagagatctataaaatactttgagcttcatgaagaagaattgtctataaatagaacttggcacgtaattagtcatttcagtactgtaaatgaaagtcgtgtgaataatttttttaagtttctctttttatactcttctgcatttaacataaggctgtgaaatcctttagggcactttaatatgcaaaatgccacaacttcttttttctttgtaatcatttaattaatatacttctaatacagcatgggagtcagaaaaatcagcttatagccaacaaattgagccttaagagaaaggaattttcaatccctttttggattattattttcagatattcctagttggatccactgcttttaaaaagatcagaagaattcatggctgtatttgttaattctgtaggtctagggcaatgagtaattccgggaaatatttaaatttcacattagtatataaccattaagctttgggaaatgttaatatgacattgaagaccatgtagaatatgatcatgttttgtgtttgacacattttcccaaattgggagtatttccttttcctttttcccaacaaaactttacaaccatcacataggtattcaggcagaccaatcataaaatagcagagaaaatttaactttgcttttgaatagtttagagggctgtgattgaagacgttgcttggtaatgaaattgattttccaccttcattgtgggaattagattaagaagaaagcagtctggtgagataagaataactcagtctgattcttccaagtatatattaataattttgtgtggcctttgctaccatctttaacattttcatcatgttcaaatacttccttcttaaatgatgttttggggacagtgaggggtgtatgtgaatgagggtgtgtagaaatcaggtgaaaataataaaaatgtgttcattgtgaatcagtttaagtctgagatttcactttaattgattgaaatcatttcctttagcctcatctccaaacaaaatattggtacaatgaaaaatctacctgcttttttttaaagaatattatgtcagtgtcaatcataggcaattctgaaatgtgttgttgctaagatgatacattcttactcatattatttacttagagactttaatgctcttaaggtgtgaaggcttttagattattactgtatttattaaaaaccaagggagacaacaaattacttgggtccttacagtcttatttaagtgatcctatcctttattgatacatttgaatattcaaaacaatgtccttattgtgaaatatttctgaacagttttgtccggtaactctgtccacggtgttaggatttcttcagattatgcaacaccagatactgcgaggttgaagatgattttttttttaacatggcagttgcttagatgtctttaaaatagcaatgttaggaatcagagggtgagattcagcatttcaatcaacatggcaacaattctgcagtcattttgtcaagggaccctgtgcttgcttggggagcatctctacttgtcaaaacagtgacttctctacctcaatctctgtgagtccatgagaacggtaataagatggctgtgtccatgatttttgcagttcagctcaggaaatgtattttctatttaagttggttagtccatactaagcagtcctccaatacattatctcattgaacatacagcaaatttgttaagttgttgacaaagtctacaaacatgaagcccagtgcttcatgacctagttatgacctagttaacttcagtgtctctaggataatattttttactgtttctctcttaacaaattttctccataattagttataaaactagaaaggatcatggtgacaatctaactttatccttatttgttttatagaccaacagaggcccctagaggctctgtctctcttaagattatggacatagctaaaactactgacaaagcagaactgccatcagatctggcctctgctttctctaaattgggcaaatctgagatgcatgttattagctcaaagcattaaagtggaaaataaacacacataacacacaatgatcactttgcaattgtcttctaataatgatttccatagtttaaacatttatgtcatgtttttaatttgataattgatatggtttggatctatatgcccacccaaatttcgtaaccaagtataatccccaaagctggagatggggcctggcgggtgattgcattatgggggtgcatcctttatgaatggtttagcatcatcctctctgggctgttctcgtgatagtgagttctcaagaggtctggttgtttagaagtttgtggcacctctcccctggttctctttcttgtccttgctcctgctatagaagactcctgcttctgctttgcattccaccatgggtaaaagctctgaggccccctcagaagctgaggctgtcatgttcctgtacagcctgtggaaccatgagtcaattaaacatcttttctttattatgcaatctcacgtatttgtttatggcaatctgagaatgaaccaatgcagtcattatacaggaaactgatcatcatctgggaaaaatggtgatttaagccaggggttggcaaacttttgctaaaaggaccaaatagtaaaaactgtaggttttgtagtagtctctgttggaactattcaaaactgccattcttggacaaaaacaccatagataatacataaatgaaggggtatgtctgtgtagcaataaaagtgaaatttcaattttacataatttttgtgtgtcacagggcattattcttttgatttttttcagccatctaatacatgtacaatttatccttagctcttgtgccatacaaacacaggcaagttactggagttgtcccacggccatgttttgctgacctctgatttaagcccacaattccattctgccatttctgcccctgtgtatgtttcctcacaagtgtgggtgatgtataaacatttgtagaaggtgagtctaaaatgaatagggatgataaaggaagtgctttgactatgctcaatatactaacactatgttttctcttaacagattcctacttaaaatacttttttggtacgaaggctcacacaaaagctgctcgttatttttcaaccattaacttttgttttccaattacatttttaatgaacagttttttcaagaatgcctatttaaaataatgtcattaaatgggagaaaataggttcatatttaattgaatttgttttgtgccaagtaaacaagaacaatgttccctaagggctttaagcagattcaagaaacatatctgaatcacctataatcagtataaagcacatcacacaaaggatgagagaatgtggtgcatgtgcacacgagagagacagagacagagagagagagagaaggaggaggaggaggaagagaaggaagaggaggagggagagtaggaggaggaagagaagaaagggaaggaaagaaaagaagaaagggaaggaaagaaaagaagaaagggaaggaaggaaaaaaaggaaggaaggaaggaaggaaaaccttaacatctagaattttagagaacaagaacgtgtttatttgaaagtaggctctaaatgttaaggtatcttcccttgcacttcaaaataatatggcgtgcatgcaataaataagaaatgcagccgggtgcagtggctcacgcctgtaatcccagcactttgggaggtcgaggcaggcagatcacgaggtcaggaaatcgagaccatcctgactaacatggtgaaaccttgtctctactaaaaatacaaaaaattagccgggtgtggtggcgggggcctgtagtcccggctactcgggaggctgaggcaggagaatggcgtgaacccaggaggcagagcttgcagtgatctgagattgcaccactgccctccagcctgggcaacagagtgagactctgtctcaaaaaataaaaagaaaaaaaagaaaagaaatgtgcagcttatgaaatgataaaataaactcccatatacctaccaccaaccttaatgtttaaaaatgtactatccaagtagagtagccatcactcttagcacttttttttttttttgagatgcagtctcattctgtcacccaggctggagcccagtggcatgacctcagctcactgcaatctcctcctcccaagttcaagcgattctactgcttcagcctcctgagtagctaggattacagctactcatgtccagctaatttttgtatttttagtagagatggggttttgccatgttggccaggctgatctcgaactcctgacttcagatgatctacctgccttggcctcccaaagtgctaggattacaggtgtgagccaccatgcccagtcacttcgctactattaaacatttaaaatgtgattagctttaattgaggggtgctataagaaaaacatacaaatccaattttgaagattcagtaccaagaaaagaatataaaggatctcataataatttttgtatttgttagatgttgaatgataatatttgtatatattgagttaaatatattattaaaataaatttagctttaaaaatttggttagtagaaaattctacttagattagtgcaaaagtgatcatggtatttgccattaaaagcagcgctaaaacctgcagttacttttgcaccaacctaatatatatggttcacatttgtcgtggttcacactttatttgtattggggcagaactgataaagatttctgagtctaccaagacttttgagttttccaatgtacccttccctaatctcctactctgaggtaatcatttttaaaaaatttaataagaagttcctagctttttacagttttatcacatacatgtatgactctagattaggtggtctgctattttaaaacttttttaaaaatctcattttatttagctaacaccctctgtaaaaacaccagctccagtgtctccttatacctactcctcatttctgaccttcagatgttttctttctctcctaccagctcggccatgctttctaaaaaatattcttttatccagcattttcaggtgttctgtactgtgaaggacttctctgtacattagacccttattaccatattgcccttgtcatctagtgggaatataattatgtttcacctcctccatgctctttggagccaggagttggcaaacttttgctagaaggaccaaatagtaaaaattgtaggttttgtaaaacagatagcctctgttggaactactccaaactgccattttagacaaaaggagccatagaaaatacatacatgaagaaacgtggctgtgttcccaataaaactagaatttgaatttcacataattttaatgtgtcacaggatattatatttcttttgattttttatcctatggcaaaggtgaaacatatgactttataaagacatagctgaggaatgattgtatgagatactctaaatgaataacgaaaaagaataaaggagcaaacattctatattataataaaatataattctgtatatataataacatagatattatgcagccataatattagatttgagatgataaaatgtaaacatgtacaaataattaaactagataatcaaattgtcaaattatctgtctagacattaggtgctacaagagtactaaaaagaaaaaacaaaaacaaaaacagtggaaatgagctgagctggattttgaagcatatataggaatgaataaattgttagagaaggataaaagtctatttcaaggggaaaaaaaagtatatgagtaagacttgctaactatgagtttgttaaaatgcgtagagtaaaatgtgatactttatcttatcgttcagcaaaacaatatacatagaaaagtgttctagacgttatagagcgattcaattttctagcgctttaaagtctctttaactaaacattcatgccaaagttcccgggaattgtaatttagatcctagcaaagatagcagtagagttatacaaagtcttttgtttccttttctctaagaagagttatttctgtttgaaagaggtctttaagcttgtatttcaaacaactcccggcaaatatctccctagttaagtaaatgcagagatagccaatactaaaattcatctgtaaagtgatcatactatgaatttagctccttctcgggttgtgacttgaagagtttatgattcagtgtttcccagttgtgatatactgaccattaaaaccttggaagttggtgttaggaaacccacagcgtggtggtttatagcttgccgtgctttgaaatattccctatcatccaatttcaaaagatacttctaagctcatgggagcaaatgtcattacggagaagctttcaaaatcatctagagataaaagagtcactctgctcaaacaaggaaaacccaccacaacagtgagctagagccactaatctcattgtgtttattttaatcagtacctcctctcataacaaataatcctgatttttcatttgtggtagttatgtaaaagttctggttaaaatgttcatttgaatattagaaagtcagttgattgtaagaaaacattaagtaaaaataatgtgtgaatatggcaaaatgtgaagacagcatgctgatgactgggaaaaatctgtctaaatacacttttttccccaaaggaagaattattttaaagaaaagttggtagggcatattttaagactgtctatcttcttttgaaggaaaatcacttagcttaagtggaacattaggtttcctgtttcctgtcatagtttttctaaattacattcagtacagcaaaaaaaaaaaacaaattcagaggtgaatcccgagttcctctgtgcaagagaaaaggccttcaaagtttaaacaggcacagctatcctttcttctcggggtggggggaagacagggggtggcataactcttgcagagggctaattaagtaagcccatgtgagttactgcattaaccatgcagaggacagccccaggtagaggattcctaacccttagaaagtaactcagaagtcaatcaatcaactagagagcattcaagagaataattagaagccttgaaacaatagttccacatatcttgtccccaatgtaaatggaaataagggaattctccaaacaggtcatacctactgattaaaatccataaaagttctgagagtgtttctcctaaatgcacaggaattaacatgcaaaggcaggatagtagctatcctgaactttcaaattctaagaaaattcttagaatttctaagaaaattcagaaactaagaagatttttagtttgtccacaacctccaaatctcttctatctcagtagatggcaccactatttcctgactttacttatttccctcacctcccatgtccaatacaccaacaaatcctgttgacttgaccttcaaaatctatcccaaatccagctacaattcgtcacctccatgataccaacctattcaaggcctaagtctctctgacctacactattgcattgatgtctttcattccactctaaccatcttacaggcattttatccatactgcagccccagtcacatttaaaaaaattaattcagattttgttcattgcttgaagctcttcagtgacttatcatcaggctcatatggaaatacacactcctgaattttacctaagatgctcttcctaaagactctctaacaatgtcacctaccgctcacctgctcacttctttatagccagactccccatctttccaatccttggtaatatacttgccttcctttccaaaacactcttttgttgtgtctttgcatggcaaatcactcattccacttagcactcaggtttctgcacaaatgtcacttctttctttcctgacccccctcactgaaatagcaatacagacacacacacacacgctcctcagtcctcttatttttcttcagagcagtatcactactgaaattatcttagttatttgtttatatagctgtcctatatacttcatcaaattatgaagatttaaacagacctcatatgtaaaagcactttataaagctctatttaaatgtaagggatggttattgtagcggagtttgtcactttataattccaatctaatgacattatgaaacaagtctttattgatttaattaattgtaattattcttgtctcctcctagcctgctttcttttttaagtagcctggagatgcttgctctcttttttaactagtctggaagcaattgctgactggctattcagtttgcattattttttagtacttcctcttccacataatattggtattactttttcatgcatccttagaatcatagcatttttctatagtttgcataagaaaaaatttaagctttatgtgtccagatacatattttcaagtagtttatcaaatgtactgacctttcaaatcatgtatgtctcataagaatatcattatttatcaggtttcccagatgtttgcaattttcctggtatctaaacaatgttagcattttgtaagcatgttgttgatttcctattttaaaattattaaaggaagaaatatcacttcagcttttcttcatatagcagatatatatattattaagcagagagcaaatagtgttctgcaactctcgggtgggcaaacatagtgctcactaacttaattttccataacagaattcaactttgtctcaagcacctacctatcctgccaggctattccaaatcacactcttgttattaaatctcctattttccacattttgtattggagccatttgcccatatgagtttcaactgaggtgaccgtcatcatggtcaccaatgccttttgctctttattttccatattgaagacacagaatcctttgttgatattttgcctgggtcccatgtgccttaatgcatcacacaaacttttccatctccagtgaggctgccaggaagcccacacagcctgccaagaaccgtccctctcttctcacacacgaccttccacccaccccaagaaatttccttttgtctgatgggaaaccctttttcccatgtgtttttgttgaagatgtttgttctctgtgctgattctgtttctcttaccagttctgtaagtgctctaaatctccttatgggcccggggtttggaaacacaaagccagagtgaattgcaataaatttctattttctgtcctgccagatctctccgttgagtcagtgagcacagggccaattttctgatggaatgggggtaagaagaaatcataaatacaaagaggagaaaaacataggttaatagcacaaaattgaaacctccataatggttttcaattttactcctcagtataaaaatcaatatagatcacaaaaatcacaattactgctgttgagcatctgccttgtaaatggtcctattatagccctcaatggttttactccttcctttttgtttgcctttaaattgaagtatgcaataagcttgtaaaagtcacaaatttaaaggaactatggtaactttttaagataatcttgacggtaacaatcagcattttcatggcactgtataactgtattcattaagtaacaaaataaaacactgaacataataggtacataatactgaagctccggttgtagaatttctgcttcattgaatctcatgtgtggtttcactctgcagaaataagaatacctggaataaaaaatagagaccttcacccttttcaaactgacctattattttaaactctatatttaatgtaatgtatatatttttatactagagcaaagttgccacttgtcaaagtccttcaagtttaacctttgtgaatagagacattgtttcggactacaaaaagaattcttttttttttttttttttttttttttgagaccgtctcactcttgtcctccaggctggagtgcaatggcacaatctcagctcactgcaacctccacctcctgggttcgagtgattctcctgcctcagcctcctgagtagctgggattacaggctcccgacactgtgcccggctaatttttgtatttttagtagacacggggttttaccatgttgaccaggctggtcttgaacccctgacctcgtgatttgcccgccttggcctcccaaagtgctggaattacaggcatgagctaccgtgccctgccaaagaatttttttaaaaaaatgacagtcaggacactcgatttctgctagtcccagtctgctagaaagaatgtacttttacaaaaaccagttcatctcaattttgctcactatgttagcagagtatgtctcacttgtctactttcttgtttgtttcttgagctacctgttacctctctcagtgagggaagttaaagctgcagcaggagcttggagagctttttcaactggttgacagctcttattgtcacaccttagttcatacgctatctataggcgactattgtttcagtgggttgtggtttataaagtgctaacaaggcttgagacataaagatactattatttcaggtgacactacttgttatgaatctgcagcttctcacatccctgactcttgtgaaaatactccatatacaattttccggtctgtttcagctatatcatttgacttccctgaagtatgggacttcatgaaagcgtgattccctttcattccaactcctgatgtgatttccaagtgaatttacattattttactgtatcattttacattattttaatatcttagtgagtttttaaatcagcagtcatgcctcagctgaatctcaagggacattatatggccaccaggaaaagctagtgctaattaagtttttctctggatttctcattactgacaaacagctcttgacttcacaaaaacaccagtggcttcacagaagtagcatccagtagttggtcaatgttatttctgtggttgctataaccacataaggcagctctttgacccctgaggatcttatccctggccattcctgtttgagtcagggatatacacttttcccaaatttattgactttattaagtggacaaccacctaaatcaatatctctctctccttctccctctttcccctctccccttctccctttctttatcctctctctttttttcaaatttgagagtccatgattgggtattgatgagcaggatagcttgggggcaagaaacctatttattagcaatgacctaatgtatgagcatagaaagaaaagactgaggaaagccaaagatggagaacctgacagttccgagaaaatatgactgacctcaacctgtgaggctttcatgttctcaaatgacacagaaatgactaattttcttctgttgaatttacttgagttagcctcagtggatttctatttcttgcaatggaaagttaatcagtacaattgaaactttagtttattaaaagttatttttaaatgcatttatcaaatatggatttttcctttcaataaaagtaatagtagttttgcatttggcaaggaatttaactttttcacaattcttttacatctgttatagccacagaagatagaacaactgctttcctctatttggtagatgaagcaagagtctgaaaagatcagataatttgcctaaaatctcacataaaactagaggtagtactggaactaagtccctgaccctcaagcattgattgtcttcagtgatggcctgaacttgcttgtaacagtttaccaattctgcacctgatatcaacttaatttcgtgttcagttttcagtgacattgtgctgacagcttgaaattagccatggtgggagtatttatgtcacagaaatcagcgaacaattcaactaaaagctttaaaaaaaaaaaaaaaagccagttttcaaacatttaccacttcctcaaacaaactgaatattttataaaatcatttattatatattctggagccaagggtatccatgtatctttaaagcaaagctgaaaactcttaatttacttttaattggaactttacaatttttcaccaggagagcttccagttgtgggtgaaaacctgtaaattattgctggaaaacagtcttagaaaagttgttctgtcttagaatcggaaggttacaagaattgccaattttatctagcttaaccgtgatatttcacagatgagagaactaagggcaagagatgggaaatgatttgtccaaagtcacaaagctacgggaaaggaaaagcatgattcaaactcggatgatcttccatataatccaaagttgggtaaaatttatgcttaggaagatcaaggaaataggatttgggccaaagaaagaaaagagaaggcagaagtctacaatcctagtaggctcataaaatcccttatgaataagactgagaaggggattattaaaagggatttccaatacccaattaaagttgtaattgtgcaggtgtatttgttcattaatgtatatgaacaaagtgatgtttctggttattaaaatatacaatcaataaacttacaaactcaatttcatgactaattgcttgtctattaaatgcaaaagatattttgcataatgagaaattgccaatattcaacaaggagaaaatgaaaatgaaaggcggctctgggctgggcgcggtggctcacacctgtaatcccagcactttgggaggctgaggcaggcggatcatgaggtcaggagatcgagaccatcctggctaacatggtgaaacctcgtctctcctaaaaatacaaaacattagccgggcgaggtggcgggctcctgtagtcccagctactcgggagctgagacaggagaatggcgtgaacccaggaggcagagcttgcagtgagccgagatcacgccactgcactccagcctgggcaacagagcgagactctgtctcaaaaaaaaaaaaaaaagaaagaaagaaaggcagttctgcccagatcatggttcatggttgctattgtgtgataaaatagccaagaatgacaagaaaaaatgtatttattttaaaaataagtagtgaagaagtgaataactaattttatctaggaggattggtgaaatatattacaggtttttcttgatttaatatatttaccccttcagaataaaacttggtttgaatggtatattgctcactttattatacatagatctctgtaaatcaatatcatgccaaccaacaagcaaaaaaagtagttatctggtttttgtcaatattttaaaaaataattgatgtaccctttatgaatatgaattatcacagaaaaatagaagttttttgggaaaggataggggtactttggaagtatgcctttgagacttgagtgtggtgtgtatagtcaatctattttatttaaacaaagtttaaactcacttctcaatggtaagtcagtatactgatacaattggtcttttatggataggtaatattatgtggtgtgttctcaaaataaaagtggaattcagcacaggaaatgttaatatattacaattcagcatctattttccccttcttctccctatgcagtattatctctgtttcctagtcataaaaattgccaaggtagaatataacaaaaatgacattaaatgatcaaatgtgtcaggatctttatattttaccaagcaaactgcaccaatcagaacttaagtgagacttttttaaaaaagaagacaggaagtaaagaagaaacccaatttaaagtgttttgtgtcttatgatctgattcacatcaaacaagttttgaagcagctgaataaatcaatttttgttataagaaagtcgttttatcttttatctttttcttggctatcagcaattagttaatatttcaaatgtagtagcttaaatgagaaggcaacaatcaagaaaattaaaaagagagaggaagaataaaacacaaaaatatataattttttaaagattaaaaagaaagggttttgaaatcaatgattttttttttttttttttaaacggagtctcacgctgttgcccaggctggagtgaaatggcacgatatcagctcactgcaactccgcctcccggttcaagcaattctcctgtctcagcctcctgagtagctgggactacagtctcatgacaccatgcccagttaagttttgtatttttagtagagagggggtttcaccatattggtcaggctggtcctgacctcctgacctcaggtgatccacccgcctcagcttcccaaagccctgtgattacaggcatgagccattgcatccggcctaaaatcaatgcttttgataaattaaagagaaggagaaagagattgaaactgtatttccgatttgtccaggtcatagggggtatgatactaatgcgacaaagtgattgttttgtgtggaaagaatcataaaaagaagtacaaaacagaagttgatgaagttaagtgatctgcccagagtcacacatcagctaacagcagtgctgggaaaggacactcatcctagggctctttctgtattaaaaatttttgacttacatttccatgatgattattgatactgaatgtttttttatgtttgttagccatttgtatgtcttattttgagaagtgtctcttcatgacctttgcctgctttttaatgggttgttttttgcttgctgaattaagttctttatagcttctggatattagagctttgtttgaggcatggtttgcaaatatattttcccattctgtaggttgtctctttactctgttgatagtttcttttgctgtgcagaagctctttagtttatttaggttccacttgccaatttttgtttttgttgcaattgcttttgaggattttgtcataaattatttgccaaggctgatgtccagaatggtacttcctatgttttctttttttttattattattattatactttaagttttagggtacatgtgcacaatgtgcaggttagttacatatgtatacatgtgccatgctggtgtgctgcacccattaactcgtcatttagcattaggtatatctcctaacgctatccctcacccctccccccaccctgcaacagtccccagaatgtgatgttccccttcctgtgtccatgtgttctcattgttcaattcccatctatgagtgagaacatgcggtgtttggttttttgtccttgcgatagtttactgagaatgatgatttccaattgtacttcctatgttttcttctaggatttttatagtttgagttcttacattaaaatctgtaatccatcttgaattgacttttgtttatggtaaaaggtagatgtccaggtccactcttcctgcatagtaagttttaaagccaatagcagctagatgtgcaaaatgggttctgacaggctgctacctatgtaatgatcataagaattttttataattaaaatttttttaatgtgctgaaataagtttcatgatggcaagaattgtgatttgtttactttttcatgtttgtatcctttgtacctaatgtcttgcatagcatctaataggtgaataataaatttttagtaaatgaatgagaaagtgaatgcccagaaatgagaaaatgaagttcttaacttacatacctatcatactgcctctgttgggagtgttgctatttttaagaatgggctctaaagacagatcactttatcctggttgtatatttaaattactcagagaggccaggcgtggtggctcacgcctgtaatcccagcattttgggaggccaaggcaggcggatcacaagatcaggagttggagaccagcctgacaacatggtgaaacccgtctctgctaaaaatacaaaaattagctaggcgtggtggcatgcacctgtatcccagctactctggaggctgaggcaggagaatcacttgaacccaggaggcagaggttgcagtgagccaagattgcaccgctgtactctagcctatgtgacagagcaagagtctgtctcaaaaaaaaaaaaaaaaaaaaattactcggggagcttttaaaacatgccagtgccttatctccacccatggggagtattctttaattgttcagggcctgcttctagggacaggtaatatttaaatctcttcgggtaacaaacaagaacagtacactttgagaactactgatttatatgaaagctccatgagtgtctcacatccaaagataaattaatcttagctttaagctagacaaatgtataaaaatattctgctttaatgtcttcattttccaaatgagataactcaatatcagacaggttaaattatgtatctactagtaaacattgagtaagtgtcaaagctaggactgaaattcaggccttccctagtccaaggcccatttccctgtactacactgcaccatttctctcatgatcttagtagcaactgttcaaacaataatgtgtttgtccgtgtagcttaatcatgtgcataatttcaacaattgaagacaaagaagtagcattttattatttttgatgttcagtacaaaagatactcctcccaaatatttgcagcttatgtaatgcaattcgctgaaaattattaatatataatgtgatgaacattatgtatattatgatatatgatgtataatatatgatatacattattatacatatcatatatatacatatacatataatatatgatatatgatatataataatgtattatatattatataatatataatgatgttcagcacattatatattcatgatattctttttcatctggacacacatacaaaagtaatagagaaccagtttgatttttaaattaacgggctgttatagaggacaaaaaagatgatgaatgtctgaaaattctaccatacctgactgtggcataatgttaaccctacacatagttatcatttggaaaccctaacaatgaaaaaaaaaaaaacaaatccctttaatagttttctatggtatctatgcttcagttaatggtcacataaaagagaagaagaaaataattggttgtcctgaacttttccagccattaaataatttccaaattaaaaacacagttcagtttttatctcctcttatcttagactgctggtattatagaaatgtctgcacatatcattttttgtttttacttaggcctcttacaataacatttatctacttcagtaattgtgttttttttccataaccactccatcaaatagattttatatatgtgtatttacacatataaatggaagcaaaggtacttttatttcattcaacttgaaaagctaggtgttgcaaattgatttggtgttatgtaatagaggaaattaattttatctgtcttgggttgcttttatacagcataattgaatctgaaaaataattgtgcattgagtaacttcaaatgattttgcctttttgtttatgttctttaacataaacagtattcacagtatagagatttgctaaattcattgttaggatttaatttcatttatttgtttcattgtaaaaaagtgatggattcataattatactccccagagtaaatgtaactggatccatacatgaaactaaaggaaaggtgaaagagtctacccaaaaataacatgctcaccatcttaacaaaaagcaattgcaagaaataacaagatatgtaagttatccctatattcttaaaacaatgtacaaagattgggcatgaagcaaaattgtctcccaaatagggatttcatcttttctcagttagtgcaaaacactgatacatctctgggaagcatttggagctataggctgacctgaatgattttctcaagacttgaccgacttctaaaacattcacacatccctgatattcaaaccaaattattaagtgcacgaatgaattccttttaaggactttatgccttgctgtatgacactgattatatttaatatattgatggtgagaagaaagcagaaggaaaaatcttccaccagaggagatagggtcaaaatgtcacagtttagaaggatgaaatgaattttttgtcctacttcaaatgtatccaaccaagtaatttttgactagtttgttgattacctgaaatcttaatagtttcatttctgacatgtttacacaattttagcaaaaatcaatgggaattattttaggcatgtaaaaaagatttttaaatattttgttatttctaacaatgtcttcttttgccttcactaaaattgctttatttctgtcaagtcgatttttattgaaaatatgtttcttattagctcaagagataagtgtgtgtcttctcagttacctgatgtttttgccacctggctcaagagtactaaccaagaatttttctctgctataactgtaggcatttgttaaaaatgtcaggctgagataccatggtacatacaaattggacatattgctggatactctggaagtaagctataatcatgttacacaaaatgtgtctagaagctaatgatttgtctaaaattttagggtatgatctcattagttttaaaatatgtaacctctgagcaggaatatattctgttacaactattctcttttatgttattataaagcatttacattcacatcaatgtagactattagcatctcaaccaagtcaactgaaaagtttcaggatattgagtaagaataattctatctggcacaatggtaaatgtcaaagtagtagtgacaaccagtgtgtgatgacatcgtatctttaggtatgatctaaagatacctaattgcttatttgtttcaataaattagatagataatagataaataatatacatataattacagatctattcatatacatacacattcaatgtgtgctatgtatgtcagggaaatttcacatttagaatatttgagcttttattttatacttttaagtaatcatgactattgtttgaacctacacttatttccttttcatctttccagtatagtagtttttttgttttttgtttgtttgtttttgagacggagtcttgctctgtcacccaggctggagtgcagtggcattatctcggctcactgctatctcctcctcccagttcaagcaattctcctgccacagcctcctgagtagctgggattacaggtgcgtgccaccactcctggctaattgttatacttttagaagagacggggtttcaccatgttgatcaggctggtctcgaactcctgacctcatgatccatccacctgggcctcccaaagtgctgggattacaggcgtgagccaccacatccggcccagtatagtagtttttgtgtggaggtttttatgttaaagcagcagtccccaacctttttgggaccagggaccagtttcatggaagacaatttttccacagagcagggttggggtgggggatggcttcaggatgaagttgttccacctcagatcatcaggcattagttggtctcataaggaacatgctacctagatccctcacatgcacagttcacaacagggttcgcgctcctataagaatcccatgccactgctgatctgacaggaggcagagctcaggtgttaacgctcactcatcttccactcatctcctgctgtgcagtccagttcctaacaggccacagacctgtacaggtccttggttcaggggttagggacccctgtgttagaggactaaagtaaacagatagatgagtaaactatttcttggatcccatgttcatggatcgatattcaattgctatgctattcttttgagctttcttaccaaataaagctgtgattacaattcagaggtttaaaataaactgcattaaaagcataggaaaagcaataaagaaaatgggtaatggtcaaataaaatcagtgaagtttatcacttagtttaagattttgatattgcattatattgctcaatattacttatattgatcactcatggtttctatagtatccattccaattgcttaaaaggaaagataatgaagttttattttcagaaaaaaaaacaaactatttttttgtagaatagattagtcttcaaatattttgctcagaaatatcatttaactgatacctaggttcacctccaatttactttaactagtattttaaaatctttttaaaataatgtgccttataaatgtaaaatgtaagatagaacttattaatttttagcagcataacaggtttgaataattcttttcatggtaaagatatcttgccaaacttcttgtggctttgatttgttctgaaccaccagagacactccaggctcttgaccccagtccccaggctcttcattagtaactacaggatgggattagatgacagatgagattaaattttctttagaaacccttgatttgtgagatctgacctaccgagagaatcatgtttccatataagcacagagcattttccccactaagccattatatgaattaccccaaactctttccagaaaaatgctcttggagtagactgaataggagaaggaatagagagagagaatttggagggtctgcaccagaaaaaacataacagcaactaacatgcctgaaacgttccgtgtcttgtaagtcctgcattaagtactttacgtgcatccaccaattttatcccactaataatcttatgatggagattactattacccttgtttttaaatggggacactgaggcttggagagatttagtgcccaggtaatgagtaggaatgctggggtatatctcctgttcccaaccattacaagtaactgacaaactgtaatctttcttctatgttctttgatttaaaacaacaataataataaggaaatgaaatctttgtttttaactccatgctggggccagtgccaatgctcaactgaggctggagctctggttcataattttttttatggtaagtttgtttccgggcttgtgtttcgcatgatagtctgcaaactattattgaagcagtctggctggaaaccattttgtgtcctataatttttctaatttaccacagtgggaaatagaaaggagagagagcaccaggctagccatctgaagacggccttctctttctgtgtggccttaggcaagttatgtagcctatctggacctcttaccacgtctataataaaagattagattacacaattgcctatgacactgcaaacattaacgttttgattcttcctttggtcataaatgacaacataggaacgtgggggacattgagtgttttagttgatgtcaaacccataaacaggagtggcgcacctggcattcaaaactatgtttcttaattcctgagtcagatatgtattactacactgtgcgggcccctttggggtcaacatcaaccccagtgcagttggaaagctgtcttgtagggttatgcaatagagttttgaacttggccctgtcccatctaacattaccaataatgtaactgaggatataatgtgcttgtcaaattgaataatgtctaaacattacagtaattcatgatatcatctataaaacaataaagagttttaaattcttgaaaggtaggactgatgaggtaaattcaataaatgaaacctccttgtttttgtcagtgattaaaataatttgtataaacaccatagaaatgtctggttaacagcatattaattgacacaggtttagtattcaacagtgtgagggtgatgtttgaaaactataatcacaggctacaaaagaagtatagcatccacatgcaggtaaccctatgagtagagagagtagtggggctcagtgtttttcctccactacatacctgaaagataaagcttctacagatattactaaaagttttgcagatggcagcaaagctaaaagcagcagccaccagttgtgcagaatgtgcagcctgttaattcaaacctttaccatttgaggtctcagtgattgtgaacacctgctctgctgtgaagactaggtgtgaaccatacagaaaggttatcctcaggctataaagccacttcttactgccatgggtgaacaggggcagaaacaaagcaaaaatgtgaacaaagcccctaacatagagatggtcatagagattgtccttcaaatcaaagctgacagaataaggaagctttagttcagacaggaagagacttaacagggatttggaaaactctccttatataatttgtaagtatggataccctttccaattcattctctggcagcctatgtaaacaattattctgggttatgaatggtgacaatctagccacatgttcttcatgtcacacaatggaaacatctgtaaaatacatggataaaatcaacattttggttttttttaaattatactttaagttctagggtacatgtgaacaatgtgcaggtttgttacatatgtatacatgtgccatgttggtgtgctgcatccattaacctgacatttacattaggtttttctcctaatgctatccctcccccctcccccaccaccccaaaacaggccccagtgtgtgatgttccccaccctgtgtccaagtgtttgcattgatcaattcacacctatgagtgagaacatgcggtgtttggttttctgtccttgcgatagtttgctgagattgatggtttccagcttcatccacgtccctacaaaggacatgaactaatccttttttatggctgcatagtattccatggtgtatatgtgccacattttcttaatccagtctatcattgatggacatttgggttggttccaagtctttgctattgtgaatagtgccacagtaaacatacgtgtgcatgtgtctttatagcagcatgatttataatcctttgggtatatacccagtaatgggatggctgggtcaaatggtatttctagttctagatccttcaggaattgccacactgtcttccacaattgttgaactagtttacagtcccaccaacagtgtaaaagtgttcctatttctccacatcctctccagcacctgttgtttcctgacattttaatgatcgccattctaactgatgggagaaaatttttacaatctactcatctgacaaagggctaatatccagaatctaccaagaacataaacaaatttacaagaaaaaaatcaaacagccccatcaaaaattgggcaaaggatatgaacagacacttctcaaaagaagacatttatgcagccaacagacaacatgaaaaaatgctcatcatcactggccatcagagaaatgcaaatcaaaaccacaatgaggtttttttttttatttttaatttccctttaatttgcactttccagcccagtgatacagtatttatttctgtgtattttctgttgccagatgtgactcatatttatttgctatctgcccttgtatgtcaataatgggttataagggtcataatacacttaatatgtgcatcattcaaacctaataaaaaaattgtagacaatctactcgaaaaataaatgtcatcctccccttcccccaatgcctgcaatcagccctcatatataaagatcaaattcaacaattttcttcaaactaaactctacctacatttgaaaggagtttcttttattctctagtgcagttatgccatgtgttactataccttggcctggtattagtaatgaatttgtcctcatgggaatttgtgacttactggcaactgtgtgagtgctcttcactgctttgttaataaccagctcttttcctatagagcacgttttccttggtggatggaaagcatcccttcctggggcatacacttaatcagaatatgtagacaatttctatctcttagagaagtagggacaacaagcttaaaaataacttacacagaagaacagcagcaaagtaattcgtttgaatccttttattatgttgttgccagaataaatatctgtataacaagttccatcatagaaaattatattaaaggaattgtgattaggcttgtcatttccccagtgtatgtacaaatgagtttctttatagctagcttttactgtattcttaaaatattacaaacatatatagtccacgctagcaataggaaatcaatggatagttacaagaaagaatgacttcataatgatttttgacctcccaagtcaccagaagatttcaatatgagagtcccttccccctacacccccacccagcaccccctgtttctctccttctctttttttctctgaactagctttagctgcatggctcccatttatcttaatagaagttacttaatgaaggttatgcatatcgcttagtaactcagtggttaaattattctgttttgtgctttctgatctacaggtatttttttttttttgcttcaaacattcaccaatatatttcacaattgctatttgtgtttctagccagataattcatgagtttattttaaagtataattatgcttatgcaatttctgcaagacatgatattgacaacagtggcataagttccatcaaaatgtagaatctggtataaacattgttatatgtgtgtatgcggtaaatataagcacacaaaatacttctttaattttttttctgagtgactaagtagtcgtcatagaggtttagtctgaaaatggactaatagctgttgcaattgtctttttcagttcaaaaatgatagttaaaaactacactaatttgtattaattcttaccagaaaacggtttatcctcttgtacgtaatacttttaattctaaatatgtgtgtgtgtcctgtaaacttgcttgaaatactggtttgaaaatgtaattggtctttatttaaactgagacaagcctgtatatgctacaaatagtttattttagcaagtatagtctttgataatttgaactaatctttaaattcagttcaccttctacttaaaaactttaatggttttctacgtacttccttctcataaacctctgaagatttttatgcataatgaataaattttatattctaaacctagaattcagccccttgcacagaaatctcatcctacttatccacagttttatctgtgactctccaagacagaacttctcttatggctagaaaggcttcatgggcatccccacacatttgcttcttcttccctcaaacttatatcaaaaaatgcctccactttatactttgcctgcaaattttactcatagatgaagacaaggttaagttctgccttttccatgaaagttgaattattattgaatcttattaaaacccaaactgagcagttctagttgaacctcctatgggtgcaagactttgtgaccaatagcattgcttattatagatatgtaggtgttggcctctaccagtggggcagtaaccaccctgaaaacaagagcctcatcacagacaggttttatattcaccctaatatatacatacagacatggaataaatgacttttataaatttggaagtcttcaaacttgaaagtgttcagctaggtcaaagcagggcagctgagcttttgagaatattcacatctgcaaggatgtttccctatcagtaagaactttcattgatcctataaaatatatcagtcaaaacatctagattaagtcatttatttatttaatatattaaaaatagtaaaataactttgacttgtgggttgaatcatgcaaaattcaacaagttttatagttcaagtgtggttgaacgtcagcaaatttatatgtttcaacctaatatttgccaaaatttttggatacagtagtaaataagaggctgtccttatggaacatatagtatagccaattagaagaattacatttgattttataggacactgaaagttctcattcttgtctagatgatctcatgactgaatttgtttggacacaagtccttacagcaattagattttaatagtagttcccagttatacttgacgagtaatggtcttttaaaaaaatcaatctcaaaaggttgagatgtgccccatcttctcttaccaatctattattatgttacctgtaatctgccaatttctataggtcccctaaactggtcaatgcatattgtattgtctcttaaattgagaaactttataatttcaaagtatgttctacgtgcaattaatgttaccttttgtagcttcctttcaagttatttccctattacgacaaaaagctgtcacctcaaagttggtgaatgaattattgttccccatattcatgcacatcttaattattaaggcttaattcatttttttaagctttataatttcccagaccaaaaataagagattgatttcttaatagttatccgtacaaataggctgttttgcctttcctgataacctgctttgcctaaattatgaaagaacaatttggaagaacaaattgttctctggaagaacagtggctggaaaaagacacagtgttccagaagctgatgccccacagctccctgcaaggttagggcagtattttctctattgtccccctgatgataacctgcatattgctggcctttttgactcagagcagcacaaagggcttacgtctccaaaaacttgaacacagtgactccatgtcttgatctgagcccatcattttaaaaaacataagttggattcatttatttctaagtccttatatctgtctaatatagataaacattatcttctgtgttaattatagtagattggtaccaaacttggtaaatttatcttattttttattctttagtagtattttggcatatcacagaccagaaaagttgtgtgctatcaaggcctccattttaaagaaaagttttaaatgctgtctaataagaaatcattaatgattcagttttgactgttcttattttatcctcttttagctcagtgttttcgtaacactctactatgtgcctgagattatcagctgattcctttctattgtgttactatttcataaactacttcaaaagcatttttgtgttctcttttatatttatggaggcatttgagttatcaactttagttttcttttgggtatactggccttagactgattttaacacaatttcaaaacttggtgttcagttttagacaaatctccagaggctcagtcctttgattcacataaaactacaagagtttgttggcttagttagatcttgtatgaatctcaggtatttgtgtgtgaaagcctaaaataacaccttcccaaaatgttcactgcttactttaattttacctgataaaaaactttcttagtgaattttactttaagaagcactgtttcactcaagaatatggttaagagatttgattggcttcagtcaagaataatcatgttataggtggttctttttgtccttcagaccttgggataccaagtttcttcccttccttctttcctttctttcttttcttttctttttttttttttttttttttgagacagagtcttgctctgtcacccaggctggaatgcagtggcatgatcttggctcactgcaacctctgcctcccaggttcaagtgattctcctgcctcagcctcccaaagtagctgggattacaggtgcgtgccaccacgcccagctaattttttgtatttttagtagagacaggatttcaccatgttagccgggatggtctcgatctcctgaccttggggataccatgtttgttaagaagaacatcattctggactccactagacaccctgcctaaactaatatagaatattcactcaatgtgtctacaatggcatctcttgttttacaataatgacttagctactagttgcgataggtttattatttaatctctattacctgattttgaaagcattgttgccttcaaggaaaaaatggtagattacaatgtccttatactagacagctattttgaaaatcagattacctgtttaaagatgctgcatttctccttctaacattttcatgtgacctaattaagctgaccttgttttcctgaagaattgtcagtaactcgtggtgttctctatttggattatgaagctgctcagtgtcttaagattagggtgatgagactaaggttttgccagtttatgtcaagtggccttattgacttttttgagagcagctgccaagtttttagccttccgataaggcaatagcaacctaaccaaatctctctaagagaagctttccataaactattagttaggatgggggaagtgtccttgcaagggaggttttgtttttgttattgcttttgcctagactcatccttcacttattatcagtcacagaattccgtggccaggcttatttgaaatcaagacagtgtttactgatcataatagaattgtgtcacctttaataatactcaattcccttcctgtgtatcatcaaatgcacacgaataccatgatcatctctaatactaagtctctactaggaactacaggaacctaaaacttataaaatccatttgttaccttattgaatgtgaacatgtaaaactatgacctttccttaatctctaactatttcaacattcctgtcatgccccaattgtagttagaaagacattttcatgtctagattagttaagaaaacaaaaatcatcttattaaggaagtcattttctaaacaagatttgagctaatgctatactttgtcttttcttttgctgtcttcttttttaaaattagttttttttatgaaatctccatataattttagtacaaatgacgaaaggagattattctgagatatgtatttactatctgagatgaccatggtgcttatggtcattatttatcttccttattttcataaatgcctgggaataaacctcttagagatacaaaatgctagttttcaaacttaccactattctagatttcctgttattaatgtaaataatactaattttggatagtttgatagattctcatcaaattagtagatcatatttggaatggccttacttaaaagataggttccatggcttatacgaaagatatgggccattcttcctcaaagcagctgaaggtgaggtagcataggaatctgtgtaagtactgatagatatttgccacatatatcaagaattcatgggaaaactatggtttcaaacatgaaaccaaaattgatcatgccaagtaatctgacattggttcaatgtcaaaattttgttactattttccaaccctaaatgacaatgcaaacctaaatagatatgtttttcattggaaagtatgtgttggggtcaactaatgagtctctaggaggatgcttaaacctttattaagaaatacatgtccaaattcaggcatataaaaatagtaccatgatatacaactgtgcattttaataagtggcccttataacttgaatttcataatttttaaatatgttctgtgtgcaatggtataacttttgtcatcacaaaagcaaatactcacataatgggtatttaacttgcaaccaacatgcatttcacgttgacaactctacatatcatgctccaaagactatttatatggacctcaaacatatggacctcacttctgatcgatgcacaaggatcctttgttaaggaattcaaagtttttctctgttattaaaattatggaaaatcatcactagaacgctaaaatttattttttgctttataataaaacttttatttgatgatcattaatgattatcctgaaatggcaatataatacaaccatttgatatataagaatagttcatttattagtcaagttgtataattttgagaatttgttcataaacagattttaagaaaaagcatgaagctattaatctaattgaatacagtatatgtgtttgtatgaatgagttattggacaggaaggaatttttctatttgctgtggcagataaatattcactaaatgctttgagatggaaggattcaatttagaaatatcctagatattttgagagaatggcattgatacatgtgagctatctttgaaaaactaataattgagtgagactcctctatcattgaaaaactaataattgagtgagactctttcgactacatcatggaaattgtttttcatatttaattatgaaagatccaatgtgcttatttgaagtacttttcttttatctctatggagaagactaaccatagtaaaagctttgattcactttttaagattgtgccttggctccagcctttaaattagtcattatacattttattcttcccttggcaagtatttgaggaccaattttctttttattaacaggggagaaataatggttttttgaataagctaatcattcttagtatttggccagatttcatttttcccatcttaggctgactttgtaaatagtacttaatatcttgatagctatataccctacagactcagtgattcttactttaaaataaagaaatactttcagtcttatctcagatggtgattatgctaaacatgtattatataaacactagaaaaatctttaaattattcagaataagtactagcctccctctagcaccacaatgttttcttaaatttccctcaaaaattatacagcaaaaagtttctaataatgtctatttcattttctttctatttagtatacatttagcaagtataaaggatattccaaaccttggattagataataatgggagatataccttggatttcttggtagttggtagtgtttttttctagcaaactttttctggacatactatttatttattaaaggtgagttcaggcagctctctgcttcttctcacatatagtagctagatcatgattctcaatgtcattcaatccagataaccatagttaccaatattacagtcataaaaacaaataagtttcttcttatttaagaaaatgtcctgaaaattgctttatgtaatcaatcaactctcccccatttaatgtgaccatactaccttagctcacaagaaacaacataaaatgacaattttcattcaatggcagtcatcaattagaagctggtatgaaatgtttaatgtaatccaggctgttgtgaaatcaagtatcttttctgtgtcttgaaaaactttgtcatggtagaaattttatcagttattcaccatgaagtttcttctaccgtatttttactggcagaaatctaagtcttgtcagtttggctcctgtcagcaggcagactatagatactggaaaatacagtttaactccatctaatttcaagtctcactagcttaaatctattgaggaagattgcataactaaaacaaaaaaattatggatccaaaataacataatgaggacagtaaagattaatttaagtgctttttaaaaatttcatctggcttttctcttggaaggcctgtgcaactcatataataccagattatttagtacctgaatgcatctgaactttgtttaaagttgataattttgttgactcattcaaaaatcttcttgctgagccctaacttgttttatcttgggatttcacatactttttaagaggtacaggaaggagaagcaataatgaatgataaaagctgtaactcccttcactagactgtaaataaaaccttatattaattcttttgccgtgacagaaagcagtgcgatgaatacttctggggccagttatttaatcattttatttggccatgggaaaatagtataggtggttttcatgcttttttgtgtgtgaactgtcataattaaggtgaattggaaaagaattgattacatagttgagtgacataaactgtactctgaaaagaaacagttttaaccagtatcatttatcagctagatcactgtattagcatcctaaaaataagttccttgcttcaaatcttgcctctttccattctctcctgaaaaggcagccaaagtgatctttgtggaattgaaatctaaccatgtcactttcttcttaaaatctttattttgcctcactgtggttttcaagcaaaattacaaactccttggttgtgattattatatacgtgtatataatatatgtatatattagatacgtgtatataatatatgtatatattagatacgtgtatataatatatgtatatattagatacgtgtatataatatatgtatgtattagatacgtgtatataatatatgtatgtattagatacgtgtatataatatatgtatgtattagatacgtgtatataatatatgtatgtattagatacgtgtatataatatatgtatgtattagatacgtgtatataatatatgtatgtattagatacgtgcatattatatatgcgtatgtgatacgtgcatattatatgtgcgtatgtgatacgtgtatatattatatgtgcgtatgtgatacgtgtatatattatatgtgcgtatgtgatacgtgtatatattatatgtgcgtatgtgatacgtgtatatattatatgtgcgtatgtgatatgtgtatatattatatgtgcgtatgtgatatgtgtatatattatatatgtgcgtatgtgatatatgtatattatatatgcatatatgatatgtatatatattatacatatatcttaggttatcttagttatatttatatattatatatgtatatataatatgtacatatataatatatacacacatatattatatacacatatataatatatacgtatatacacatatataatatatacatatatgtatatataaaaatatatgtatatttatcgtgtgtgtgtgtgtgtgtgtgtatatatatatcactaagaggtgttgttttagtttctctctgccctctctgcctgatgaatccctaatcatttatttactcaatgatttttcaagattttctcatgatcatctcttccaggaagacttccaagagacactatcttgattcttcctctgtggtccagtagtagctggtgcatttttcatttagttctgtaatcactggtttccttgtgtttctccctctattagactatgtgcattttaaggggaaaaaagtacaatattacattcctcactgtgtgctaggtgcccagggctgtccttggatacatgtagtgggtcctccatgagcaaacatttgttaaatccatgaatggtaaagagttctatattcaaaccaaggctctgacaatacttcactgtaaagcctcaaaaaaattttttttaatataaggctagagattcttgcctcaagtgggttgttgtaactgttaagggcagtgtaaaagttccttgaaatttcaaaagaaaaaagatacaaagatgatagcattattgttaaacatgctctttatgcagcaaaggtgtttgttaaggttcatgattggttgagaatagtaagggagaaaaactgaagttatgaatcttttctttttcacttgtttttctgaagtccctaggattacttttttgctacaggaatacaagggggttgtcacgtttttctttctatgctttatggctctccagttccaagtgctgagtaggaaagatgactctttcactgtaagaaatagtaataacattttcaactcaaaactcactaatcagattgattagctgtccacaaaaataaaatcctgcaacaacacattcctatttttaaaacattttttggcattttgtattttttcattatttaatagagtgaaattttattgcttggggatgctcagttcacttgagaaaccaaacttaagaaaaagacaactagaaattgtctttattgaagaaaaaatacagagataaaactaaagagaaaaaatggctttaaatgtgttgtaacacagaaagtcaacttagttatttgggaagccacaaaaactatcatctcccaggccatagtttcagaagtttctctgctttatcgggttttacacactaaactgaaagaacagaagcctaattctgaaagaagcaccaatgaaacactaagtatgttccttcttcctgttggcaggtagctgttaaggtagatgttgaggacaaaatcaagtgtatcggaaagtttagtaaacagaaagccagaaaaactaattctacttcttgacttggtgacttggctggaaggtaggggaagaggaagggttacttttgcttctctgagtgtctatttcttcatctgtatgatggatgagcaggactagctgttctctgataccccctacatctgaagttaccagattctaaacaaacctggtttttatatcttcaggtacaactttctctcacctcaaccaaaccccattttctcaagcaggaagggagaaaagaaagggggaacagagaaaagaaaggcgagaaagaggaaagaaggtaagctgtaaggaatagagggagagaacaagggagggaaggaagaagtgagtaagaaagaaagcaaagatttcaaaaactgtaaccctggacatattctaggctctctcaagccttacagtaaagaagtttttttctaataataccaaatatgaataattcctatcatacatgaataagtttggtttattagtagtaaacagattatcattcctaggatataagaagtaaagttgctttctgataataaaatttgaaagatgtaatttaaaacttatttattgtatatactatatgatataaacttccacaaataatttgaaaaaataatttccataaatatttcaaaaaataatttttcataaaattttaaaatgattttttgcatggtatgatacttttttttacactcaaagtattcctaggcactagtcacgatagcaaagacatggacccaacctaggtgctcatcaatggtggactggaaatgaaaatgtcttatatatacatcacagaatactatatagccatgaaaatgttccttgcagcaatatggatgcagctggaggccattatcctaagcacattaatgcaagaacagaaaaccaaatgctacatgatctcacttataagtgggagctaaacatcgaatacacatagacataaagatggcaacgatagacactgggaactaccagactgaggaaggcaggagggggatcattggctgaaaaactgcctgttgggtactatggtcactacctgggcaacaggatcatttgtaagccaaacctcagtgtcacgcaatatacccatgtaacaaacctgtacatgttccctttaatctataataaatgttgaaattataaagaaaacatatttctagaaagcattaattaaccataaatgttcagttatgttgactttcatggaatttaaatctgttttctttctatgtgtctaatttatcactttgacagacggctttcttttgactcttctttttctccttgatcagatgataccacccgcttctcccccaatcccacacacatataaatgcgtatagtcatgcttctattctctttcttccagcttctttttcttctcttatcccttttccctctcattgtggtctttaactattatagctgctaagttagggcaagaaactctgtaatatctctaatattgcagattaagaaatgctgctgggttagataactaagctcataaggagccatggggaaggtgagtcagaaagaatccttataatatggacactgaccttgttaatgttctgggcaccggcatacaccaccacccccccaccacccacacacaaaaactcataattagtactgcctttgggtagttactgcctctcatcttcatgaatcttaagtgatagaaagagaggctgaagctttatccattccagagtaggagaaaagtgcttataagggagttatgagtatgggctttattgtcatacactcctggaatttcagttctggattcaactagctatgtcatcttgggctagtcatatacattctttgacacttagaaacctcgtgtagcaggaagatgatgatgaacgtactataactcttcaccttgtgaagattaaataagataatgtaccacaaagctcttagcacagtaaactttagttttcatctcaagatgtgaaaaatgtattggggttgaacctgaatgatgaccttaagaccatgcctcagagtgtggttctcatctagctacatctgtgtcaactactacaacagaacctctgtgggtggggctgagaggatggatttacatgaggatcctgaatgatgctttggcaccaagatatttctgaaacactgcctcagagacttatcttcaatttaaaagtaaaaatcaatagaaatattggattcaatatgcagttttcaatttccaatcaaggtttctattgtgtactttcaaaaatattctttatcttctgtacatttgtactgaaaataatatgttttgatgtaggcctatttggaataacttgtgtcttcatccctaacttttgaataaaaattaccaacagaccaaatttttgaatttatattttcacagtgcctggttattcacagatattaaatttaagtgtgacattagtttagtcattttcaattgtgtgggatgttttcaagttgagagaataattgaaagggattttatgtcagaagtatataaatatttaaatgaagtttttaccaatatatactatgtcctagtgaatttgtggttaaagagctaatcttcaccaggaatcaagaaaaattaagtcacaaatgtgctattcaaatagaaaacctttgtgatcaaatgaggaccatacttggttaaaaaaaattaatttatttattcctatttccataagttgcattatatctacactattcccaggatggccccaatagaagtgttcttgccgggaagacatgaattcctcgttctatacctgtgaatatgcatgggatgtcatcaatggtaaagtgagtcttcctaaatgctaaatgccaagtagaataagagcaaatgttgggcttagttgatttagctataaaaatactcagtgataaataagaatggtttcatgatacaactatgtttggtttaagaaaaacaagtacttgttcctattcgaagagacaacagctgaaatgaaaaagatttgacaaagaaagcatagtaatggaatgatttcttaaactgacgtgtagacaagcaggtagataaaaatctctgtcttgtcttcagcatggtattttagacagatcaatgaactgaaggtgtgaacagagtggaatgaatacagtagtcctctcttatccaaggtttcactttctatagtttcagttacccaggctcaacccatgtcattgtgttgtatcaacagtgcagtaagatattttgagagagaaaaagagaacagaagagacgacattcacataacttatattatatggttatagtggttctcttttattattagttgttaacctcttactatgcctaatttataaattaaactatcacagatatacatatatatatggcttggtactactcagtttcaggcatccactgagggtattagaaagtatcccttgcagataaagggggacttctgcaaaacagtaagaattggaaagcacagcatgtattacttcatcagggaaaatgccttatacattgctataacacaagaaatgataccgacgggacagaaaaacaagcaggctccattgattttccctggctcctcatattccttactaatgcacttgaggaagtaaataatgcatacaactgattgcattagaggtgactgtctccttattcatgcataagtcaaaaggcattattagtgcgttagagacttggaatcagttccagattgcagagtctctttgcctaatgactgtcacaaatgggaaactcacaaaccaaagcaaccaaacaagacttttttcatagttagctcatatattgccttcctttgcatcataaaaataaaaatgttgttttatggaacaaacacttttttaatgcatgaaatttttatcaagtaagaaaagacataaaaggttttcataaaggaatattatattgtcctttgtgatccttcttaaatcggttgttgttatttcttttttaacctaggcaagataatcataaacaaattgatgttacaagccttatgtgattgtctcaataatttgtatagcctggggaaggactatatatcttaatccattattgtatctttcattgcttaattatggtagatgttcaataaagcaggatggttcttccatataattttatattattgataaataaccaaaagtatcctctccctgatcactcatttgcatatggtctacaaaatgttaattgaactatgttttcttctagtaaattctgcaacagtgacgtactttgactttgtcactacggaagcattgttaatttaactttggtaccactgatttttataacatttatttctgcagctttttaatctcccagagccttccatattatgttcaatacctggctttggtgagcattttcaatggtaaaacaaactcattccccttttggtgggtaggttgtgtttttttcccttactcctgagtgggatctgtgcaaaagcacaaaggactggttaagttttcagttaagatgatgggatgtatgagatttataaatggaatggaatgttgatgatctaaaaatccatggcctctgcacaaaagccaagctaatttctagaacatgtaagaaaaagtaaacttgatttaatagataggaacatattacttcttttaaaaatctattctaaattcttcctggcactataacagaccttccctcttgcaacttagtaggattaagtttaataggattaaatttagttctaattttttgaaaaaacttttagagtaatttaaaatttacagaaaagttgcaaagaaaataccatgccccatgcccagttttccctaccggcaatgtcttgtgttatgtatgtcacaactaatgacaaatattgatacatttaattaactgaagttcagtcctaacattttaaaaatacattatattgaaaagaaaatattttatatataattaattgattgtttctcaggtttaaaataaagaccaattagaaaatatatgtagcaaaaatagcatgccatattaattcgtaagaaatgattttgtgattcaatacaggtgaccagatagaaatgtataacaaatatacagttttgtatatgctattgtgttataatttatttcaatagtatatttatttagactttaatgtaccacaactaaaataaattctgcaagaaacattgtgtgcttagacggttttgaacagggctgggcaaggtggctcatgcctgtaatcctagtgatttgggagtctgagatgagaggatttcttgagcccaggagtttgagaacagcttgggtaacatagtgagaccctgtatctaaaaaaaagaagaaaaagaaaagaaaagaaaaagaaaaaaagaaaaaattagctgggtgtggtagctgggtatggtggatacagtctatctgggactatagactatatgcctatagtcccagatatgctggagggagcagagggaagctaaggcaagagaatcatgtgagcctgggaagttgtggctgcagtgagctgtggtcatgccactgcactccagcctgggtgacaagagagacagagtgagaccctgtctcaaaaaattaaaaaagaaaaacagattttcaacagaaagctatcttcccatttaacttgaaaaaattaagtattatcttgtaaggtcagtcatctcagtaataaccgtttactgaggactgtgtgtcaggtgttttgcaaagtgcttgacacacattatgttccatcctatcaacagcccttccatgtttgtttctatgttatagatgaggaaattgaaactcagcaaagaatagaaagtagcttagggataaacaaacagccaagaaatgatcgatacaggtttaaaggaggaggaagaaggggtggggagaggaaagtggggaagtggagaaggggaggaagaggaagaagagaaaagatgtccaggggaaataatctcctaaagcataaagtatgtaataccacctcatgtttgtaacaggagattcagtacttaaatccaatcctgattaatggaatagagtgtttagtcatctttgcattacgtaaatgagagtgattggtctaaactggcatttttgcaaattaggttttttttcaaatagtgctactggcaggtctatcagggaagtgatatagaactggtttaatacaaaaggctggctgggcacagtgactcatgcctataattttagcactttgggaggccaaggcaggcagatcatctgagatcaggagttcgagaccagcctggccaacatgacgaaaaccccatctttactaaaaacacaaaaattagctgggcatggtggtgcatgcctgtaatcccagctactcaggaggctgaggcaggagaatcgcttgagcccaggaggaggaggttgcagtgagctgagatcacgccactgcactacagcctaggtgacagacctagactccatctcaaaaaaaaaaaaatgctactgtaatgtgtgaaaattattaatgaattttatgtcacaggttttcatcttttgcaaggggatgtttgtggtagttatttataaagaggctgagagataaaaattatattaaactgagtagttcttataaggcattaaaatgaattatcttactacttagcagaattgtgaggttctgttactcaagatttctaagtggagatagtaggaaagttttcttttggtttagtaatccatagatacgtgtgcatctttgtgttataaggtagaggcttaggatgtttgaggctcttgttatactcctgaccctgaattcctttcttgattgggaatagcaagataaatacacctggggcaccatctggaaatgtattatctctctttgattactataatttctgtgtctgattgtcacagctggagtctcttgaatttgggggctccaacagggtatttttgcctattttgaaaatgtaagtaacaatcaacatttatcaatgttatttttaaatgtaagcatcatactttatttatttatttatttagagacagagtctcattctgtcacccaggctggagtagagtggtgcaatcttagctaactgcagcattgaactactagggtccagtgatcctttcacctcagcctcctgagtagctgagactacaggtgcatgccaccatgcccagctattttttttattatttttatttttattttaaagacagggtctcattatgttgcccaggctggtctctaactcctggtctcaagtgatcctcccaccttggcctcccaaagtatgaggattataggtatgagcctccacacctaaccagcatcatactttagattcattcttcagaaaatggttttgcttcagcattgtttattaagtagaaaataagtttcaaaaccaaagaacaggctaggaagagtttgttaaagggtacaaaattacagctagataggaagaatgagttctagtgttgtacaccactgtagattactatagttagcaataatgtatagctgcaaatagctagaaggagaatattgaacattttaaatatacagaaatgataaatgtttgagatattgaatatgctatttatcctgatccgatcactatgcattctgtgtatggaaacactatgtaccccatgaatatgtataattattttcaattttaaaaaggagagttaatgctaaatgagtttctcagtggtctaattgcttttggattcagaatctctctttttaatcatcagatatacagcttgagatttcacatttcagcctaaagaaacacagtaatattaagtaaaggtttgatacactgcagctgtaacaacagcaacagaacgtttgtcgactgttactccgttacccaaattggaaaagcacatgtatagtagtaatttatgtttttggtaacagaagaaggaaacataatttcacaaaacatttttatttttttccaaataatatttgaaaaatgaggatgcttctcagaagaacccaaacaaatactaatctcggccactatgttgacctctgcaaaggcaatgtaaatgggagagacccagggaatagcttggtatttatcaaagacatcataatttgcttcttccacaccatctcactaggacatatgtttactgataaagacccagatacatgagataagtgttatggaaaagaactaacttcttctgttaattggcaatcctactctttaggtaactgcttcccagtaaattaagaccaatcagtaagctttctttgatcaggtcagctaagagaatcaggggcatcatttttcttaggaaaaaactatttttaattatattctgttttcatcataatctcatatacctttggggcatcaggaaatcattattgcatacctactacgtgctgggtacttttttatgtactaaggagacagtaatgaaaaaataaacaggcaaaacaaaacaaaacaaaacaaaaaaaccctttttctcacatatgtactaatgggaaaaagctagacaattgataaaatatataaggagattgtattctattctttgttataatagatagtggtaaatgctatagagagaaataaaaaggcctagagtttgggggcagtggttaagattacagcttttaaggatgaaatcagggatgtatcactgaagagggacagttggataaaagttttaaggagatgagggagtgagctttgcagatattgaagacaggagcatccaggtgggaggaagcgtgtgtaaaggccctgagaatggcacgtttggaagtttaagacatgacagacgaccttgcacataggaggaatgcagagcatatttcattaaatcaatagtaggcttcaagatattaagtgtttttccgtacattatggtctaattcaatgacattctttctttacgcacaggtaataggattgaatttgacaagaatattcaaatatggttcacaaactgaaaacagtttgcttcgtatgtaggatttcatataatttcaagccttgttttttcattcactcttcatattaatgctttaaacagttgtaactttctctcataattgtgaattggtttttccaggagtgtaattggctgtgaaattggactctttttttcttctgtaaactgtcttcatgctttgtggagaatagcattctccaatttctcttccttcctttatttttgctttgttgaatagtttcacccagaagagaaagagaaaatccctgaaagcattacacacaaaaggtcatttgtcctattgccagctcaatgataaaagctcagagagtgaatagtactcccctgcaaaataagcgttgataattgaaacaccaaacaaacaaaatagataccaaattctttgaaacaatagtctactgctgccctctcaaattgggatacatttttcttttcttacaaatcaaaaaccctaaaaccctaaaggattcactctccaaaagcctttctcttgagttttgtcctgcaatttgaataagctctttgtcttcatactgtcctcacattgctgagggagctctgatgagcatatacccctctttccaagagggtatggtgacagagcagaccctagcccctgctgctgttctcttgctccaccaagagaatgagtggcagtgttttctgtgaataaaacaaaaaaatgtaaagcatacatcaaactgtacagtcagtactgaaagtgcccaagtgccatcctgttcatgccgtgagctatatgattggcctgggtgtagaagcctgaaggtgaattatcctgttgggttcagatgagtgcaaattagctgcaatttaagtattaaagtggatatgaacttgaactagagtatatccaatgtgcaaactaattgtagccattttatctagcaggttccaaaattacccttgaaacttaaaacacttgttcctgaaaattcttatgaaatagcctctgttcaaattagaagggaataaacctcatagagcttctggttaaatgtgaagacatttacttttggtgaaaaaaaaatgcatcagctatttatatcagaatatgtggattggaatactgactctaactcttagtaactaacccatttgggaaatacgcaataatgaagttggcagtgtttttggtgttctttcaaactgggttctgaacttatttattatatgtctggcaatgggaaattaaagaagaaaaatagatatagcagacttattcctggaagagcatcttgggaagataagacatatatatgatagagattaaagagtaaagtaattaatataatgattggtatcactataataccagaaacaaggcttaagtgccaaatgtagaaaatataatgtttgagtcctaaggagggagaaattatggcacactggcaattcctagaaatttctctctccagggataagacttggcacttgactatgatatgtcaaagttagaacagaacatagagactacctggctcagtttctcatcacacagatattaagaattccacagtcccacaaagctgcaagttaaatgggcctgcagcaaagacttcctaagccctaaaccaagcagttctttccttgttttatgtactcatttctgagtaaataaactcattgaacaagcgttttgagtgcctatatgttccagacgctgctctgagtgttgagaaccagtgggcaaaatttacaaaatcaattgatgtaatggaactagctttctagtagattatatacacagtgagtttatatttttgaaaataatttttcttagtgaaaagaatgtaatggggttggggtgggcaggtaagatagtgaaggtttctccgagaagttgtcattcacacagagaattaaattataaagagtcagctatgggcgggaaaacatttccagcagtgagaaaacaaggatcaaaagctctgggggaagaaaatgcgactggatggaggacccacaggaggtattccatatctgtaaacaaagatatggaaatgagaagcagtcattgtcctgtgatcactgattgttcttttaatataagttcccacttcaatatgataaggacaccccattgggaagacaaaaaaatacagtagatcttaaatgttgtcaatatatagacacatacacacacataaaaaaaaaagagagagagagaaagaaaaaacaaggtagtggtaactatgggaggtgataatatgttaattagtttaattgtgattacttcacaatgtgtacatatatcacaacactaagttgttcatcttaaataattttatttataaatgataccacaataaagctggaaaaattagaaaatactatacataacttgaggattcaactcaattttaaaaattttctttgtactgacatttgccattctgtttattttttgaatatatgtgcctctccctactcactttatatgaaataatgtagtaggctgatggttggggtgggagagatgaaccactttttcatgttcacacctgcggcaccaaaagcaaaagaaagcctccaaggatcactatcaggatgctggtccctgggacctttccctgtcaaagcccatctgccttcctagacacttttctgagtaaacaagggctgatttccaggcagcacttatgtggttagtttaaattttgtacatcagggcattcgagggagaccacattacccagtgggagtttacttggcaaagtacatccttctacaggagaatgtaagagttttacattacaggattcagccagatatggtgcaaaatgcaattaactggttatttttaaaaaccatactgtttttttgagacagagtctccctctatcacccaggctggaagacagtgagttgatctcggctcactggaacctccacctcctgggttcaaacaattattgtgcctcagtctcccaagtagctgaaactactggcctgcaccaccacgcccagctaatttttgtattttttgtagagatgggtttttgccatgttggccaggctgttctcaaactcctgacctcaggtgatctgcccacctcagcctctcaaagtgctgggattacaggtgtcagccaccatgcttggccttaaagcatttcatttgaagttttgtcagaactggcaaatattggaccctaagtttgatggagaaaggtattctgggctgctttcttgcctttcagcttgttggcagtatcattatcagaataacttcttccctgttcatggaaaaaatgtcaatggctgctaatctggaaagagaatgtgtaatttaaatgggaaggtgaatcatggtttgtcctcccaagaaaaaaaaaatgcttcactagagttgcaaagtggacttaggtattttcatttctttcccatgttgaacaatcttcacccttatgtattttcagagtattgtccgaatgagtgaaataagatgacattttattggcagatttttcggattcaaatgcatatatagtgcagggaatacatttcttaatttgattgatgaggatccgatacactcactgtctcctctgaggagcaattggttacatgtagagcataacgtaaataatttgaatccattttttcatatattttttaattgttgttttattttttttcatagagatggagtcttgctatgttgcccagctgttcttgaactcctgggctcaagaagtcctcctgccttgacctctcaaagtgctggaattactggaatgaaccactgggcttagccccatttttcacctgtaaccttagtttgtacaattgttgacttttctgttagaaaatagggaaccttcgtatttaaataactttatagcaagtattgaatgtcaaaggttaacttcaaatagcaaatgctttttagtgttcctctacccaatgtaaaacaacaaaattaaccaacttccagagcagtataagaattctaaaagcatcattacaccccctggctttacattttacactccatatactgcaaaaaaagaaaaaaaaggaagattgtaagatgctagtataactgataattaagcgaccattggtcaacttgtaatgatcagggatggtttggaagtgggcatagaaccaatattgttgtagtaagaagtggtggctatgaggatagggaggtagtgatgctgggtgtgggccgagtagactagattatttcaggtgcatatctgtagtcaagcacataaaatgtgtaattcagaaactattacaatataatatgacttgccagtttttatgagctgttaaccctataccaaattccaatatacttagcagagttttgatttcttctttcttcttgttcaagcccatatgtgtttatgtcaggagtaaaccaaatacttggaggatataaccacctaccatgggttaagactagaagacagtagagactgaaaggcaagataaggttgtgttttctccagcaaacctttgtatttaaataactttatagcaagtattgactgtcaaaggttgcctgactaggacagcttcttaaatattgatgggtttgatacggtttgtcttagcttcttaagacatcaaaacataggagaaaggatgctgaactttggagtatttgtcttcattaaatacatgagtgacaggttaggtgatctgcttctgtgccaggttaaataatgaactataatattatagtagtaataataatatctgccttttgtaaaatgctttgtgtactaagcactcggatgagtactttatatactttatcttctttaatctaaattaccatgcatgagacagctgctgttatttacagagaagaaaacccacaacaggaaagttgtggcagaaacttgccagggtcactaagctaggaaatggaggagccaggtttcatacagagcagtttgagcatcagaaaccaaccagaactacagttacctggcattgggtaaaccatgtcattctctgcatttgtttctttaactattaatttatttaaaacgtatgcctccctgatgaggctgttgtattaagtgaaataatgcatataaatgcggacagttctgccaggtgcatggtaggccggttttaccagctagtatggtgtatttctactacaactcattttactggcagcagctcatctgaagctctgattgttttagagcattttgatgttcctttgaatagattaatttagatctgacgataagatgttataactaagactctaattctgatacaatcacccaaactagtatatatatatatatatatgtgtgtgtgtgtttatatatgtatatatatgatataaggatatgtgatatacagagaatatgatggtatgtatgtatatacatacagttgacccttgaatgacacaggagttggatctgtccccccgcacagcccgcacagctgaacatccacgtataactttcaattacactcaaattgaactactagtagcctactgatgaggggaaaccttacctatgacaggaaaattcaatgaacacatattttgtatgctctatgtattatatactgtattcttacaataaattaagctagagaaaaaaattgttattaagaaaataaggaagacgaagtatatttactgttcattaagtggaaatggatcaccataaaggtcttcatcctcactgccttcaaattgagtagtctgaagaagaggaagggtcttgctgtctcaggagtggcagaagtggaagaaaatccatgaataaatgaaactgtacagttcaaacctaggtgttttcaaaggttaactttatacatatgggtgtgtgttttctaattgctgatggaaattatatacttaaaccattgttattttgacctgtcgaattttctcttaatccctaatttagaagaatttttgaaaaaaaaaatccctaagtatcctgaaaatagactatgattttcacatcctttaaaaattgatgtatagggtgtgaaaatgaagccagacaaaagaaatgagatcacttctttttaaaattaaactttgtcattgtttgtactagctatcctacagccccaatatagttttgaaattgaatagattcctaatggaactgtaacccatcaaaatgtgtttcctgaagcttcacaaaactgcatggacatttcgacttataatataacaggtgtataaatatatttataatttaggttataccactaacttcttccttacacaagttctgtggtgagactgccagagtttgaatcttgcttcaccacttatcagcatgtactcctatgcaagttgtttagattctctgcatttgacgtgctcaccagtgaaatggagataataaacccttaagtaattagggttgtcatgagcattagcgtttatgtgcctgccatgtaggaatcctcagttaatgttagctgctattaatacaattattatcaaaatcattattataattctcatttttaaaaagtagtttattgaaaacaacactgaattagtagacaaatcctatgtttaacctgaaaggtgtgttactgtctcaacattatgattttctcatcaataaaatagaaataataatacttgtcttggctatctcattggattattctgagaatccaatgagatgccattggtgaaagtgatatgaaaattgctaaatgttatataaacataaagtgatatttatgttatattaaagaatgagcctgagagaaagactgaagaaatgtttcatgagggggtgaggcagtcccttttaagagaagcaggaagaagttttcacgagctcttgggtacaggcaggtgaaaagctgaaactcatgctgaaaatgagagaatatcaaaaaggcatgaacatactgatatggcagatttctgtttgacacttagggaatatgaaatgcattttacaaagaagcatagatgagataacaaagattatagttcataatgggggaggatttcttactttctgtttggcagattttgaatttctactagtaccttaatcagatgatgtaagatagatatattattgtggagaattcacctttctgagatgtgcagatcagcttggcatatattgcaagccctgagaaaagtactggcttaaaatttcttatctaccggaaagcatacgaaatattgtgagagtggagagagaaaaagaagattgagagaaaaggagagagagagaaaatggggtaaggatgtcaaagtttcacatttgttggtttctagcaaaggggcagtataaagcaatttgtagttgtcacatttgaacacataaaattaaaattttttcaaaaagcaatttgctttattgatggttccatttttacttttgtaaatttctgagtaaaacatactttttaatcttttctgacaatcctttctatctgaaaatctgagctatttatcagaaatcatgtcagccatacactgtgccatgtgatattttgcatttatattgagtccttcaatcaataaaaaatatattagagtgctttaagaatcaccttacagagtaatgaaaggaaatcagtttaaaactaagtggcttttgatattttacaaggtgcactgtataaatttaataccacccagaagaataggactcttgaggctgagaccaggcagtatgttggaatctgggaattatgaagtgtttaatgctgaaagatgccttagacattatccaggtcaatatccctatttacagatgagaaaatagagccacacaatggattaattcagtgattctatttgcaaagtatggtttctgtaggatcagtatgacctaagaacacattagaaattccaattccaggggcctattccccagacctactgaaactctgggatcaggccagcaatctttttttgtttgtttgttttttgagatgggggtctgtgtattttaagaagccctccaagtgattctgatatgcacgatagcttgagaaccactggactggcttttaatttttctaacacctaccccaatattttacgcattgtaccatgctgctgcttctctttcaatcaaagttttactctttagaattgaggggagtaagaattaaactcaactgtgtccacgtataccaaaatagtgggaaaatcaaggaaataattttgtaacacagctcttaaaacaactgtcagactcgagaattgttagatgaaagtagtattcttaagatttaacattgtagataactgtctcatttccctactccacagaaactgattaaactacaatctctaagagatattcaggaacactgctctagcctcatactatttagaaatagccctaatattttgattgaaatgagtcaatcctatatcacttcacctgtcttgcatccagattaacaaagaactgcaaaggctggtaaacagagccccagccatcttttgagttttctcccttgccctgcaaatacaaacacttccttaactatcctgtaagctcatgtgtaatgctctgaatacttaatgggtattttaggatgctgagtatgggaaaaataagaattaatacacattgtatttaatcactaaaagattactattattgaactctgaatgatatataaattttccttttggttggtttaaatgggtttacttagattcattataattcttccataaaataattgtaatgggccttttgcaaacaaatcaggtacatgtttttcatcagtgaattcaagaagaaacaatgagaatcttctttggagacagaaaccaatttaccatgaagctaataaaccttaaactcagtgtccttccaaaatccagtgcctaattttggacttataattttgtattttttttcttgaacagagcctcctgaattctataagctttaggccccacataaccttcagctatggagtcttagttactctgtcagtgagcagaaatactttacatgttgaactcggtaaaagtctttctgtttatgctcaatgaacattgaaccaaaatgagcacccgtgccagtttaaaagcaggtagaaattgtttgtatataagcaccttgacagttgtgagtggttttcgattagcattagactgggttgtaaaccacttctttagcattttagatttcctttctcttgaatagaaatagacaagaagcacttagcagcttaccacaacattaggcaatgaagtgtgtgttcacacatgtaaaaatgtatgtctctaaatgctttcaaaaggagggcaactttactgtcgatcagttctggccccaggaattcaaaaacacttcttagtttaaacattggaagagaaagcatctggattcaaatctgaaataaatgacaaatgcgtattaaatagatatttatttgatttgtgtggctctcatctctgatgtcttagagcaacagcataatttacatcttcatcttagtgaaggaactttttttcatcactgaaaggagacaaaaaatgattcagttgtaaatatgacctagtttaagtagatttggatgttatagctaatttaaaaattccaaaggggagggttgcatgattgctatgttcttttctggttatcattttaaaaattgaaatgttgccagcaatgcttttaggttagtcaaggatagggaggggaggtatgaaggagaaacaaaccatgtcatatctctaaataataacgctgttaagcaggcaaatggtagcactcaacattccaactcactctgatgtgttaatatattgaggctttagattcaattgctctagagttttagactcattacctcttttcgcagtgttactgttagctagttgtcatctagtccaagaaattagtctctttgaacctcaatttcttcaaccatcaaagatacataacacctactacagatgtgtgagaatcaagttatgttaagcttctaggatggtatctggcacacagtcaataaatacaaaacagactttatagccttctcagtgaataaatctgaagcacattttatatacatgagatcacctggggggaactaggttgagaattaaagtgcctcttgcctatgtgtgtctatatttgggtaacaaaagcctagagcttttgctgacatagttgaaggagtaaatggtgagagcaggagagacaagtaactgccatgctcttcttgtgaacttttgataacattacagatgatatagtcacttacatggaattggttgtactttgtcttgatactctactttaaaagctggtagcttgttaaatgttctgccattcacggctacaagtgagagctgtgagttcccgagggagccctatatacagtgatgcctgtggtactgagaaactaagctgggttccagaagtttattaatgcttgctttcaaagtgacaagggggatcacaatgtaagattacagtatttgtcatcaccttctcttcatttttctttactctctttcaataagaagttggccttttggttaggcctctccagatggtaatatactagcgtaagattccagtaagaccaacaccacactgcagtttgaggtgtgttccatggctctgccaatgttgtgttttcattttttaattactcaacagtttgctacaacgactgagatctctaccatagaaattgcttcttggattgagatattctttccagaatgtcacagaaaaagttttatattttacctgggttgatttaacttcatcggtgggaagacctgattcttctttttatagagatgtatataactcattgtgattagttccttttatccttgctaccaggaaaacaatggtaaattgaatatataaaaactatatagattataatcaataagtttatatacatgtgtataactgtcccacttttgctatatgagcccgctcatggcttcatcatttttttaacctagaacttttcttcaactcctaaggacctgcacaactttgagaatggagccattttagagacctataatatattaattctaatacactatcactagtcataagaacaattttaaaaatagataggttgaaattttagagttaagtatgaaacaaatcagtaactttttattaaatttgtatttaaacttaaaagttttaaagatagattatatacaaataatacatattcattgttatgaaaataatacaataaagaaaaatacaaacatattataacaattaatattcacttaggtcttactgtgtgccaggaacttggctaagatattacatcatgaggtaggctttgtttttcccatatcacagataataaaatggcagcttcaagaggtgaagtaacttgcccatggtcacgcactttgtagtgaagctggaatttgaagttaggtaccctgattacagaattgtgattctcaaccactatattacaaatccaacccaatttataactctttattagcatacttcgaaacagttatgtgtatgaatatgtgtatgcccatacatgtatagtgacataaaattatatataatgatatcttactttccatgttgttatgtacactaccttttgttcaacaatgtatcatgggctttctcctctatataaaaggattgatatacatacataatattatattctatatctcaaaaatagcagggcccttttgatgaatatgtgttatgtcctatttcacaaatagagaggtatagataatttccctagaatatccttttacagatcctttatacactgatgatttgtttccttggagtaaatcctaataatgggaatagtgggacaaaggacatacccattttatgttgtggcacatccatctaagcaaccaaacaggaaggctttgcaaatgtatcttcccagcaacaaggtaagagagcaatatcccattcctaagtgttattttcaaaattagattatatcaatatttttaaactttgctaactgtaattgtttgaggatggaattattttcttttttttaactgaattctaaatgtgatagtaatttttttcattttctattgtcatttgcgtctacttggggaattaatgaacttgtgcttttaaatagccttatgatccaaataaatatttttacaagcttaaactattagaatcccataatattagcaaaatgtacaatacttttctgtttcacttatgttgctcacttcaaaatctaatacttttttaaaaaatagaactatcatacttggattctataaagtttactatcaaaaagtttaaggtaatcacttaccatttctgagatggattaaaatgttatagtacagtgtggattcatattgctgtgaaagtcactttatctaaaagcttttcctggaggaacttatggtgagataaatggtttcatatttttggtacgttatttcccataaagcaatatattccaaatgtgttagcattgtacacttgcatcatattagtcaatctgccaacctaaaaaaatgtaaaaagcaaaaatatttcccatgtagtattaccataaaaagcagtaactcactagtgtttttattcaaaacacaaatgtgaagacatactgaatttaaatcaactatattactttattttgctgttttaaaataatactaatgttgtatagtcttcttacaattatgtgcatttcctttttgcatgtatgaaaatcctaaatgtggtattcctatcgaaatgctgactggtgaaaagaaataggcacagtattgaaattgcatcatgatagaggatctagataagtagttttgaatattttcattactatcacttttaccacttacaagtcagttttgtgaatcaatcaggtttataaaataaatatcttgatggaataagatatttaccaagttacaccatcctataaacaaaagcattcaaaacctgaaacagctgatgtcttggagttttgttttggttacctgcagtttggttttgattacctatgtttattctagtttcatatcccatctacatttgtctaagctactttacatcattggttacttacttagtccctcttctgtggtatttccgtgcttcctggaatattgttcattcaatatattcaattgacaggcagttttttaaactttggttcagtaacagaggtactaaatcacctggaagttgtttctgtgactagtaggctacactgaaattaacagatttgttgttcgttaggattctctaatcatgttcattttcaggatataataacagtccagaggcttgtaagttgtagtctattaaatccctcttcctagagagttgataaaacaggaacataatgctcttcattcctattttcttctctggatatttctaacaatttcatgataagtcctaatagataaatctaagcacacttcaattagattattggtaaatagcaatccttaccaaaattgccttttctactcctttagcttgaagacttaactccaagtggtcaaattaataacctgaatttttaaatgtgatcatttccttcacaaaccatactatttttaggttgtaattcatactcataattttttctaaagataatcatttttccttgtcattttctgtttttaaagacattcttctgtccaatcctcatcttttgacagtccaaaattttgtccgtcatgactggatttttcatggtaagtgtagaagtatagagaaacaacctataatggatctatccctctttgctgggcagtggtgagagggcaccattgaagtctgtcttctcacagggccaagaacttcaggattagtgaaaccaagagaaggctgatgctttcaaatacatatgccccttaactaagccatactgtcagcaataaatcttctatttatcctttaatgtcttttaataatagctttgaaatgggctattaatgccaacattttcaatagagtctgttagaagacaccatgttactcatgctagctctgtatgcaagtttacattaattacagtgattttctttctactttttatttgagaatctttgaaataattatgttttaatgagattgggaccaaccatagaccatatagcatatttaaatcagttttgtgttgtgaacttttgtcttaattttacctgtgtgttgccatttagccatttttccagaagagtttggaataagttctgttggttttttttttttttttttttttttttttagacagagtctcacccaggctggagtgcagtggcatgatctcagctcactgcaacttctgcctcctgggttcaagcgattatcatgcctcagcctcctgagtagctgggactacaggtgcgtgccaccacgcccagctaatttttatattttttgtagaaatggggtttcaccgtgttggccaggctgatcttgaacccctgacctctagtgatctgcccaccttggcctcccaaagtgctgggattacaggtgtgagccaccacacctggctgattttattattcataatggatgtcttagtaattctgggggagttttgtgaaatgcacatgaaattaatacacatatagaaaagatgaagtgtgatgtcttcaatacatttgcaatttttaattatctctcactatgaaacattaacataaatgtttcctttgtcactgagttttgtgatactgttagattaaggaaaataaagtttcagaaagactagcatgtcacttataatacctaaaagtgaacatatcttttaacaaaatgttatatcttaattataccatatttaccaatttttatttggaatacaaagtcacaaatggaagagaaaaagccaacataatattttgattagatttcatgaagtccttttctgatctattaactatatgaggagactggctattgttaactacttctagggtaataatttcattttcactatatttccatttaatttataaatgttgatatttgtgtcaataaagttctcctatgactattagcacttacagattttagcaatcctcacaatcactttttatgtgaagagtcttgaatttagcatgtaaaacatctagtataaattaaaagaaaatgtagattaaatggatatatgaaatcaaactgtctttcactgggaattgggatctggcagttacattttaatatatgttttctttaaaatccttccacatcccattcttctctctctacctctctggaagtaataacgcttctccagttggtctgcatctttctcatccacattctcatatttttactacatatgtgtttgtctgtacacaaaatatagtgtttgtgagtgttcatgagatttataaataggtgccacaatctttgtatccttcagcaacttgtctttgtcactctctgttatgtttttaagatatatccatgctgttatgtgtatatatagtttgttaattttaagttctatttcatagtctattgcaaggtacaatgcagtttgttgatctttacttattgttaaaactttgagatcattcacccaaattttgttattacaaacaacattacaattattattcttgcatgggaattctgaaattctgttatcctatattcttgccaacacatggtattattagactttagccgttgacagtataatagatttgaaatggtaccactttgtacttttaatcggtatgtttctgaattaaaaaaattatttttctgtgttaaaatattttaaaaacattattaagcttttataccactcctctttcttgaaaatgccattttcatggaagagaattaagctcttgtccaacacttacctacattagcttaatatacttaaacagccttttgtcttccataagaagaaagaaaagatcaatttgaggggcagctattttttattaaatgtagaaaaattatattctttttttttgtatattatgcaactatgctttttctaaattagctcactggagacagaaggattcatgtctttagcttttttatttttgtttttagagagatctgtcaattagagtgaaatgattaaatcatcacctacttgacaccaagcggggtggtctcctacttccttagtatttattgcgggatctggccagcagcccacaatgcaatggggctctttctttgttcccaggtggatcagcaggtcgagaaataatagacacgcacaagatagtgaaagctgggtccaggggggggtcactgccttctggtcccacgatgcctccaatgcactggatataccagcatttattaagtttagtgagggcaggagtaggttagtgagggatttagggtcatttgactatgaggtgagatggtcacatggggatgaagtaattctttaacataacatctgtatgcagaagtacagtatacagagataagaatttacaatatagtgtgtgcatcagtaatttccaacagagccttaaaacagaaacgcagtctttccataacctatgattagcaagatattaatcagcaggaacagttgcagcaaaagctggttacaaacaatccatagaaacaggacgtgaagctagacaaccggttataccagaaattctcagaagggagtatgccctaaccctaaagaggcctagaatagccatggcaagatgagggcatttatagccctatcttatccatatggacaggtgcccctcatgcgtctgtttataggctctccacaagggtcgcattccattccccgagctatgaacatctgcttttctgggataggaatcttggtgatgtgaaacctccctgactacatgtccattcataggctctctgtagggggaagcacgtcacgcgctgctggctcattctggcagtccaacctggcattgtctttacacaatcttgcatgcaattttatatttacaataatcaggagcatttcatcttttattccatagcaatagtttcagggggtctccctacaagtattacatactctacctacacaatcctgcatgcaattttatatttacaataatcaggagcatttcatcttttattccatagcaatagtttcagggggtctccctacaagtattacatactctacctagttcatcttaaacacactccaatgaaggaataagtacattaaaaaaaaaaatgggctggtcctgccttttaaatggtccacaaagcacgtttgtttagaatttggaacctgtatttttctagaaggaatatgctaaaatttaaagactaagtagagactaactgttcaggtaagttcttaaattaatgtaactgaaaaaaggattgaattggctgaaaacaaatttaactgctattctgctatgatagcctcagaacctgaatagtgaaaaaataaaataaatgagtaaaaaacaattgaatgactaatctataatattctcttctctgagaaaatgtattatgtaagccgtgcttgttcttggggctctaaagagagtttgcctgtgacctctgcagtgagagtagctgctttttttctttttatctttttttgtaatttaagttccagggcacatgtgcaagatgcacaggtttgttacataggtaaacgtgtaccatggtggtttgctacacctctcaacccatcacctaggtattaagcccagagtgaattagctatttttcttgatgttcttccctccacccaccctccctgaccctccctgtatccatgtgttttcattgttcagctcccagttataagtgagaacatgcagtgtttggttttctgttcctgtgttagtttgctgaggacagtggcttccagcttcatccatgttcctgcaaaggacatgatctcattcctttttatggctgcataatactccatgatgtatatgtaccacattttctttatccagtctatcattgatgggcatttgggttggttccatgtctttgctgttgtgaatagtggagagtagctgcttttaatatatgtgaaccattagacagagaaaccgtcatgggtaatttattgggaattccatgggatttttaccatattgagttcataaaaaaagaaatatgaatactttcccatttagctgtgagattatttgcataatattgtcagccaccaaattaaaagataaattggaatcacaactattattttactactttactgttttgaacttaattcaacctgtagtgatgtagctggcaagacttatgtttgttggaagatacagttgattttgactttacatagtagtgtatctaattgtcatatgtaaaatactttatagataaaattatgtttctatataggagagtacacagaaagaatatagcacagtagtaagctattttgtaatctgaacatttttaagttcaagtttgcttttctcaaaactgagtgcaaagagagccaggataaagttaaaaagacatgggctttaaagtcagatgatgtttattaaaattctatctccattatatgaatttaggcaatttcttgacttctctgagtcttttctgagtcaaattctctgtcgatgaaatattaatagttaaaagttgtttactatttcagactcgaattctgctatctcatcattgtttagtcttctctattcattaaatgaaagcaccatctgctctattgctcagacctagaccaaagatgtttccttcattcctgtttttactctaaacacatgaaacccattagtaggtcctatctgcttttctaccaaaacatcttcacaatgcattcccttttctctatctacacttcagcattctatctagaccatcatcttctctatctagaatatagtgcagagagtatgccatttaccttagtcttcagtgacttaaaatttcataagcaaatgtcaggataattttgaaataattactggaaaagtgctaactgaggcagaaaatccttttaatgtgagtaggatgaattatacctcagatgcccttaaggtttgcatatatactataatggagcagagacaaagttttgtattgaatgcttcatttttcttaggattaattcacaatatttaatggtatggcatatagtataacacgggaactttttctcactctcttttttgaattgtgaatcaattctgttgagctaaggctttgcaaatctttcgatgggatataaattagagtaagaactggaattccacagagcataatctacctctagcacttatagcacttaatcagacatttgtagtcaaattacttccatttacttatttttccactcagaagtaacatttcccaggtatttttggagaattaattagtttccattaattaatttgtttccactatagctttaataactctgttgaacctcagggtaactcactgtaatggtgtggacctaatttgccaagtgcaatgcaatagccttttgtttgaatagaattcttctgtcaatgtcagtcaattaactaaagtgatttttaaatgcctaccttatgagccactttgtgccagggccctgtagggactccaagaatagactactacattcctagattcaaaaactaaaatctagttgggaagaaaagagcaacttacaaaatcatctaaaaggaatataatatataattaagattctgcaaagtgtaatatcaaagtaataaatgataggaaaattctcagggtagttgataccaaagttcaacagagttccattctcatagtgcaccctactaagtagaaagttacttacctgtttatcatcccgcctgacctattcttagttgtcaacatttatggagtgtctgggggaaagaagaaggggcagagagaggaataacaaaacaaattgtttctgagtacctaataaatttcagttacttatgtctacatgttttatcatttaatcttaataattatctggcaaaataggtttatttgtgcacgatttacagttcagaaaattgaggctcagagaagggaaagaacttacaccagatagttcagttaggaagacttaggcttctctttaccaagctactttctttctgcagcatcatataacctaccagttaaaacaaacaaacaaaactctataatagcaattcagtacaaagaagaattactgtaggtgttttgagaggatttggttagtttcttttcattagtttcctttatgatttacccccgataagtttaagaataacaagtgatagaataggtcttattagcaaaatgcatgataaaatggagtaatcaaatcaccattcaataggactcctggtctcttctgtcaagaaattcataaacttaacatgagatgtagataaacataatgaattataaaacagggagcatcaacagtaaaatttaagagtgaatcttctctttctgtgactactgtcttcttcataatcacttaaattctttctcaaaagggtagtttgatcaaggaaaataaaactggaaagataaggtaggatcatgctcctttgcataatttataaaagaataatattaatattcaaagctgattctggttgctaaaatattttggtgatttacacaatattgcagtaagaatatgtttcccatatgacgttacactttctcaaggagtaacaacttggtgcattattttattcattcaaaactaaactaattgtcttaattttaatattacctacagatggcttaaagttatctaagaaacttttataatatgtttataacataaatacttgcccattttctgcgaattccaggagctttctcaatgaacttaaaagagaactaccattcaatgcagcaattctgttactgggtatatatccaaaagaaaataaattggtctaccaaaaaagcacatgaacttgtacgttcatcacagcactattcacaatagcaaacatgtggaatcaacctaggagcccattagtggtggattggataaagaaaatgtggtgcatatacaccatggaatactacacagctataagaaggagtgaaatcatgtgctttgcagcaacgtgaatggagctgaggcccataatcctgagcaaattaacacaagaacaggaaaccaaataccgcatgttttcacatataagtaggagataaacatgataaacgggtacacatggccgtaaagataagaacgctagacactggggactagtagagtggggaggtagggcaagaggacaaggttcaaaagctacctgttgggtactatgctcactagctgggtgacaggatcaatgataccccaagcctcggtatcacgcaacatacccattttacaaacctgcacatataccttctgaatcaaaaataaatgttgaatttataataaggaaaagtaaagaaaaagacaggtgatgttggcattgtggaagccttgaaatccaagacaggaaaacattcatctttaatttgttcagctatagggagccactgaaggtttacagacatattacatactaaagctatagttttgaacaattagactaaaaatgatggcatatggattagaattggaaggaacaaacttggacaccactgtagcatttcagggaaaaagtagttagatggtggaatgatgataaaaggaagaaattgacatgaggtatcttctgatgtgttgtattgaggcctaaaatggacacattttataacttttcagttacatgttcatatgtgtttatgcatttcctgcaatgatagaatttcctttttgttctcccttcacatttattaaaactttattaaaatgttagcctcctttagctaagctaagtcttccccaacaaagtggttttgtccatgcttaggttagagttgtaaatgttaaaagtagctctgtttaaaaatttctgagcacaaatttacaaaataagttttttactgatgacagagagtatctgtgctatttttcctactgtctgatacccaaattatgttcacatttttagccaattcaaatagtagcaactgaaagaagagatagttgatatatactcctaatcttagaggaagttaacgtatttaaatttcctgcagctgttcctggtatgaggaaaaggatgtacatgtattcctgtcttcctgacttgtattattattcatgtctcaagatagactaagcatttctcaagagaaatctagtcatttaagtgtggcatattttataaatacaaatataagaatcactgattaattcacaaactgtgtactcaaacctcactaaaaatgggtctcactgtgtcctttaatattcacttattaaacgtttttctaggaacaacatattcagacgggcctcatttttttgtcatctgagaaatgtaggaactggctccttctagttggaagacttctaaaacttaaatccacttctaaatactcatagagagaccatctttctttccagagaaaataacaataatattaatagtagtaataatggaagaaagaataaaactgcagaaagggaatttttcctaaagcgaagctgtaatgaatagcagcagttttattcttccttaaggtgtatttgcatagttgtaaattacgcatgtcaaacaccaaacaaatcctcattccgtgtcaggattttaactccttacccaaagccaagtgtacattacagtgagtccatagagagtctatgtttttaagttaatccttacattaaattaaaggatgaagtggaaaggtttaaagcagtttcctctgctattgaattccaatacattaatatctaaaaattaagcacaatatttgtatagtgttactttagtattaaatattgtatagcttcacatggtaggattactctctagagcaaatgtacacatatatagcttgcttttcatttaaataccaatccattggcagcatagtacaagagaaatggttttgaagtaagttggctttgctaatcctggctccagaaactttggatttgacctggacgagtttcaaagtatctctgagcctcaatcttctcatctgaaaatgggaataataaatatctacttcagagaatgatgttttgggattatgtaagagacaatggacatactaagagattactcataaactgttcatacttttctataccatacaaaacatatctggattaaaacagatgcagaaccttcactttattccctggtgtatcattgttgctcagccttactttccccaaggtaaccaatcattaggaagtcaaagacagaatggttcagagatgctgatcgaagcaagtgcaaagttcattggccatatcctggagggactgtctcttgacaaacttatcagagattagaacatgctcattcatttaaaccagaaaacacattttgaatcctaatgtatgttagccattgccccaggcattgagtatacagtgcacatttttttttagcatcatcacactttggttttggtacatcttggaaaacactatcatccatacctttgacatgatcgtatcagtttcatttgttcctttggataaaagcacctaaaatcttttatctagaacagagatttggaaatttaaatataaaaaggcctgcagttttaaacgcaatttcctgagccctatctctagagataataactcaaagtctgaggtaggccttacaactatctgctcaatagattttgatcaacaaactagttagtctacagctgtatttctcagtttcactcaggacgtttatagccaaagtattcatatctaaatggactttgcgatttttaacaaggagaacttgtcaaaaacagtaaagaactagaaggtgatttcttcttgggaaaaaacaaattctggttataatcaaatttccaaatgaacagattttactatttgattgaaataaaccaatctatgactagaaaattaactgagggttgagattccagtgatcccgttggttattaagaggataatccgaaaggtttctttgatgtgccatgtgaaccacaattaaaataaacaaatatagcttgagctttccatcaaaaggctaggagatgtataacatcagttatagtaattgccttttgatagtagtccaagaatacagttacttcccttttttttcaatgattctatgaatattttaaatatacaaaagttttagatagataccaaataaaaatttgcatgcagctgtttttttggagagggttatacatgttaagtgtgagcttaatatgaataaatacatctagatgagctgttgttttgtctcgaaaccattccctgtcattagacaggctataagggaatgctgtaatattttgttgctgagttgctaactggatattcatgaactaggtgccctatcaactactcagtcaattgttgtgttaactagctgctatgtactttgctggcttctgctgagggaggctacaagacaaaacaaacaagggggaaaaacctgccatgtgtgtaaggtttcatagcaaaaagtttggataacctggggaaaataaattttgttgcaatatctaatgaaaagaataatgcagcccaggcacagtggctcacagctgtaatcccagcactttgggaggctgaggagggtgtatcacctgaggtcaggtttttgagaccaacctagccaatatcatgaaaccccgtctctactaaaaatacaaaaattagctgggtgtggtggcatgtgcctgtaattccagctactcaggaagcagagacaggagaattgcttgaaccaggaggcggaggttgcagtgagcccagatcgtgccactgcactccagcctgggcgacagagtgagactctgtctcaaaaatgaaacaaaaaaaagaacaatgcaatactttattctatgtgatttacagtataaaatggatatttaccaggttatgcaccttcactttcattttccttttggaaatccctttgtgtgttcaagtgcaaaacttgtaagaaagtcgaaaaatcaaaacgaagtttaagtggtaaaagtgacattattcactctacgaagataaaattaattctagtagaacttaaagttactctattttaattggagaaagaaatttctcacaagtaagaacattgtagagttgtgagatatactaagaagtaatcagaaatggaagcaatcaattactatgatgaataggagatcatagaagatcaatagaagatttaaatgcagcctgcttactgttgggagaaagtaggttagataaattcacaaggtcattaagagcttgtgtttgtgtgtttaacaagcagaacttgtcaaaaacaagatttttttctcttcaatgatggtcagaccaacatagttgtgactgattttgagaaattatttcattttcagcatctgctacaaacatatccaagaagtcaaagttgtagatccagattttagttggaaagcagaaaagcaccagttagcaatgagctttccttctttgtcttcctattgcacaagtgaagaaactgaggcttggagaggctacccgccccccacaatcattttcacttggagaataggtggcatatggggaactagaatcaaaatgctgagtccctctggctaattttctttccccattgtatgccatctattgtggaatcacaagtcatataaagaggatattaatgttctttttactttcatatattccccaaacatttagattgtaagaagaatattttactccagtgaagaaaattattctgtcaccaagaaaaaaggttcctctttctacacaaagatttccttgccaaaaactaattgcttagcataaaaatgccacccttttttcatgcattagtaaaatcaattctccccactctaatactgctcagccattgtgtctgtcagcactctgggtgcaaagctgaaatctaaagctgtgtcatcaagcacaattaattttagggttgattttgcagtttgtgagctctctaggctttgcgcttctcttctgttcttctgtaacctaccatttcgatatggggggggtggggtggtattgcaacctcaataaaacttagaaaaaaggaaaggaaatcaggtgcctttgttcatttcttcaaaactttattgaacacttacttctgtcaaacattggtaagcacaaggaatgtggaaacctgcaattaacagacctgagacaactgacagttagggagtgtactggacattgatttctaaattcagatggtaaatagtttaacaaaggcaaacacagtaggggtgttgttgaagcacacacaaggaacagtagaaacaaattgcctgaactcggattgaagaataagtaagagtcagtaaggaaaagtagtatgtgtgtgtgtgtgtgtgtgcctgtgtgtgcacacatacacgcatgcatacacatgtgtatgaaaggaaaaatttttgcatattaaagttctaagaaaagacatttagagacgaactctataatcctttgtcaaatgtaaaactgttggtagctatttgatctctattcatgggatacttctacattatcacagatcaaaccccctcacctcataaaatgtatcaaggaatttaagatcaattctgtcattagacaaaataaaaatcattttaaatggcacatttgaaagatttaacttttgatttttgaggattttcctcatagatatctattcagtcagtaaatatgactggtttgaatactttgttagaactggagaaatagagaagagtaagttgtcaccagcactgcagaaagtgttcagtctaattaacaagatacagttggcacccagtaattaagactattctgcaataaaatattcaaactggaatgaaggctgtgggggttgttaaaaaagcatcttccgtaaaaacttatctgagataatctttcgttcccatttgaatatttacatagatgcacagttccacctagagtctgattttcaattagacaaaaaaaagagatccagaatctctacttataaaaaacatttctgattttgtaattaagaagcccagtaattaaatatgcctggaaaattgtattagattgcattgcattgggtcaggtacatgctttcatttcacacttaagagccccttttaagagcataagcaaattaaaaaacagcaacccaacaaactctattccccctgttaggggggaaaacacattctaatacagcttctaatttgccttgctaattctaattagtatagtgtgagctgctggacagtttttccagaaggacactctgcaaagaagcatatttctttagctgcacgctctggggaaagaactcaaactgggaaaattgaatagatactttttctcatttgattgaaggttatagatgaaataaaataaggttcgaggaaatcaaaagaggctgcccttttctctattcagaactgctgaaaagattgaatgataagatgaaactgaaataaagcctccagaccattgcctttgaatggtttggtgagttgctacaattaaagaaacacttgtttactcttgccacaatgcatgagtgggatctactaggattctacttgtttctgggtgtttaatttcagttctgaccctagaaagtacaatctttgagagcagggattgtgtgctccactttgcttgtgctgacttccatagctcagatatactaactggatcagactcccacaatcaatacttgcctattgatgagaggcccatctcctgcctgccgtgattattgatcagggtctctgagaggattccatggccttcgtctgtccctaggactagccaagaacagcagacaccatacattcataaatagatccagggcaacttcccttctccttctcattttgagttttagtctaaatataaattattggctaatcagtgcacattctggcattctgggggctcagtaccattgttttaattatgaaaagaggacttttattttttaattttgactggggtccaactcaaatattctgaccagtttgtatgctacatctcatgaagggaacatatagaatgtttctgatgatcctcacaagtattgactagtaaattacaaataggacctccagttttgcatacagcttcttgaaaggggagcagttctttttgttctaaactgtgatggctttgttcctcatttaatcatttctgagtttaattttaagtcatcactatcaatttaaaagacaggttttgatatcaacattatgcacatcagattagcgttttgtacttttgcttttcagaaaataattgttttagcttaatggagtgtaagaataacttaagtaaaagaatgccatagttccatttggaggtctcttctaaattagtttattctattttgcttttgcagtatcactaaagtgccctgtatacagtactttgaagcttattgaaaatacatttctcatatacaaattatattgtcttcaagagaaatgctgatttcctttaagagggtaataccctatactgagaaaaacaaaaaacaaaaaactagacctagttttcagttccaattactaactgattgttggttattaaatattcgctttcttattagactttaccagttccagcaactggtttaccttagcctcctgtccatcatggccattactgattatgaaactaattagtgttgagtgcatgcctgttgagtgtaggctctcaaactgctgattgaatagatttggaagagggctctgacatctccatttttaacaaacatctcaaattattcaaacgcaggtggtcagggagccatctttgaaaaataccactcaacatggtaaaggcatcagagtctaccaatttatttaaatttaggttagacaaggtaaattagagtggtattgtgtgttactagaaaagtatggcaccaaaaggaaggcagttcctttttttttttaagacggagtctcggtctgtcacccaggctggagggcaatgatgtgatcttggctcactgcaacctctgcctcccaggttcaagtgattctcctgcctcatcctccagagtagctgggattacaggcatccactaccacacccaactaatttttgtatttttagtagagatggagtttcaccatgttgaccaggctgatcttgaactcctgacctcaggtaatctacccgcccttggcctcccaaagtgttgtgattacaggtgtgggccaccgtgcctgtaccccccatttttttttaagaattagggtcttactctgttggctaggctgtgagacagtagtgtaatcatagctcactgcagtctcaaactcctgggctcaagtcatcttccctgtcagcctcccaaggaggtaggactagaggtgtatgccaacatgcccatctaattttttaatttttaattttgtagagatggggtcttgtatattgctcaggctgatcttgaactcctggccacaattcatcttcccacctcggcctctaaaagcactgggattacagaattgagccaccatgcccggccaaggcagtttcatcactaaatacctgtaaagcctaagacatttgatcatgttctgcaggtagccataaagtctagaaacagttgaatatacataataaatggtttgttgatattacatcacaataaatgttatattcaatatgttgtctcatattaccactgcatagtttagtgcaatgtgcaaaattacaaggaacatcatgtgtgagcactccatttacatcaatctctgcatgtgtatctgtgatatgttgataaggttcctcaaatttcactaaataaacttttgatatgtttcctcaaatttcactaaataaactcttttcctttagcctaacacaaactcttaaatcatcaatccagttttgcagattatcactcagtcatttctatatcacagtggcctgggggatgtggtgtgctgtgctactggaaccactcagatggctttctttagcacataaaatggggcattatttgatcacttgaattagcaaacattgtttgtcttagactttagtaactacaggactgccttggtctcttgctgtactcaaccaaaaaggcataggctggggaattataaaatttggattagaaaaaaaataaatgttaagtgatcttatattaagggtctttcagtttttaaatgatttagagttatgaaatgagtcagtgctcctggatgtatgataatggaatcctgtggatcccattggtgatataaattaactctgtgccaagtgcggtggctcaagcctgtaaccccagcattttggaaagccaaggcagaaagattgcttgggtccagcagctcaagaccagtctaggcaacatagtgagatcccatctctacaaaaaatggtaaagcttagctggaggtagtagagcatgcctgtagtcccagctactcaggaggctgaggtggaaggatctcttgagcccaggaggttgagactgcagtgacctgggcaagagggaaagaccttgtttcaaaaaataaacagataaaaataggtcaggtgtggtggtggctcatgcctgtaatcccagaactttgggaggtcaaggcaggcagatcacttgaggtcaggagttcaagaccagcctggccaacatggtaaaatcctgtttctattaaaaataataaaaattagttgaacatgttggtgcatgcctgtaatagtagctacttgagaggctgaggcaggagaatcgcttgaacctgggaagtaaaggttgcagtgagctgagattgtgccactgcagtccagcctgggtgacagagtgagactctgccaataaataaataaataaataaataaataaatctggcaagcttttttccataatgaatctggatcctcttacctaagtttgattttagttgaatcatcactcctccaggtaaaccttttctgacctcccagaccaggtcagattcacctattcacctatctcatggtaatacatacttttaccattagtacttatgtaatttttgttttgttttgttttgttttttggaatggagcctcactctgtcacccaggctggagtgcagtggcaggatcttggctcactgcaacctctgccggattcaagcgattctcctgcctcagactcctgtgtagctgggcttacaggcgcctgccaccatgcccggctaatttttgtatttttagtagagatggggtttcactattttggtcaggctggtcccaaactcctgacctcatgatccacctgcctcggcctcccaaagtgctgggattacaggcgtgagtcacctcgcctggcccttatgtgattatttaactgatttctgcccctttgctaaattataagatcttcaaaaaccagaactatgtatctttttgctgaatattttattcccagtacaaagcacatctgacatgaggttggtagtcaaaaaataattgttgcgtgaatggttgtaaaattaaatgagcacaattttcagtgaacctggaaagttttgcctatggtatcaccttcttctcaatatcttatcttcttcctaagggacacacttcatttattacagtccattgaaacccattttccatgaagagtaacctgaaatggaagaaaattccagagtcataattttaaattaagttagcttgatggccttccaatagaatggaagaagcaaagaaagatgttaaattctgcctccctttttttcctcttcctcaaacagctcagtcctgcctttgtttacttaaaatgtatccaaatatttatttctcagtaggtttatggggtatttttaaggtatttgagatgttgtccagcgtagtatatttttgtctcccacttggctttttggaacagcgttatctcttcgttttctaagttggaaataccctttaaagaaataatcaatgcgatgatttgaaagctaggggaaggataaaataaaagtaaacactaccagttatttttttaaattgcttctcaaatgcccttctctggaggagactgtaaaggcctattcaagctgaaataatggctaacagtggccagtgctgttccaacagcaacaccaggcactagcaagtaatctctctgtttggtgtgtataatgtatgaaaaaaagtgactgcttatacaattggactgattacttactttctctggtggcagaaagagcatttatcgtccctgtaacaagcttcacatgaatcagcctactttaaagggacttatctagggttaggaaaagtatattttttcaatttcctttcaaattcattcttattctagttggtatatgttttctttttggctagaaaactaaactaaccttctagagtttgttttttttttaaacctgtaatttcatcggtaataaaatcaaaagtatttaatgctacatactctttttaaaagaattccctttaattcattgttggtaaaacattggtcatctgtccagaagttagagaatgtttgtatgctgtctcagtttaatcacacacacttaccaatcacatgagactctaacattacccctgacaactgtatgtggctactctagttctcaataacccatttatttaagagctattgagaatggtatttgcaatgtgagggaatgatctgtttcaactaacagatggaatatttagagtactatattctgatatctcttggcatatctcatattccttcataaatcaatttttaaatcacattgaatgaagcttctggttagcgggttgctcatttgtcagtttttccagtgaaaaagattgaccaaaaatcactatttacacttcagaagcttccatacagattattgccaactctctcagggtcctgtggcaagaaaatcaatattggatgcacgagaaggtatgtgtgaccttccagaaagtaatagaagtgtgagaattgtactggaaaacaaaatggaaaaaatacgtatattacttatataagcacaatgaatcactctgacattcctcaaaagaatgagattttatagaaaacctgtgagaaacataatagcaattcttaaaaaccagattcctccaaaaattgctatgtacaattatttaaatataagttagagaaacagtaagataaagttgattttaaaaaaactctagaaggagatatatccctaaaaccttaatagccacatgttgtgctaatgataataacttgaactgctataaatctaaaaaaactaagtagctgcataggccttactttagaggagctagcattggtcatcaattgtctatttggggtcagatagcatggtagcctccaaggatacaaaaatactccatgctctcaaagagcttaccctttggagtttccatctactagcatctaaagactactgaaaactgccattgtcagggaactgcatcttcattcttttaacttttttatcatgttgcccaagcctttatttttttcctttgagagagagtcttgctctatcacccaggctgcagtgcaatgttatgatatcagcccactgcaacctccgcctcccaagttcaagagattctcctgccttagcctcccaagtagctaggactacaggtgcgtgccaccatacctggttaatttttgtatttttagtagagatagcattttgccatgttggctaggctggtcaagtgatccatctgccttggcctcctagagtgctggaattataggcgtcagccaccgtgcctagcctgcccaagacttttaatattataatagattagtcactcgatagaagttgaacacatgtgttcttattttgttttaactgattgggttttagtaaaatattcagtggtcccaggctatatgatgtttaatctaagtggagcattaaatgctcagtagaacgtaaatgatattcaagtgaataaacaaagattgattgagaaaaaatgtggcagttgactaaaaggagaggtagatattgagatggtatagttttttttccaaataaaatcttagagtgaatgggaaacaatttaaaaataaaaggggtgagaagagaaggaataggatggctgtcatgtttcccgttttgcatgtgtaggggagcatgtgggcacctgtgagtgtgctactgaaacaggaagaggaagagggtttctagaagacaaacaacaccatgtgccagagttgtttagagctgaaataaagtatgaaatgtttatctgagatgataagctggataaaacagaggtctgaaaatttgacagactttggatggtttagcctgtttctccacatttgttgaatttgtatgagtttcaggatagtatggatgaaacaagagtgtcaaccaggggatgatttggatttggttaccctcttctcccccaggaaacatttagcaatgtctggagacattttttattgtcatacctggggttgggtgttactcatgtctagtgggtagtggccagaggcactactaaacatcccacgatacacaggacaggcccttacaacaaagaattgactaatccaaaatggcaatactatagtgccaaacataagaaacactgttctagacctattcttccaaagtgtttccagactttgtaagaatccaaatcccatttgactactttttacttttcttctaatttaatatatttcatcattcacaaagaatcaaattattagtattgatttaattttggccttaataattattatcagatattacaacactgtatctttcttggtttccactgcatctgtgtgttttttagaaggattctctgagaaaatgttttgttctaatggaacagaataccagtcctgattaaaaccaggaaaaattaagacttggggctccaaagatatatttttatattagtcttttaccattataaccttccggctattttaatgcaaacttgtttctgtaaagccatattttggttgctataacaacttgatgtagctcttgatgagctcttcttgccttaatgctgctttttaaaaagttggggttgctatgactacaaaatgctgttttattttcagcaagctttttccccttgtaaatttgctttcaaaatatatatgtgtacatgcatgcatatttgtgtgcttctacttgcatgccttatagaagactagactatagtaaaaactgaagtctaaaatcaccagaagaaagataacagttgatttattttggtgatactattatttttaaactgattttcataatgttagatgaactcagatttgagctgtttttctccttcttcgaattatgtaactgtttaatgacagctccccttctttgtttcatgatttacttctcttgtcctttgtgttttaatctcttcctgtttccaagtatttatacctctgccttagatggtcatttgaactctaaaaatgtggaagcatgtgtgtcttaatatgctcattattataggtggactctactttctaacactactgattatggccttcttcatatcaaaggtaataacaaaattcccatggctaagaatctcattcaaattttgagaagccataaagctggaagttgggatacttttcttctattattaactctgtcacaattagcaatatgagcatctgctaaccacaaatctttctagaggagtgctatccaatagaaataaaatacagccacatagaaaatttaaaattttctagtagctaagttaaaaagtaaaaagaagcaggtaaaattaattttaataacgtgctatctcacccaatatatcccaaatattatcatttcaatctgtaataaatatttttaaattatgaatgacattttaaaactttttttctattaaatcttggaaattcagtaggtactttacacttacagcacacctcacttcagctgagccacatttcaactgcttatcagccacatgtgactagtggctaccatattagacatatcaagctttagatctcaatcaaatttagtcatacaacaaagtttcttatttattgttcacttactagtttgagggccctttgttaagtcttaggaatacttaaatgattaggaaaagtttttcttagttcatttttgagagagagagagaggaagagaagatgaagatgaagaaggaggaagaaggagagaaagggaggaggaagacagcagggggagggggaaaagaagaagggagggagggagagaggaaagaaggagggaaagcaactggaaagatgcagattttcagatattttttgctattttattataatctaatgttattttatttcattataattaatttgagaataaagtaggcattctgaactactttagtgttacttgttcacagttgtattcccaacttcttggggaagggaatgtttgggacagattagctactccccatatatttattgaatgaatgaatgaatctcctttgtgattgagtccaagactaagtaaatattattgtcaaggaatagtttgaaaaataaaaccgtacatgaatattttagaaaggcgaagggaggagtggctaacaatttgaagtgaagggaaataatgtaaaagattgttattctttctatgtgtgttgtttctcttgctgtgtgaagaattgcgtctgtaaacaaggaggagcacataaatgcctgacattgttttggttccacccggcagggtatgttgccagaacatcattgatgtgtccagatccctgatcacattgctgcttccatatccctttcctgccttttctcatttgaaaaaagccaaatcaaagtgagcatgtgacccttttagcctgctcagtaaaggaggtttctgttttctttttaaccatgtgtcattttttatcaccattattttagaaataaagtggcagattgaattttttttttttttttttttttttttttttttttttttttttttttttgtaagctgagccattttgcctgaaatgcagaggtttgggtgatctaatctgatctggaaatcagagaaataagggaagcatgttataacttgagtggattccaaaatcaggttatagatgataatctggtctgtgaattaaaatgtttgatgctgacagctcttcatattacaaaaaattttaaccagctcccatcatttgtcacagatttttttaacctctcttcagtaatgcaacaaaatgtctggcatttcatgtctcatgtctcttcggcccttgtaaattggaattacattcaacacatttcacttggagagtttaaaatataaggtgattttggaatccttgttagagttccacagtaagacatcattctacattagcccgaggggttcgctcaacacaaatattagaatatacttgagatttgaacaaccctaggtttctacgatcatgtcatttgtgtctaaactggtaaatggaactattgctacttcaaggagttttgtttatatcgaacactagacaacataggctaatgcttggtactaaaatatatgaatcagaaattatttgagttatttaccataaccttatgtttacttgtagacattgtgaactgttcaactgttcattctgttttatcctgtgtcactttgggttttttttctttttttctctttccttatttattgagatgggatctcactctgtcacccaggctggaatgtagtggatgatagcgactcactgcagccttgacctcctgcgtcagcctcgtgagtagctggaaccatgcctggctgatttttttaatttattttttgtaaagacagggtctacctatgttgcccaggctggtctcaaactcctgggctcaagtgatcctcccagctcggcctctcaaagtgctaggattggagacatgagccactgcgcctggctggctttgattaatatatatgtgtgtgtgtgtgtgtgtgtgtgtgtgtgtgtgtgtgtgtgtgtgtgtatatattcatatatatattaattttccaactggtgacatgggttaaaaatttattagattatatttataatcatatgtattctttttcctaggtataatgtttttaatgtgagtcttcttgtaccccctccccccaaaaaattttatgggctgcctttaacttttggatgaaataattcaagtttattttttctgagatggagtctcactctgttgcctaggctggagtacagtggcgcaatctgggctcactgcaacctctgcctctctggttcaagcaattctcctgcctcaacctcctgtgtagctaggattacaagtgcagaccaccatgcctggctaatttttgtatttttagtagagacggggtttcaccatgttggccaggctggtctcgacctcctgacctcaagtgctctgcccaccttggcctcccaaagtgctggtatttcaggcatgagccacagcatccagcctcaaatttttaatcattagactataaggcacactagaaacatgaaattttggagatggccgggactttcaaatcaactagtttagttattttcaatctttttgtctggtgagttctttactcaagctaagtgaaccccaaagttcaaacacgaagtcaaattgaagaaccaaggaagaaggaatgtaggtgaagaggatagggaaagcgctatccctttcctggagttcaattccaaagccataaatcactttacctctatccatttgctaataagataaaaagggttttgttcaaggtcagacagctctgcctgaaagcctggttggtgtcttttggattcatttgttcagcaattatgtgagtgcctattatgtatctcactggttcttaggatactggagatcttggggtacaaccatgaacaagtagagaaaggcttcatgcagcttatgatttagcacaggaagacaaataatacactagtaaatgcatattgcagttaatttcagactgtgaccaggtaaggtgatgacatagagtgactttaggagaaggggttgagatcagagaaggcctcttggaggaggtgacatgaagtttgtgcatacctctactcctctattgtcttcaagagagctatcttcaattactagcaaggctgtcacgctgggatggtgcagtggaaagaacactccatccggaatcccaaggtctaggtgtttaccccacttctgtgtccttataagactttatatattttattttattttatatctgtgaaatgagagtcatcatatctgtacaggattaatgaagatctggtccctgccttttttttttttttcagccttcttaaccaccctcttccttaccacaccagtctcttaaacattatttcccatgaatgctaaatttatttatattctcaaggtattccaagcctttaaaagagctgtggttctctcagcctggaatgattccctttcaagttcctagtttttaaactaggaactcattactcctatctgaaacttgctctgattctttcatacagagggaagaatgattgttgttttgcctcattttttgaaccatttaagatggcgtttataaaagttgttttttaaccttctaaaatgttgtttcatcccatgtattacaataaataactaataattatctatgtattctttcttcccccattagatcatgagctctttaaaggcccaaaccatatctgattcacaaccacatcatgggctctcgccacacagatcaaaatctaaaaaggaaagtggatgcaatgtaaatttttcttaatgctgtgtgaggagaaccttatccaaaacgatttcacagaaaagagcatttgttttgctgatacgggagagtttctttattccaatcacaaggcatgtgacaggggtgtggctcacttcttcggtgcccactgctcaaaaccctagggggagcatgcagacaggcaggtgcagaggccttggggagtgcttttgggatctggcccatggcagtgtccaggactcccaaagcccaagtgggcgtgtgttacagtgcgctctttcagctatgccatctgcagatgcctgtgttagtcagctcaatagaccctctgccttattgcaaggacagggggccattgtgacagcctgagttcttgcccaatgtactggaagaatcagaccacatatgggctggaaggttgagagcaaggtttgattgagtagtggaggtggctctcagtgagatggattgggagccagaagaggggatggaatgggaaggtggtcctcccctggagtcgggccgcccaaggctatactcccctcggcatctgcgttgttctgccatcactggtctggtggtgtctgttggtgtccgcaggtctgctcctctgctcctctcaacatccagctgcttgtgtctgtgtcctcttaagatctcaggtttatatgggcacaggatgggggggcatggtggaccagagtagtcttggaaaatgcaacatttgggcatgaaaacaggagttcctgttctcacttaggtccgtaggcacaggcccgagggtggggccctcattagggctccctgcccttctctacctagcacttccctgccccactctcgtatcactgttacacaccttacattgcaaaggtggttgctttctgccttatcctgggaaacagacatatgtgcttgctgagcccttcgctaaatttacaagagtatatacactgaataggaggcagagaaacaaacataatactttactcattctcagatttcctcccattccaaggaatgtaacatatactgctctgggtacaagagagtgtaaccattccatctaataccatcctgcaaagtgctttagaaagtagaatgacaatagagccggcctttggtaaacatttaaagtgtgttttatcatctttcaccaaatcccatcttttcatcgtttccttcattgacttatgataaataaaaaagcggggaaacaattttgggggagccaatagagtataggactaaaatacttggtcttaatgttagaggacctgagtgcaatgcaatgctcatttacttgccagttttttatcctggacaaataagttacttcatatctagtacccctgtttactcatctttaaaatgtgaataatacctgtttcataggttgttctaaagactacatggctaacgcatctgggactagctaacacgacacctggtaaatagtaagaactttaaaaaaatttatcatttttttaattacatgtaattattgatgacattgttggtttatttttatattataatttcctatggctaaacctagctcaatagtaaattttcaataaatggtaggttaatttattactggatttattcagtatttctcacatctgttcctttcttctcatttttaaagtattttcaaaactgtttccctctgtctctccagactaattgggtaactagcaactacataaagacaacctatggatttcaaggatctttcattactgtaaacctggtaatcaaactggtaactctttctgaggcctgaagaagttgctgttctgagagttctgttatgcagccatcactgtttttaggtgttttcctttgctatagaaataaatgagaagtatgtatgtggtttatttcacttcattttattctgaccaacacagtagtgaagcttccaattgaagacagagtaattatacatgtcatatccagtaaagaattaatggcatcttttcgttcctcaccaaaaggggtaaatcagaggctaggggagtcatctggataaaagagaatatttaaaatactcatttagaatttagaatgcaaatcaaagtatgcctgtttagtattttacttaaaaaaaatagtctagcaacaagctagagggagatgttttattttggtaaagcgcgtcttctatcatcatttcttaaatgagtgaatctaagtaggttctttctgcttgtgttcctagggaaacaattgttcctggaatgagatcctatattcagaagggagcaatctaaagagagtggttgtgactaaaacatagtagcttaactgcaaattggtaggaagtggtaggctacccaagctaatctgctgattgctaattttcttgggtgttgttgcactgccttgctgtaattgaataggcccagattaccctgggagggtggagtattacagccctctgaagagaaccctagtgtgtgtggtgttttcctttgtgtctgctgatgaaaagcccagtaatcctgaaagcgatctgaaaccaattttgccaccggcatcctatgtggtaaaaatggtctttaaatgtgcatatcgaattagtagactctcactgagaggctttaatggaaggagtttctgcttcactaatttggtgtggatacttaaacaacttttctttatttgcagctatgcatgggcagagaggtagttaattttttaccgtccttagtaagtccaatccagaacagggctggcaaaccttttctgtaaaagccagatagttaatatttgagactttgtgggctaagaggtaaaattgaatatatgatgtagctacatataaaacgagggaaaacgtctgcccttgtcctgtttgcctgggagctgtgggctctcagtagcagctaggtgagaggaaaaggaaagttgatgacatttctcaattgtcttgctctgcctgggagctccagcctccacagaccatcaccctgtctctcattcccatgtcccaactttctgttctccctctatatctcctatctggtaaataatactcacattacagtcagcagaacctgccttagtggcccgaagccagttggatccctccccgctgcccaggaggtagaaggaagaaaagagataagtgcctattattctccattgaaatgatgactacattttgccttgatggcggtactagcagtgtatgttggtctttgtattctggtcagttctttcaattagaggaggagtgtagagaattctaagtccagatatttgattaaaaaaaagaaactcttggaacaaaccaaatgtataattagtagctaccactagtgcttctttgtactgagggtatttagctgttaaaatatcattggttttgtttccatttccaaatgatgttttgtagtaattggctcaattaatacataaattcagacactttcaagtatttttgctgaaaacatattttccctttgaattttcaaaatccaccttcaacccctacttgctgtcgattaaatactggttctgactgcatcttaatgccaatttatggtagcttggctcaaatacagtcatgtgctgcgtaacaaagtttctgtcaacaacagactgcatatactataaccgtaataggtttgttgcctgatgcacatgggaagtcagtacaccaagacactaggatgaagctgaggaagaggtttgattgtaaggctgctgaatgaggagacggaaggaaaccacaaatccttctccctgagaagtgtggggctagagtttttatgggttttggagtgggccagagtgtagagattattgattgttcaaagagtgcaatttgaagtcatgggacagggagttgaagaaactgtattctcatgctgattcagttcttctgtgagagtctttaaactggttgatgtcagctgttctgctggaattcacgatctgcttaaatgatttttaaacaaaagctttatgattctaacatcagtggtcctatttaaaataaaagccttgtgattataacatcagaaatcctatctataggaacagtagggatgcagatggtcagtatctagtgttacatgactttctgttattaggaagtgaatcaaaatgcaacctaattaatgcttaattataacgacatttctgtccaaaaatttctgttaaccttgtgaggatggcttcagtatggtgatagtgccataacattataatagagttgaaaaattcttactgccgggtgacatcttgatgaccctgacactatgtaggtctagtataatgtgtgtatttatgtcttagtttttaacaacaacaacaaaaaagtaaacaaacaaatgaaataagaaaaagcttatggaataaggatataaaaatatttttgtagtgctgtatgatgagtttgtattttaagctaagtgttattactaaacagtcagaaagttttaaaaaattaaaaagtttataaagtaaaaaagttataataagctaaggttagtttattatttttttctttaatttatttattattattatactttaagttttagggtacatgtgcacaatgtgcaggttagttacatatgtatacatgtttattatttaagaaatattttttaaaaaaaatttagtgtagtctaagtggacagtgtttaaaaaatctactatattcatgtcctaggccttcacactcacccaccagtcattcactgacttaccagagcaacttttattagaaccctgcaaactccattcattgtaagtgctctatatgggtgtgtcattttttaaatattgttaaaaatttacacttttggtgagaatgtaaattagttcaaccattgtggaagatggtgtggcaattcctcaaagatctagaaccagaaataccatttgacccagcagtcccattactgggtatatacccaaaggaatataaatcattctattacaaagatacatgcacacatatgttcattgcagcactattcacaatagcaaagacatgtaatcaacccaaatacctatcaacaacagactggataaagaaaatgcaatacatatataccatggattactatgcagccataaaaaggaatgaggtcatgttctttgcagggacatggttgaagatggaagccatatcctcagcaaactaacacaggaacagaaaaccaagcaccacgtgttctcactttttagtgggagcctaacaatgagaacacatggacatagggaggggaacaacacacactggggcctgtcagggattatggtaggggaagggagagcattaggaaatataggtaatgcatgctgggcttaatacctaggcgatgggttgataggtgcagcaaaccaccatggcacacatttacctatgtaacctgcacatcctgcacatgtaccccaaacttataaattaaaaaaaaatttttttgatccattgtatttgtacatatttatgggtacatgtgaaattttgccacgtgaatagaatgtataatgattaagtcaggacatttagggtatctatcacatgagcatcatttgtatgttttgggtatattgcaagctctctcttctagtttttttaaaatgtacaatacactgtcattaactatagtaaccttactaatctatcaaagaagagcttattccttctattgaactgtgtatttgtacccattaactaacctctcttcatccccactgccactcatacaccctttccagtctctggtatccatcattccactcactacctccatgtgagcaatgtttttagttccaacatatatgtgagaacatgcaatatttctctttctgtgcctggcttatttcccttaacataatgacctctctccagttccacccatgtagttgcaaataacataattttaatttttgtggctgaatagtatttcattgtctatatatatctcacattttctttattcattcatttgttgatagacacttagattgatttcatatctttgctattgttaatagtgctgcaatactattcacaatagcaaagacatggaaccaacccaaatgtccatcaatgatagactggataaagaaaatgtggtacataaacactgtggaacgctatgcataaaaggacactatgccataaaaatgaatgaatcatatcttttgcagggacagggataaagctggaagccatcatcttcagcaaactaacagaggaacagaaagctaaacactgcatgttctcactcataagtgggagttgaaccatgagaacacatgaacacggggaggggaacaacacacactggggcctatcagggcttggggggaaaggggagggagagcatcaggacaaatagctaatgcaagcagggcttaaaacctaggtgatggactgataggtgcagcaaaccaccatggcacatatatacctatgtaacaaacctgcacattctgcacatgcatcctggaacttacagttaaaaaaaaaaaaagtagtgctgcaataaacatagacgtttatgtgtgcctttgatatattgatttatttccttttggataaatacacagtagtgggattgctggatagtgtgacagtattgtttttagtattttgagaaatcttcaaactgtttttcataatagttgtactaatttacattcccaccaacagtgtataacaatttgtcactccacatcctcaccaacgtctattattttttgtctctctagtaatagccattctcactagggtgagatgatatctcattgtggttttgatttgcatttccctgatgattaatgatgttgagcattttttcatatgtctgttggccatttgtatgtcttcttttgagaaatatctattcatgtcctttgccaatttttaataagattatttgcccttttttaaaaaaaaaacgttaaattgtttctttgtgtattctggatattagccccctgtcaaatgagtaatttgcatatattttctccgtttcaagaggttgcccctttactctgttgattggttatttttgctgtgcagaagcctttaatttaatatagtcccatttgtctattttttttttttttgcagcctgtgcttttgaggtcttattcataaaatctttgcttgcctagaccaatgtcctaaagagtttgccttatattttcctctagtacttttataatttcaagtcttatgtttaagtctttaaatcatcttgagttgatttttgtacacagtgagagatagaaatgcagtttcattcttctgcatatggttaaccagttttcctagcaccatttattaaaaagggtgtcctttccccaatgtgtgttcttaatggctttgtcaaagatcagttggctataaatatatcgatttatttcttggttttctactcttttctattggccaatttgtctgtttttgtgtcagtgccatgctgttttgattactgtgggcttgtaatacattttgaagtcaggtaatgtaatgatttcagctttgcactttttacttgggattgctttggcaattctggctctttttttcatttcataaacatttgaaagattattttgtttatttctgacaaaaatgacattagtattttcatagggatttcattgaatctgcagattgctttgggcagtatagtcattttaacaatattctcctactctattagcatgaaatgcctttccatttgttgtgtcctcttcagtttttttcttcagtgttttgtaatttttcttatagagatctttcaccttggttaaatgtattcctaggtttttttgtgtgtgtcactattgtaaatgggattgccctcttgatttctttttcagtgatttcattattgttgtatagaaatgctactgacttttgtatgttgattttgtatctagcaattttactgaatttatgacttctaaaaaattttttgtggaatcttttggtttttctatatataaagtgtgtcatttgtaaagagggacaatttgactttctcctttccaatgtgaatgccttttatttctttatcttgcctgatgcactggctacaacatccggtactttcttgagtaagagtggtgaaaatgtgcatccttgtcttgtttcagtttaaaaggagagtctttcagattttccccatgatgatgtttgctgttggtttatcatatagggcctttattatttttatgtatgttgtttttatgcctcatttggtgatagtttttatcatgaaggaatgttgaattttatcaaatgatttttctgtatctattgagatgatcatatgctttttgtccttcattctgttgatataatatgtcacatttattgatttgtatatgttgagccatccttgcgtacctggtataatcccacttgatcatgacgtattatctttttgatgtgatgttggatttggtttgctagtgttttgttgaaggattttgtgtgtatgttcattacggtattggcctgtagttttattttaaggaggattgatattagtacttctttatacatttgatagaattacactgtgaatccatccagtcctgggctcttctttgtttgaaaactttttattactgattcaatctcattactcactattggtctgttcaaattttctgtttcttcctgattcaatcttggtaggttgtatgtttttaggaatttatcagtttcctctagattttccagtttgttagtgtatagttatttataatagtttctggtggtcttttgtatttctatggtaccagttgcaatgtctgctttttcatttctgattttgtttatatgggtcttctctcttcttggttgatctagctagtggtttatcaattttgtttatctttttgaagatccaacttttcattttattgattctttgtaatttttttagtccctatttcacttagttctgttctgatctttattatttctttccttctgctaattttgggtttggtttgttcttgcttttctagtttatttgaaatttttctactttcttgattcagcatttatttctgtaatgttccctcttagcagtggttttgctgtgtctcacaagttttggtatgttgtttccatttttatttgttttaatttttttattttcatataaattttttcattaacccaatggtcactcaagaacatgttgtttaattttaatatatttgtgtactttccaaagtgcattttggtgttaacttctagttttattcccttgtggtctgagaagatacttgatatgatttcaatatttttaaaatttgtttagacttcttttctttttttggcctaacatatggtctatcctggagaatattccatgtgttcatgagaagaatgtgtattctgcagttgttggataaaatgttctgtagttgtctgttaggtccctttcgtctaaagtccagtttaagtctaatattttgttgttgctttttttgtctaaatgatttgtctaatgctgagagtgggctgtagaaatacccaactattactgtattagagtctctttctttagatctagtaatatttgctttatatatctaggtgctcttgtgtttggtgcatacatattttgaattgttatatcctcttggaagactgatctctttatcattataaaatgacaatcttcatctattttttactgttttgccttaaagtctgttttacctgatataagcagagctactcctgctagtttttggtttccatttgtgttgaaagtctttttccatccctttactttcaatttatatgtgtctttacaggtgaggtgagtttcttgaaggcagcatatagttgtatctttaaaaaaaaaaattagcacagggtcagtattcaaggatcatttttttaaatgtattccgccagtctatactttttaagtggagaatttaatctatttatattcaaggttattattgatgtatgagattttgtttctatcatattgttaattgtttgttgcttgtttaatgtgttccttgtttctttctttttcttttattgtttgtcattgtggtttggtggtttactgtagtggtggtatttgagttctttctctttctcatctgtgtgtttgctttaccagtgcatttcatacttttgtgttttcatgatggtaaatgtcattcttttagatttaggattctcttgagcatttctgccaaagctgacctagtggtcatgcattttctcaagttttgcttgtctgggaaatgctttatttctctctcatttatgaaggatactttttctgattatagtattcttggctagcagtatttttttctctttcatctttgaatatatccatctttgaatatattcaactttgaatatatccatctttgaatatattcaactttgaatatatccatctttgaatatattcaactttgaatatatccatctttgaatatattcaactttgaatatatccatctttgaatatattcaactttgaatatatccatctttgaatatattcaactttgaatatatccatctttgaatatattcaactttgaatatatcccattatctcctggcctataaggtttctgctaataaatctgctgttaggctgatgggttttttaaggcattgatgctttactcttgcatctagtcttttttagaataattcctttgtctttgagtttagacagtttgactataatataccatgaagaagacctttctgcattatatctgtttggagatctctgaacctcctctatctgatgtctaaatctcttgctagatttgggaagtatttttctattatttgagtaattcagttttctatccctttcattttctcttttctctccaggatactgataactcaaatattttgtcactttatggtgtccatgaatgctttgctcattcttttttactttatttttttcttgttatttcaaaagatgcgtctttacatcttgagattatttcttctgcttgatctagtctatttttgaaactttcaatctattttgttcaatgaaatcttcacttctagaaactctgcttggttcttttttttttaatgatgcttgtctctttgacaaagttcttattcatatcctaaattgtttttctctgatctctttgtgttgtttttcagtattcccctgtatctcaccaagcttctttaaaataaatatttcaaattgtttttctgagatttcacaaatttgttttcgattgagatctgttctggagaactattgtattcatttagtggtgtcatatttccttgctttttcattttccctgtgttctgaccttgatatctgcacatctgatgtaatagtcacttcctcccatttttaaaatttgcttttgtagggcaggactttttcctgaaagttttgtttgagtagggcactttggctttgattctgggtgcatgcagtaaagttgtctctgtatgaactatctggctataaacagcatcattgttatttattatttcctcagtgacttacgatatggttattattggaggctgtggtaaggttttgcgggggacttgaatgccagatggactggcctgcaggccccactggtggcagtgattggctgagtatacacatccttgagcaccagggtggtgtatacctgcactggagctagcagatccacatggttcacttcttggcccttcaggtgatttattcagatgcccacagtagcagcagtgggatgggaagctggtcagggtctcgagtccctgggcagttggtgtgtgggtgatggcagtgtcaggggcaggatagtcctgtggagcaggagtgaacagtgcatgcttgtgttgacagtggctgtggtgggcttaggaaagccagtctacagtcccccaggtggcacatgcagataggtggtggtagcagcagggtgggtaggctcaatctcaagccccaaagataagtgctcaggtgccaacagtgatggaatgggctgggaaatccactggttcctggactgcatattctggcataaggaaaggggtggttagactgggtgaacttttcctcaggcctctgggtggtgtgtgcagttaccagctatgctaggcaggggtgaggtaatccgtaaacccttggtaggatacacaggtgagaaatggtagtggttgtgctgtagccctgccactgggtagggtggggctgtcttcactggaagtattgtaagttggtgggtgggaacatgcacaccacttgctcctcaggaccaaaaaggtggtgacctattccttgcttgcatttcagtcacagtggcagtagcccatactttgcttgtgcctcatctctgacaccactgggacccaggacagtaggccatctgttggtggcagggctctaaaatggtgccttggtgtagcagcttagttctcagggagtctgtgggacccagcatgagcttccctctggagcaatgccattgcacagtctctcagcagctctgtatgttagttttgagacccatgaggctcaaggggctctctcatggctaggattgcagaagttcacaatgggaatatagaccactgggggtctttcatttacccttcccttgcattgaggagtatcttccagttcactcatggtctccgactcacaggcttgctttaggtatgccttcttcttccttctattaggtgtatcctgtcacttttctgttgaattctagtgttctcttttggatgatctatttgaagtgtgattatctactcgctattttggtttttaggggaggaggtaagcactggtggtagcagcagggtgggtaggctcaatctcaagcccccaaggtgctggtaccagcacctatctgcatgtgtcatctggaggactggagactggctttcctagcccaccacagccatcgccaacaccagcatgcactgttgtaccttttctatgtttgaatatgtttatatacacaaatacattgttttacaattgcctacagtattcagtacagtaacgtgctctataggtttgtagcctaagagcaataagctataccatatagcctcaaagcaataggctataccatctgtgtgccactacattctatatttgcacaatgatgaaatcgcctaatgacacatttctcagaatgttttcctgtcactaaattacacatgactatattttgaaacctatgaaacaatgaaagtccctgtttctctgtatcctgcttgtttttctcaagcaaagtattggtcatgcttacatggtggcaaagcatccagctaaaatgtaagaggttaaacctttatccagacaatttaagcatgaaataacagatgcagaacatctggaaaaaggataatcattctggatgtttctgatacgctaaggttttctacagttgaatcaatagccttttcatcctcattgcaattgtatctgtcccaagagaaggtctttttcattgtgttttgttttttggttcagagcgtctggctacagctgttttatcaaagtagcatggtgaccactgctcaaaaatgagagttctatcttggcttcagagattaaggaaacttggaggctgtagaaagcttgttttatttgaggtttataccacagttggcctagacttccctgggaaaactggtctttattttctgtgttccatagcaaacctgggaatagccatggtccagaaaattatatatgtaggtcatataaagtaaccctacccaatcaagtgcttcagaacaaaatgtaatagcttaaagaaagaaagaggtagaacacagggagggagaggcatccccagagcccagagccaagccttcaagaaaaatggtcatcattgtcattgtcatcatcatcattgtcatcattgcagaaaaatgtttcacttaatatatactagcccctattctaagtattttgcatatatgaactcactttagtactaacaactatgctgtgaataggtactattatagtccctacttcacagattaagaaactgaagcataagaaagtctggacttaacaagtaatatagagttttggatttatgggtaatagagagccattgaatgttttaagtaaggaagtagcattgtctgctttacatttcaaatcacttaggcatttattttttattatttattatgtatttatttatttatttttgagacagagtcttgctctgtcacccaggctggagtgtagtggcacaatcttgacttactgcaacttccgcctcctgggttcaagcaatcctcccacctcagcctcaagagtagctagtattacaggtgtaagccaccacacccagctaatttttttttttttttttttttagtagggacagggtttcatcatgttggccaggctggtctccatcccctgacctcaagcaatccacctgcctcggcctcccaaagtgctgggattacaggcgtaagccaccatggctggcctaggcattttaaatcatgtgggagaatagaggaagaaaaaccaggctagaggtgataagaactccagaggaagtggtgagggggaaagagcagagaaagggattggtttgctaaataatttgcttaaatgtacaatattgggtaattgaaggtttcaaggaaaaggggtagctgaagaaatcaatgtcccaagtaaagtaaatgtatagagaaaagaaagcaggtacattttaatgctcaatcttatggatttctgactaatgccttgatattagcaggcccattttgctctatgaaggaggttttcatttgactgggtctttccccattattttgattaaagacagggtggggaagattctctgaaagacatttttgttttgaaggttctctgccaaataagaaagaggaaataagacactaaactaagaccaatcaaatcaatcaagtcaaaccctctcagtttgatagctgtggagggacctgcctgaatttgccttttacagagaaagtttcccagggctcttatgttaattagggaatttgagtttgctacagatgattgcattatcatcccagacaggacagctaaacccttctgtgcaagagaaagaaagccatttacatatctctccaatcacgttttaaaagattttagagattataggtaatttcccatttattgtcaggtctatcctaaagcacattcataggtaaatgcaagtgggtcatttctagtcccttatttttgatgtttccaaggaaagggaagagaagaaacaaattttcatctagtaagacattgctagagaagcatcaattgagtttgcttcctgtgtatgagtcctaactgtagttttttctttaactttggagttttcttttaggctggactccagattgaaacatgccatgataatttgaattcatttcatggctcctgtaagttggcagacaaccagagtagttatctgaatggttgttgtgtttggtagatgctgttttcccccttacacctcaacaaacactaatatatttaattttattcaagcagatcatacatttgaggataacttggactatagggaaatttgcattccaaattttagcataataaatcttctatgaatttctataaaacccttatgaagattgtagaaagtcttgaaaaataaccgaaggatttcccctagattaacttgtagttagtaatacctagaatggctttgaagatgaaagtaaaaataaaataaattatttataagttctgtggtcatttggctctctattcaccctagacactaaagataccaagtcacaaatcacttccttatgcttgacttagaggcatgaagaataattcttcctgcctcatttttggtacagtcctaggtaatggaaaaatacagtgatgatgatataaccatcatctctcctactttgagccatttcagacttaaagccctgtgtttttcaggccattgttaaacattatacatcgttgtgtaatttctagggccagtgttatactcaatcatttatttgtgacttcagtgttaatattcctattgtttctacttattaattacttccaatgtgccaagcactcctctagagctaagttatgtacaagtcaggtaatcctcacgatgactttatgagttaggtactatcattatcctgattttacctaagagaaaagtgaagcacaaataaattatgtaacttcttagggccacattgcaagcaatggattagagtttggaccagtatctttttgactgtcataagtttagggaaatgacccagatgtcctaatctgacattatagatcaaggattggaatccactgcaatttcaaagacttatgcattcaactattatgttaaactgattccgtatatgtatgtgtgtgtgtgtgtgtatatgtgtgtatatatatatatatatatatatgactcctatatatgtgtgtgtcataaactgactcctatatgtatgagtcataaactgacatatatgtgtgtgtgtgtatatatatgctgaaattctaccatgcgtgatccacggcattagtttgaagccttttgatgcttcattagctgttccttaaagggcattcagctattatcagactggttacacctgaaggggaatcactttttctttgttggctaggtgagatcagatgaaagagttttgaaattatatgtcaacagttctcaaatttcttagtttccagacccctttatactttaagtttttaaagatctcaaaacttttgctttgtgagcatcacctcatataacattttttaaatgtctctttttatttaatgcaattgcattaaataaaatgtaactgcattgtctcaagatggcatttgaaaatttgagagatgtctaaatgcaccagccaaaagtatacaatactgtccaccttagtccctagagccatcttgttttggctgctcagtgtccatgcaagtatcatgccaagtttattattccttcagagatgcagacctctcttttagatgaggaaaaaccaaaacctctatctctcttttaaattaacaaacgcagatattgttacctgtattctattctagaattctgtcaattttatttctgctctagaatattctcaatttaacctgatgttttaaaggtcctctctatctgtgtaattcaacttgattcctaagttacaccagtgaataattctcacctttggtgtatttacacttcttaaaatttaatcgacttgtttctccttttgcagtattttaactgaaattccttattaaccacagattcctaggttaaacttggactcttgattcggttccttacttaggaaccaaaatcaaagatgattgaaatgtttgaaatacaacttgccatcagccctgaatatttcttcagatttctcctcaccctgtattggttggatttgcttattttccaactatttgatgtatgccaaatctgatgacatgtggctctgcttcaaagtgtaaatcaatactttcaggtaatatgcacccttataaaaatatagaaaatccactcataagcatatataccatgcctctcttagtcatatactgtgtcatatcagtttgaaaaggagaatgagctctgatcccaagactcaggtcacctggaaaagctggaattagtgacaaggatgaaactggaggcctggctccaatgtcttcagggaatatagatgcttcaccttcaggcttctttaccttccccaagaaagtattctgcctacaattttggggtagtagtgaatcatgatcaaatatcgaggaggaatctttgtatccacagtgctttccagacttctctcaatttgaaagaccacagaaactctttggcagctatttgcgcatgaccagtcacccaaactttctgctttctatgacagttccagggactctatactggaattacttgcctggtatagatacggtcattaattgaaaacggtcatgggaatgagatactttgtttatatgtgagataaatcagtaagataaataagatactggtaagtgccagagctcaagttaaggccttttcattaaaattatacagcattttcctccccagacacttataaacagaaaagctgaccattattgtcaaagggtggaggcaagaacagtgctttttggccatcagactttgtcagaaagccaatcatattttttaaggaaattatttactttgggcttcactttctcaaattccaagatttcaatgtaattttttgtcctgtttcattcatagtgctaagatactatttgttcattacgagaaaatgaaatgttttcttcaaagtaaaactaatgcatgagacagagtcacatgattagctctgtaaatgacaattactcaaatttctctcagttaaaaataccaaaacaatacatcacaatcaatggaaacatttttattgcctgttttacatgtgaacatttacaaatatcttcatacttgtagcaatccaacagatcacattgatatctattttaggtttctcataaagctatgtggggacagagaaatgtgtgctttaaagatagtatagctgaagcaatttcagttttctatttttcattttttgagacagggttttgctctgttgcccaggctggagtgcagtggtgtgatcatggttcactgcagcctcaacctcctgggcttaggcaatcctcctgcttcagcctcccaagtagctgggaccacaggcatgtgccgccatgactggctaatttttttaactatttgtagagacgggatctccctatgttgctcagtctggtctcaaactcctgggctcaagcagtctgcctgcttcagcctgccaaagtgctgggattacagatagacatgagctattgtgcacaaccacaatttcagttttgaagccaacttttagtaattgggtacttaaaatggcaacttagcttggtacaggttatgttacttttcattttttataatggaattatagttcttaagaaggaagaaactatggaattgcttatggaatagtgatatacacagagcatcctgttggtagagaaaagtcgatggagtagacaagtggaaacatttcactgggagttggtcttgtctaagttgattctcaggaacgcatctcctaagcctcttctactcccctcccgcgtgtttccgtctgtggacttgacccttatcctcacgccctgaagctggtgatcactctgacgttgggttctaatgttttgttttgcttcccaggaaaagcagcacaggcattaccgtgtaatttctattgttcttatgcttgctatttttctctctaaaaaatagaccccagacaccactccacaacccctggggccaagagatgattagcgatccagaaattgttaagagttgcatcacatgtccattaaccactcatatttttttcccaatccagcatgaaatgacagaaaagtgactctcttactttttaagccaggcctttgattcatatgttagagaatctaatttttaaaaacttgtcatacatttggggctgtattctgtcatgagagaatgacaaccataaagttaaagtgtgtccaaaggctagcagtaatgattgacaaatacatgcttgctagacccattcattacatgaagtgattcagatgtaagtgttcttttaggatttatggtgtgagaatggaccctgttttcttgaggagtaaggaagctgctcaattaagctttcttttctgtagatgcttctgtttatttgggggcttttaaaaattgttgttgtcggtctctataataaacagaaatctgcctccttgtaatgaataccattgttttacttcttatcactgaagctcagtgttcaattcttctttcatatcactgcttcagatctttctgtctggcataatcttttaagtcttttctttctcagcagaatattctcagggtctccaattattgccccttctggaagagcttcaacacatcagtgtttctcttcaaatgggatttgggacacagttgtggccacagagatgtttttcacagcattactcacagaggtgaataattaaaaaatgttgaacaaaataaatgattaaataatgatacattctcacaacagactgttatgaaatctttaaactagtctgattatgggaaaatattcaaactacatgatattagagacaaacaccacacaatctcactcatatgttgaatctttaaaaagctgatttcatagaaatagagagaatactggttatcagaggctggggagggaagggtgtccagggaagattggttaatgcatacaaagttacagataagaagataagaagaacaagttttggtgttctaatatgtagcagggtgactataacaaataacaatgtattgtatatttcaccatagctagaagatttgaatgttgtcatcactcaaaattaataaatgtttaaagtgatgggtatggtaattaccctgctttgatcattatactatgtgtacacgcattgagacatcacactgaaccccatatgtgtgtacaattataaataaaaaataggccaggcatggtggcttatgcctgtaatcccagcactttgggaggctgagcgggtggatcacctgagatccggagttcaagaccagactggctaacatggtgaaaccccatctctattaaaaatacaaaaattaactgggtgtggtgatgggcacctgtaatcccagcaatttgggaggctgaggcaggtgaatcacttgaacccgtgagacagaggttgcagtgagctgagactgtgcctttgcactccagcctgggtgacagagtgagattctgtctcaataaaaaagaaagaaagaaagaaagacccatagacacagaaataaattcgtggcttaccaggtgctggaatggggattaactgaaaaggacaggagagagatgtgagttgatggagatgttccaaaactggattttgtaatggtagcatggctgtaaatttactaaaaattatcatttaatagtgcatttaaaatgggtggagtttatgatatttaaattatgcttcaataaaactgttaagatttaaaaaaaaaaaaagaatatatgaattaacttttctttgtatttctccagttactattatcaaacaaacctccaggagattcaaaacagaacagagagtcacagtcaatgaaaagacaaattatgttctgggttatagcttttctcccagaccaacaatagtttaagttacacttctccccatgtatattcttatggaacttgtcattcactctaccttgcaatccattttctttgaaaattgcttgagaaccgcttaacactaatactgaaaatgtaatagtaattttattttacttgctgcacgacaatattgctgaagtcaattactatttcttgccttaatatttacaggcatcttatgtgatcgaagttgtcacaaagggaagaaacttaacattttattggtgtatacagtagaaatgtttactacgattgtgggaatgactgggtaaccacttttcatgcatgtcacaaagcagcagaaatccccgtgaaaactggatgactgatattcactcatttttcaatgagcttttacaattaagaatcacttgacattgagcatgaaatgtgaaatgtacaattttgttttagaaaaacatagttgacattttagtgattaggagctctatatcatagggcatatttttaggtattgtgtttaagaatgtgtgactattgtctttaaaatcctacctgcatgttgttagggaaacacatttctatttcatttttttaaaataatcgttgaaagttattttttgaaatcctagggggaatttttctccttaaacttctgtttcttttttaacttttgtccaaacaacccacaaaaatcttcaaatcataatgaatagcattgattttcagactttcatatttcttctgctttttatcttttacatagcaacaatccatcatcttttgggccaattttagcattcttttgtttttctgcaatttcttcattctgtaatatttgctaccaactcagctaaacctggtattggcatcatcttggggactgattggtcagtgttgagatcactcttggaaaattgtattgcaaggagggtctccatcagttttccctttttaatcagtacctatgcgggagtttgaacttgtattttaatcccataaggctagatgttaaatttttagtgttcagggctctttttttgttcattattcattagttcattcattcactcaaccagccaatgtttatgaaaacctaccatagtgccaggtactgaaagtatggaaatgagagacataatctctaccacaagagattctctaacaaaccaactgacagtaaaaatataagttctattatggagaaaaggaagcaaggtagggcacttaacacattggaaaaaggagtcacggtgactttctacatagtctttcaattaagccttgaagaaataaatcagttggaggagagagagaaggaaacagaaagaaatgcttatgccaagttgtagatacacaaaataacatggtgggttttagaaactcaaggtagttcagcttactaggaatgggatacatggaaaaaaaatgatattggtgaaagcttgggcaggttgtgtaaactgtttcttccttatcaataaagtggagacagtggatacaggttgcttaacagagtacagacatataatacatgcttcaggtttctttagtggtgaaagtaagagtttcatataaggactaaggaaaacctcccaattaattttcaatcttttcatgaaattctaaagcctgacaatttggactcagatagatgtatgcttcttgttaatgttttgaagtgtttactaattatgaggggtctttgttcatttttttgtttgtttgttttctggaatcattaggatatagcaattacagttggaaggcagaacaccattagtggttgataggtcaggcttttgaagtcagacttgcaaatttcttgtttctaatctgcaaaatggggataataatagtatatctaactcactgtttttctgagacttgaaagtgcttggcagagtaccaagcacctagaaagccttctgaaatggtagaatggtagctgaaagtcacaatcttcctctcctttcctttcctttcctttctccttccttccttccttcccttcccttcccttccttcccttccttcccttccttcccttccttcccttcctttcttccttccttcctttctttctttctttctttctttctttctctttctttctttctttctttctctctctctctctctctctttctttctttctttctttctttctttccttccttctttcctttcctttctttctttccttctttctttctttctttccttccttccctttctttctttccttctttatttctctttctttctttctttctttctttctttctttctttctttatttatttcttttctttcttttctttctttctttctcattctgttatccagactgaagtgcagtggcacaaacttgcctcactgcagcctcgacctcccaggctgaatctatcctctgctttctgagtagctgggaccacaggtgtgtgccaccacagccagctaatttttgtattttttgtagaaatgaggtctcactatgttgcccaggccaatctcaaattcctggggtcaagaattccacccgcctcgccctcccaaactgctgagattacaggcgtgagccactacccccagcctggtcttgttttcagtggtaaattagtacacgtgttttccctcaacattggggtgataaaatagctctggtatatatttttaccatttaagtttttattcaccacctttaaagttttcctatttcttttctccatttagttaataaattaagtagactattctggtaagtgcctctgaaatcaaaaagctttcaagtttttcaaaactgcaagttggccgggcgcggtggctcacgcctgtaatcccagcactttgggaggccgaggcgggtggatcatgaggtcaggagatcgagaccatcctggctaacagggtgaaaccccgtctctactaaaaatacaaaaaattagccgggcgcggtggcgggcgcctgtggtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaacaaaaacaaaaaccaaaaaaactgcaagttatgttagtgagccacagaatcaatttagtggttaacaactagcactttgtttttataaaatagaaaggatcatagttgaaaatatggggtgtggaggaataggtaagagtactgtttcacattaaattttgtttcaggtatatgtatatgaaatcattatgtataatctatttccttctgtggttcttggtcaaagattttgaaagtaattgctctaaagcagtgttccccaacctttttggcaccagaaaccagtttcatggaagacagtttttccatggactgaggtgggggatgctttgaggatgattcaagggcattacatttattgtacacttcatttatattattacattgtaataataatacaatagttatacaactcaccataatgtagaatcactgggagctctgagcttgttttcctgcaactagatggtcccatctgggggtgatgggagacagcgacacccaaagtgtgttgcttatgtccagtctacaccataatctcattttgattgctgtcgctgcagaaaaccctgcttcacaaacataagatgttggaaatggaagcaggcttttcagtgcttttgtggcaaactcaggatattccatcttgattttaattcagaacatacggaggtttgaagttgtctcaaacatacttttaaggtcatcaccatttgtgatttcaagcaattgaccctcttctagcatggacaaagtcgattcacctggcttattaacaagtgggtcgcggatccattcctttccagttcgcgggtattttatggttggggagtaatactcaaactctttgaaagctgagatagatgatcatgcaccagctgggagaaagaaggccctggctccatctctttcaaaccctctgctaatgtttgaaacatgtcagaaattccaatgttcactcatcgcccccataattccagtttggctttgattgcggttactgtatctgccgacttgaacacagttgtcattctcccctgaagtgacagattgagttagttgagcaggttgaaaacgtcacacaagttaagcaagttttgcaacgcattctgtgtcattgaaatgtgctgccagtgatgactgtttttctaaaagaaatctctggagcagctgtcgtgactcaaaaactctggccactgatccaactctagaaagccatctcacttcggtgtatgagaaggcatgtgtgctgtgtgtccatctcctctcagagctgcacaaacagacatgagttaagggcatgtactttaatgcggttaattttaatcacatcctgcaaaacattatgtctaggtgacgtttctcagctaaccagcattttatcatggatgacacagtgcatagactcagactgagaagcaacctctttgacctgggtagcaaaaccagaaagccaaccagtcatggcagctgctctgttcataaatatactgacacaaaatgaccagttcagatttcccgatagacttgaatagttctgcagctgtgctgttggttggcaacaaaagtgcacataacataccctcatgcacatcctcccgaaaaatgtatctcacaaaaacaagcattattgccttattgtcaatattggtaggctcatcaacctggattgcataccatggtgactcattaatcttctctaccagttgtgcctcagtatcctctgctattcatcaaatcgtctagttatgttgctagccgaaagaggaacgtgtgctatctttcgaactgcagcctctcctaaaagttcatgacaaatgtccttagcagcaggcaggatcatctgtttaccaacagtaaagggcttcggagcttcagcgctgtggttagccactgaatgatgctgtcagtgcagacacatttgatgaagtggtggccttcaatgatttcttctgttctttgtgttcacgtgtttttctattgaaaaactccaaaggcttgtcttttaattcagcatgcttggtctccatgtggcaaagcagttttgaaggcttcatggcttcttcgttggatagccggtcaccacatattatacaaaaagggcttggagaatgtaaatcacctgttgtgctgaacccataatttaagtagtattcttggtattttattttaaatgcaactttccttttgttggcattcttagagtcttctgctgtctcatcattgggtctttccccctcttcaaagaaactctccagttacatttgttttcactcatttgtgctagggttagcttgtgggcttaccaaaactctgactgagacaaatgtgcagtgcagggaaagaggcatggatggagtggtaaataaactaataaactaaataaactaataggtgggccatgcatggactaaaattagtgtcggattctgacttaaatcctgccaccagatgcagctgtacaattgaagtacatcaacccacttgccactataaagcctgccaccagatgcagcttaattgtcacttaccattcactgatagggttttgatatgagtctacaagcagttgatttgttatggtctctatgcagtcaaagctctctgctaaggttaatctgtatttgaagccactcccctcagtgttggcatcactgctgcagttccacctctgatcatcaggcattagattctcataaggagcatgcaacctagatcccttgagtgtgcagttcacaatagcgttcgcgctcctgtgagaactaatgctgctgctgatctgacaggaggtggagctcgggtggtaatgccagtgatggagagtggcataaatgcagatgaagctttgcttgcttgcctgttactcacctcatgctgtgtgtgaggaacatgtttgtaaccagtacctctccatggcccaggaatagaggacccctgctgtaaaggatagaaaagcaggttacaagtttctcccttatttgcattattatcccagattgcagtaacatctaaatgaagcttgtccaacctgcggctggtgaaccacatgcagcccaggacagctgtgaatgtggcccaacacaaatttgtaaactttcttgaaacattatgagatttttttttttgcaatttttcttttaagcttatcagcaatcgttagtattaatgtactatatgtgtggcccaagacagttcttcttcttctaatatggcccagggaagccaaagattggatacccctgatcctagcagattagaaaacagtaaagaaagagtttgttataaacagtgacccccatgtgattttaaagaatatactgtacaggttgttttggggatgcaacgggaaaaatgctgtcattcaactgtctgctggaaactcagaaactcttggtatttggaattatgtaaataggactttgaaaaataggctgaattttttccaatgattttatgagcttgtgcacgtgcacacccatcgcagtcaagtacagatagctttaggagtgggaagctcaggaagcaaactttgcttttcccctctgttcttacattagcatccattctaattgttgcttatttggggcagctaggttaatcgtatctatctgttgtcccctactgagctgatattttctttcactgtaaggtgtttcctaattactttgtgaataaaattttttagattgagtataaaattgagcccaaagttatgcttgtagctaaaaatatgctctatttaatggttcagttggggccagttgttttatgtaaggaactctgattgggctgtggtaaaactgcacttactgacgcatgcctctccttgctggtgaaattaatttggaatatggtgagtccataaagacagaggagtaaatgtttccctttttaaacagtagttttcttggttccattgtaggagtaatgctttgagcccttagtattttccaaactcttatcagcctctataaaattcctatttttagagattatgtccaatgtaatgaatcttgtttataaactcatgtagtctttacatttagttttttatcaatagatttggaccactatgcttaaagctaatcagcaagtgattctgactagcagaacacctttgaatttgagcaaacgtactgtggttccaattgttgtcactcagaggtacaagaagagttgaattaattctcagtggcctgagtaaagatctagaggcaaccactcacatattttaaaataataataataattctcttggaattcttccaggtctgttttattaacttcctactttctatactaaaagaaaaaaatagattagtaatattgttaacctgatgatgatagaagacttactccttttaaacaaattttcaccctttctaacagtttagctgaacatcctgaagcaagcgagggaaaatataaagcattgcaaactcaaaagcacatataaatcaagtcacttaaaataatggactcaagaaaaaaaagaaaacatgatattcctggtgaagcttttgttttcacaacaaaattttccctggttacagaaaaatatttctgaagtataaaaaagtgaaggcataaacatgataatgaatgacaactggcatcttcattatggggatagaagagattggtgtggtctgtggcaaaatgaagaatgcatgccctgtcttatcagacattatgctcagctccagcagatggttatcatttggggagtcagagccggcagttttagattttacttttttccccaaagaagccaaatccagatttttaacatgaaatgtcccggcttataaatgttggctcaatttttttggacagcatgtagaccaaacaaaattgatccataagctatttggcctattggttgtcaactgatgacccctccactgtagattttctaacaagaacagatggaacattttctttgctaaccagggtaataatttagaagggctctggaaccccctcttttgaggaagcagaaccctcatgtcaggatttaataaaaaatgttttggtcattaatttataaaatttcatagaatgcaaaagtttctggattgatgacatatcacttagcttggagaaggaaggcaagataactaaggcagaatgaaatgtgtgtttcaatagagatttggacaaagctctgtgacagtaataaacctaccctaggtactagcaaagcttcacaaaggaagtaacaaaaaaatgagactctgaaatattaataggatttttatagaaaaagaagagaggatttgccaagggaggaaaaagtataagcatctctacagttacattgtgggctttgctaagtcttaagatggtgattgattgggtataattggaaagtaggatacatgagaacatataattagggccaaagggacctcaaatatcagtctacacatctaaaacttgattatatagttaggggagccattcaggtttagaccagggaagatacatcatctgatctgagattatctgatctgcatgttcttattccaaatcttggtttgagttcccttaaagtaattggacactttctgtaaggaattggataaaaataaggaccctacctagatactggctaaaaagctatatgatatctggagatactgacaattcttaagaatcgactttacactagtcatgataaatcacatccttgtgatttccatatgaagctagaaagcaatgttcaagaggctatcagaatacctggtaatttcatggaatactacacagccataaaaaagaatgagattctatcctttgcagcaacatggatgaagatggaggccattattctaagaaaactaaactaattcaggaacagaaaatgaaacactacatattctcacttgtaagtgggagctaaacattgaattcacatggacacaaagaagagaacaatatacaccagggcatacttgagggaggtgggtgggaggaagctaaggattgaaaaacaacctgttaggtactatgcttattatctggctgacaaaataatatgcacaccaaacccccatgacatgtaatttatgtataaaaacaacctgtgcacatacccctgaaactgaaataaatgttaagaaaaagaatgcctggtaatttgactggcatgcagaacataatagcctgtcctgcatttgggttctgtgcagagaatattgcacctctattagaatcaactaatataagtcatgaaaacaaaaattgatggaattaggttgaaatagactggaaaggaaatgtgatgaccttaattattttagcaaaaaaaaaaaaaaaaagaggttagatatatgaagttgccacagtatgaaagtggaatgaaaatgcaatatgtaaatataagctaataaaagtgtccttttttatattaaaacatgtattcaaaataagagcaaaaatattttaccaatcatgagaaaattgtcttaaagagaaagtacaggattaaataaattttttttcttcccaaaatgcccgtggccaaaactcacttgtgggtcaggtgtcataaaaggcaccttttgaccatacttgggtgttgattagaaaaatcaaccattgtgccaaattataattaaataaaacatgtcctagacagatggccattttggcacaattggcatgaacaatgtatgaattaatgtgaattgctttaacacatgatttctgtcttccaagaaacttaatgtagaatccatgtgactcctgctcatcaactcaacagtaactgtgggtctagattaatcactttgtttatcatttgccaattgctcatttagatgctttagagacagggaaacaatttagctaagcaatattaaataaatagtccaagatcacaataaagaaaataaaaatgataaatcttcagcttctaatattttgcacagttaatagagcagtgcaaaaaatgaattcctataaggctactgaaacaaattcatcataaagtaaaggggtaccttggttgaagtaaataaatcaggaaatctatggtagcacttaacatttatgatgaaatttatgaagtcataaataaatgggaaacttctgttaggtggcttggtcttatttttattttatttctttaaagcataagctgctttaagttttttttagaagtaagtggagtttaaatgcaagagtttgcatatccgctttttatgcctcacacttcttgacttatgaatatatttgacaattgattttagaagagggaaatgacaccgccctaggactttggaaatcttggctttgcctttagcttcttcagcagtcagctatattcaaaagcaaaaccattgattctccataatcaattctgtaaattaacagggttagataaaaaatatttggatcctatgcatcatataattggttattctgttcatgttttatttagttacattaataactggaattgagagtgcaagagtaagctgaccgatattaaacatctccatgagaacacagctatgtgagtgagaacatcaaatattgtgcatgatataaaacagtgctcaataattacttaattaactagtggttctaggccaccctaagagcttgaagtgatttggatatttcacatggaatgatgagctttgggcacttggataagatctgggaaggctgtacccaggcaaatagaaggggcttttcatttgaccatctgtccagccagaacgtaaagatctatttggctcattcctggctgattcagcttatggctttagtttgttacttttaactaatcaatttccttttcttttattttgagctattttcacctgtatcaaattctttgctgtgataggtagcaaacgaggagaacagtgtgagttacttgatggtttactttccttgagttttattcttcacagggaaattcttgactagagagaataaggcacccattactaaatcttagcaacaaattggattggctatagacagtgcctactttagcagctggacatcttgtgatgatccaatatggtggttcatttttgaggcttttcttctaaaaaccttctccataaaaagtgattgtcatttaaaaaaccccattaaaatataggcaaagaacatgaacaaacacttctcaaaagaagacatacttgcagccaagaaacatatggaaaaaaaaagctcaacatcattaaataaatgcaaatcaaaaccacgatgagatatcatctcacaccagtcagaatggcaattattaaaaagtcaaaaaaacaacagattttggagaggttgtggagaaaaaggaattcctttacactgttggtgggagtgtaaattagttcagccattgtggaagacagtgtggcaattcctcaaagacctagaggcagaaataccatttgacccagcaatcccattactgggtatatgctgaaaggaacataaatcattctattataaagatacgcatatgtatgcgttcattgcagtattattcacaataacaaagatgtagaatcaatgtaaaggttgatcaatgatagactagataaagaaaatgttgtatatatacaccatggaataccttgcagccgttaaaaggaacgagattatgtcctctgaagagacatggatggagttggaagccattatcctcagcaaactaatgcaggaacagaaaaccaaatactgcatgttctcacttacaagtgggagctgaatgatgagaacacatagacacatggggggaaactacacacactggggcctgttgggcagggggtggaaggagtgagagcatcaggaataatggctaatggatgctgggcttaatacttaggtgatgggatgatctgtgcagcaaaccaccatggcacatgttagcctatgtaacaaacctgcacatcctgcatgtgtatccctgaacttaaaatagaagttgaagacaaaaagtgattgtcagcctgggcccttggaaatatgaaataatgaaagtagctaagtgcagttgagtgagaaaggaaacaagacgagagatccccaatttgcctagatataagtaagcattgtaggtctttcaccaattaaatgatcttaacaatttagagttatgattgaaaattctattggctagtactaataaactttttacaaaagtaaaaattttacaggagaaatcatatggtctggctgaatctctttttctgtgaagtttctgaaaaattgactagcagttttattattttagataagtatactccattttggaatctcatcttaaaatagtaatggaagtcttattttgaagtcacagccgtaaagacacactccaagcaattctcacagtgctgagtctcccaaatgagtgagcatgtggtgtgtgtagcttggtggtgagcagatgagcagaaacgtaacttagctgctctaagcaatcacaaggaaagatatattataaatattcaatatttgatatgcagttgaattttattatgcattcatcaaatcattgctgtgccaaatgctccagtttggaaaccacaaagagaaataagacattgattctttgtcgcaagctgtctctgatgttcatgtactttgactgccgtcttcaaaaggcatatagataaccaagaaattctttgttataatatggaatataaagcacaagagttacaatgggaataatatgtgcaggagagcctgtctcttcagtggaatcatggaggagaaggaagcaggaagtaatcatttgtcggttcagctagttaatttgaaataatgacacattgaaaccattatttcccaattaactaagacttgaaagaagaaagtcaactaactaattaaggttaagaataaaaaggatatactcattattaatgaatgaaaatgaaataccttaaatggcccatagggacagacaaggacatgcctcttcaaagaagattgtaagttctacataagaacagccactatctttatacactacagaattaagaaggaagactgtggattgaccttaaacactgtaatgttttttaaggaattgctttggatttttttttcagcagttttaaaataatttttatgtatcttagaatagaagaggtgaggattgaggctatttataagtcatatataaaacaagacatgagaggctgggcacggtggctcacacctgtaatctcagcactttgtgaggcagaggtgggcggataacgaggtgaggagatcgagaccatcctggctaacacggtgaaaccttgtctctactaaaaatgcaaaaaattagccagctgaggtggcgggcgcctgtagtcccagctacttgggaggctgaggcaggagaatggcgtgaacctcggaggccgagcttgcagtgagccgagatagtgccactacactccagcctgggcggcgacagagccagactccatctcaaaaaaaaaaaaaaaaaaaaaaaaaaaaaaaaaaaaaaaaaagacatgagattaaaaaaaagactggagtgagatggaatgagagaaggcactatttaaaagctaagttaactctgagcttcctggaagccaaattttaaaacctaaaacattactccttatctttaatttttcagtcaaaagaataaataaattacttgtgagaaataaactttttatgccacagaattccaaatcaaagtccatatacagatttatatataaattattttattaagaattaattataaaatgatatttacataatgttaggttggtgtaaaagtaattgtggtttttgccattacttttaatgcaaaaaccacaactacttttgcgccaacctaataaaagctttgccttatttgataaagcttttgaatctttggaagcatctaaattaatcatttttctattcaagagtattgctttcctttgtttctggcctcttagctgcatgactatcagtcagtgacttctcacagccttagtctctggatctacaaaataagtatcctggtgcctttctcaaggaatggttgtaaagattaaaagaggtaatgcaccaaaagcaaaatctctgaaacagtagttgttcaataaagctaaggtgcttcagtcttcattgtcattgtcctcaacatcatcatcaccatttctaccataacacttccagagacctgcaatgtatcttccaattgtacatggtagatggggggaaatgaagtcttatttcagtgcagctggccgccctgcttatcatagcattacatgtattcaggagtacctagaacataaatcattaaaccagcagtagtccctgataagaactacattaggttttatgatgtcaagaatctgaagctaccagaggaaagctgatttatagttctctcaacacctgatttttttaaaaaaaattggtttttcaatttcgattttctcctttcttttctgacatggtggagcttgtacgtgcaagaataatgttaattgactggagtaggaaaaacaagagaaagtaaatcagaaaatatgtataaaggattgaccaacactaacacactggttatctttctcatttgtccttttgcagctgtgaattattttttcttgttaaagagggagaagatgcttccagaaaaaaaattaaaaccatctgactacatttttagggtgtctctggagatttaaggctgagatttgaattttttttaagttactgagtccttcaagtttaggaagtgaggctttagaatactctcaaattagtagttcaaattctctatgtagcttttaaactagcaaagttctttggcattgctcttagcaagtaagcaatagatgtatatgtctctttttatgtttggtcagaataaaagacatgactttggaataaaatatttattctctctaaatatccaagtctctcttttgtattttttcacgtttaccttttttgtttgcttgctgaatttgtagagttttgtaaccctgactatactgtcacattaggcaaatacatgccattagtggtcaaagtgtagatgagggatatagataaagaaacaaatataataagataaaaaaaatcagataatcagaaaaaagccctttataatactgcaaaatgagtgaattaaacaatcataaatgacttccaagattaaaaaaaattatcctgggttagcatccagaagtgactggggagagaaaaacaataaacaatgagctgtgctcaggggtttccaatagatttagtgccgctctcaagagttcatgagtggagaacattaccaccaccaccacattaattgtcctgagtccctgcttcttgcggttgcaaatcctatgggccattgaggggactagtgggctgttcacatcaatcatcagacaggaacggaacaaactccaaggtgatgaattttttagtctacaggtaaggtagtggataatgataaacaaatgatgtcttctccaagagagagaatatttctgctggagtctgtgctcacatggatgccttgtgctttttggaccccctaaacagtctccatcttggcagtctcttgccatgctcgatcagctggttttttggaggcaatgggcattctttcttaggcaacgtccaagtgatcgtctattagattggtgcaaaagtaattgcggttgttgccactgaaagtaatggcaaaaccgcgatgacttttgcaccagtctaatagctatactggctcactgctaacctcccaccatcttttgtactcatcgccgttctttttaaaaatgtagacaaattatatttttcccctcaactttttttctccagaggtgtttatttcctttaactttcctcctttggaaccccgttctcttatttcttaacaactgatctagattgctcattcaaaccagggctgaaaatcaatcagaaaaagcagttctgtttcccttgaagaaaaggcttactttttaaactatgcaaaggtgaaagggggaatatttgcagtccattcgtggtaaatcaattataaaaatagctagtatttattgagcaactactctgtcagttacttgttctacatttcatagaacttaaagttctacaaaatagaatttaaaatagaacttggctgggtgtcgtggctcaccattgtaatcccagcactttgggaggccaaggcggccggatcacaaggtcaggagtttgagaccagcctgaccaacatggtgaaactccttctccactaaaaatacaaaaatcagctaggcgtggtggtgcgcgcctataatcccagctactcagggggctgaggcaggagaatcacttgaagctgggagatggaggttgcagtgagccaagatcatgccactgcactccaggctggttgacagagcaaggctccgtctcaaaaaataaaataaaactgaatacttaaatacttatttaagtattacccccctcattatgcaccattagtcctgtcactgaacctgctattcaagacatcagctttccattttttgggcaaggacataagaattagtctgcatttctgctagataactcaagttttcaagactgactggtagaacacagactagttgatttttatatacagtcttgtctcagaataattctaagacttctcttttagagtttggatctactaatcgtatagataatattttggtcatgctagttcttagagagcaaggaagggacccaactgtttatatttctcctaagaataattaacaatgggcttattataacaaagggctttgtgggaaacaaattaaatggctgtcacaatggtacaagcctgaacttattgattgaacaaactgaacgctgtctggaaacgctggatttctgtctgaccctgaaagaattagttatcttcaatccaaattgcattttgagctctctgaaatcacaagaaaaaatactgtttctaaaactaaagtaatccacgttcttatcttaaatctctatttctaaaatcaccaggtttttcccactttttaaagttaatttattctgacaagaaagccccgggatttcagagctactgagatgtaatgatagacactgtgattttttttaaaaaatatgttactatttgttcatgcttgagttaaaaaaattagtcaatggaatgctagttaatttttggatattctgtctttcagtaacaggtgtcatatttgagaatataacatcagtgattttatccaactgtatgtttctacatcttaaaatgtttcctgtcaatgttatttcacttaataaaaacaaactatttttattctaatgaaaaacagttttgatgccaaaaagacttagtcacaatgtagaaaactcagacatcctaaaacctgctgattttcccctttctgaatttccatgctaatttattatacatacatctctctaggaagttttaattagatattaaaaattttgacatttgacaaatattgggataaaactattcattttcatatttaataaagctcttatacattggcagcttttttataaacttgacatttaaaggaagtaatatttatatttggaaaatgacaagcttgacataactggatcctggtgaagaggtagctaattggcatagactgtggtggatctcctgctgagtgcttggattaataaaagctttctttggtgtcaaagtaattctctggtgtccttaaatgcaactgtttcttaaaaatctccaaagattttagtgttgaaatagttctctagtacttctaatgctgctgacaaaaacaaaacaaaacaaaaatacaaaaacataaaacaaaacttttaattatagaaactttcaaatgtacgcaaaaataagcaaacaatcaatgaaacttcctgtcccatcacccagcatcaacaccattaaccagtcatgactaatcctgccccatccacgtccccagcctttccccgacttctcatatttgctttgaaacaaatcccagatataatatcatttcattgtgaggttgttgtgaggattaactaaaagcatgcctatcatatgggtctctaaaagatgagttccctgttactctcaccataattacaatgccaatatcacacctaaaaactaataaactcttagtatcacagaattttgagtcagggttcaaattttcaattatctccaaatttatgacatagtttaacatgtttttctaacctatctctgtagtttctgtaagtcggaagttggatctaaactctggatcaagattctgttttgtgtttttgttcttgttttttattgatgagattatgtcatagctatattcgttcttcctttgaggaggcatataatttctcactttcttttttgtgatgcagttcacgcttaatgtctagatccatttgctcattattagttcagatgttcaaattcttgatttattacctggaatacttctaccaagagaatttatggaattaaataattttgtatgttttaattcactttagttcttattaatgcctgaattgttccaacttagaccagtgggagcctattcaagttttattctgagtttttctatagatctagtagtctttaacagctttattattatcagatatgataagatggtccagacttatcttgtatatttcatgactcaggcctgaatcagctatttcttcaatgacccttaattcctttcagaaggaaatagtgtttagagatgcacaatctgggcactagggttgtccattgctactgggttggttggcttccttccttcctcgcttcctcccttccttcctttcttgagaccaagtctcactctgtcacccaggctgtagtgcagtggcgtgatctcagctcactgaaacctctctgccttctgggttcaagcgattctcccacctcagcctccagagtaggtgggattacaggcatatgccaccacacccagctgatttttgtatttttagtagagatggggtttcatcatattggtcaggctggtctcgaactcctaacctaaagtgagccagactggtctcaaactcctgatatcaagtgatctgtctgcctcggtctccaaaagtgctgggattacaggtgtcagctgccgcacccagcatcttggtcattgtttctaagcctcattaacacattagagtttttaaacatgtttatctttttcccttatgttatttacaaattaaatatcagctgtttgtttacatgtacattttttacttgtaagacttgcttgacccaggagagatataaagcagcgtacatttcacaagagtgttcattggcacagatgaaattagaagacagcatttcaagccatattaaaacattttgcaacaacatcttatatgtttaaaattctatgtctcatatttgaactacaaataaataagcaatcttttgagttcaatttctcctgaaaatcatttctaataaatagatgtatatgctgggaaatacacaatagcttaataattatgtgaatatattagtgaattagaatccactggtgaattagtcaccatttttctaattagagtgtgaaatcttaattttttggagtctgattaactgataatagctatgtcatgatgttcatgcaaaaacctgtcttgatgagcattgcaatataaaaagtaccagttaataagcaaaatgaaaacaaaagaaaaacaagtactcattattttcccttcaaaattttctgagcacctgataaaatatgacagtgaaacttcagatacatcaacagcaaaattagtattaccagatattgtcttagctttttgtacaattaaaggctcagaaaaaaatgtatgctgaagaagagttgaatctggatatccacaactaagaagatagacaactgaagcaagttattcagtttatttagaaaaattaaaaaaattaatcagtttttcattaaacttgacttgtataatatgcataacatcaagtattaagcctgaactcttaagtattgtaatttccaaaaaatcctgttggggtgggagtaggggaatgactgtgtgtcactagaagctttgtaaaatcatagagtatagcagtagaataaattctattcagccacagaaaaaaatgaggcagatctatgctatggaaatctccaaagtttagtacagtttgttggttagatacatgggctgtggagcaagtcttcaatcttgacgctattagtacaaccttgagcaagctacctaattattttagatctcagttttcttaatctgtaaaataaatgttataataatatatacctctgagggttgttgtgaggattaactaaaagcatgcctgttgtatgataaatatttagactagctttctcctcctcttcctctaaccctcttcttctttctctttttcatctttgtccttccgcttcgcatttttttatcttacatcatcatcatcttgctgaataaaaactggaagctttatataattgtttttaaggcaggatctatttgtgttaatcaaagcatgttgatatatatttacgtatataagcttatatacttacatccgtaaacatttatggacagttacattaaaaacaattaagaagagcttacctctggagagcaaatctcttaaagaaggaaaggggagagaggcaaacacttgatatattatactttctcttgttttaggcttgaactttgtatctccatgtattttttaactaaaaacagtataaatttaaaaataaataatgtaatatatttaataaatcagctatatttggtcttaatgatgaggccagcctaatgaaagatggacaaaataggtgcctagatgaaattattcaaagtacttatatatggccacttctctaaattatcttgtctacttgcccacttaattcaatgaaattcttctactagaagctcattccttggtgttaatattttccctttttacagaaagaaaaataaattaaaaacttttggagaagttaatttaagagaaccattagttattggcattaaaatataaattctttttttaaagtggtcttccagcccataatatatatctgctacactgctctctgatagaatggatgttcagattgttggagagccagtgagttatgagatcaagataaaaaaaaaaaaaaaaactggggtgaagcatactgaaatgagattgcaaggtgtctacaaacggaaggttttctgatccaacagtctagacttaaaatctcagctctgcccaatgaagtgatgtgtagccctgaaaaagtcacacttaacttttcagacacttttcttcatcaatataattgagacaaaaagactcacatttcatggaggtttgtaaggacctaattcagtatttgaacttgcctaacatgagcctccagtatactgttcattgttattttagtaggagggaagcagcgtccaaggacactcctggctaaatcactaaacaactaagcgaacttggctttgccatttatcgtttttgtatctccagttactcatataaaagcagagctgggttgtgaatgatcattaagttttcctgaatcaaaattcaatgactaattgtttgatagtattgtactctaacacagtctcaaaattttgtcacctcaagaggaactaactgtaaccctaacctttctcgttgttgattttttaagtcacttggtctttataaaagaagaactcttgataataaaaatgctcaatccattaaaaaataacatataactgccactacctcttaaatatttaattgtttagtattttagaacattataaaaccacctaatggtttacctaatttatctgataatttataattatttgccataatgatacattgcacagtatgttttcatctgatgtctgcattccagacttaaaagtccatgccctattttcaaccatgtttccctttgtgataaaattatctttctctgtaataaaaatcatttttccttttaggttataatttaagaaattacattttctggttacacatacacacacacacacacacacacacacatatgtaatgtttaaaaatctaccacaatgatttttaaactatgtaatctttcatgtctatcatttattattcaataaatatttatgggatgcctcccctgaacaaggcctaatttcagaaactttgaaggataaatgataagtcatacaaaaatctaacacttagaaagttttaagtcttgataatgagatgagatgcacatatctctatctccaccgctatccaaagtaaacttcaaagaaaatcatgaatttttaatgaaacagaattattttgaacagactattaattcttaatttaagctgtggtgctgaatcatatgacactgtatattgcctgcactggttgaaaatcataatcaagtaaggagaatttgcctaaagagtgcatagttcatttaatacagtagtcatgatatattaatttttattctctctctttttttaaactcagagtactcactaatcttcgcagtgttcctgtaaacagaaagaaggcaggtggcactagatattttttctctaatcatcttttcctgctggacctagagtggctgaaaatgacaatttgctctgtaaatatttttctttgaacatttttttttaactgccaagtgacctcagcattaccaataagggttttgttcagtgacgtttaatattcaattacggaaacatatgtcactttaatgtctaaacttcatccttctcataaaaagtttgtggagcacagaaggaaaacagagcatttctaggaattaactatgtcacatggaggaagtaattatattccagtaggtgtattttttcatcatgtttgcagtaaattatgtccacagcaagaatgcccaaagtaggccgggcatggtggctcatgcctataatcccaacactttggtaggatgaggcgggcggaacacgtaagtccaggggattgaaactaaaccccgtctctataaataaataaataaataagaccagaatgcctaaagtatctatagaaggcctaattaatcaatatatgaattggtgatcagttctgcgtttttggcgctacatttttgccctttgcccctaggattcaaatgcagatttcaagttttggtagatagtcatagaaaataggagctcctactttctttttcaaaaccagtaattcgctttcattgtatgcagagcaaaaggaatccatgatgagtcattgctattttaaagagaagaaataatcactagatagtagtatattcattgttgatatattaagcactttggatgccttctttgtacaaccagtcttatttaattaagcataatgatttaattttttttttcttctgagagtgatccccaaagtatctttataatcattttcagttaaggtgaaccctttagttgctaaagaacatgcttgctgaatttgtttccccacagataagtaaaatatgcctttctgtgttattattctgaaggtaaattaacacttaaatagggcatattcgtgtcaccgatagagagtcgtgactgcaagttgcccaggttcttggtgttttgaacaaagaattggacaaaatgctcagcgaagcaaggaaagaatgaagcaacagaagaacgaaagcagggatttatagaaaacgaaaacacactctatagtgtgggtgcagacccgagcagtggctcaagggcctgtataaacaatcttcttgggttcaaatatctcctagaggtttcccattggccacttcatgctcacctcatgtaactgaagtggtagcccgcaatcagtctgattggttgcagaaagcagccaactagaggctgaaatgaagttacaaaggtcacattcctgtgcaaacatctgattggttgcaaaacattaaaccaagtatatggccctttttagtgaagagtcctgtgagactacgtaggtctcttgcctatggtgccggcccgagagtcaccatcttctctctaggtctaactatcctcatctctcagcctctgggttaaggctttttctttagtgaactggaatagaccaacaactcctagaggtcagaattttaccaaccagtataaagcatagccctggtattcacgaggtgctcaggagagaacctatccagcctgccgtgctttttccctcttgtggaatctggacttgttttctcttcagtccatttgctgcttaatcgtgtaccatgtcatgaaacctcatggtttttgttgaattggaatcttggctctctaatattgttttactttttatctcatctcaattgtgtactccttgataagagtccctttcctagaatcattatatcccctacatactaagcatagtatcttttcatgtgagttagagaaaaaattttcttgtataaccgttgacaaaattaattagcaacgctaaaaccaatgaaaacacattactcttagttcttagagtattaaagaattcagtgttgactttcaaactattatctttgccttatttgttaatgtattgtaattgaaactaattaattttaaatctaagctttaatcatgtaacataacatttcctagagtgtgttccatgggatattgatgagcattatgtaggtttctgtgatcaaataagtttgggaatattttagaaaataataatatcactaacactgtattgattcctgttgtctttcccatttccactgctgctgccttaggcaaggctttcattagcacttccctgagatgttacccccaccctacctccaactgtccccatctctgtcaattcactttagttcaactggactcatcagttgcctactgtgtaatcactggtacctgtgatctcaccaaaagtatctgtcctaaaactcgttttacatttgtagttctcaactgggggcgattgtaccctccaggagacttggcaatgtctgtagacattcgtggttgtcacaactcaggctggagcaagagatgttattgaagtccaatgggtaaaggccagggattctgctaaacattctacaatgcacaagacggcccttgaaactaagaatcaaacacctcagaatatcaatactatactgattataccactgacttcttggaaactgtcattggtttccatctcatacctaaggaatttcataacctcaggcatgatattcaaaggctttcacaatctgacagtagccttcctttctaggccattttccactagtcctttcaattcatattactccccagtctaatcaaatgactcagtcctcctctgacacaacctgtacttccctacttttctgttctgtatgatatccttttgcctatggtgggatgcccttccctcttgtttacctataggttacccctgttccaggtcaaatgtcacttcctctaggaagtctcctttgattttcttcttactactcccctagaagagtgatttctctcttctttggacccccttagcattctatttccctcatatttggcacatgattggcacaaaaattttacagatcttacttttttttttttttaatttagtcagagttttgctctgtcaccaggctggagtacagtggcgccatcctggctcactgcaacctctgcctcccaggttcaagcgattctcctgcctcagcctcccgagtagctgggactacaggtgcacgtcaccatgcccagctaatttttgtgtttttagtaaagacagggtttcaccatgttggccggaattgtctcgatctcttgacctcgtgatccacctgcctcagcctcccaaagtgctgggattacaggtatgagccaccgtgcccagcccttacttctaataaacagtaaatatttgaatgatagcatcattaacaacaacaactttgtgtcctgtaaagcttttaatagatgtgttccataaatacttaaattgaattacattatttagtttagagaagagatttccagctcaaactttatcattagctttaaatttgtctatgtatttaacaagaattgagtttctgctgttagtaataactttattttaagagatatcttcttctggaaagaaaagctttaggcttaatataaaactggccacaactgaactataaccacaaaactattatatatattatactattacaactcctttgatagttaacgaaaggattccgatataatagcactaatggaatgatgttaatattttttgtttaaggaaataatcactaatgttagttaagtgatttctgacacaaattaaaaaaaaaagctgtctcagacttattctttaaagtatagggaaattgattggcttgtaattggaaattcaaaggtagggttaacatcctcaaactgctggctaaacaagtttagcatctcttaaatatagattttagaaaaagagggaaagagtcattaccagatactttggagggaacatcaagaaagaacttttccagagctcctagcaaagcacttctcatgtcatcgatcccatttctttataaaattttttgtcatttggcctttttaatttttaaattattttatttttaattgacaaataattgtatatatttataggatacaaagtaatgttttgatatatgaatacattgtggagtgattaaatcaaggtaattaacatatctatcatatctttttgtggtaagaatatttaaaatctattactttagcaattttgaaatatgcattactattaactacagtcaccatgccgtgcaacagatcactacaacctattcctcctgtctaattgaaactttgagccctttgatcaacatctcctcttctcctactactcctctccagcctctattctactctctgtttctacgaattcaacatttttagcttccatatataagtgaaatcatgtggtatttgtcttctgtgcctagcttatttcacttagtataatgttctccaggtgcattcatgttgtcacaaatgacaagatttcccctttattaaaaccaaatagtatttcatagtgtgtatatatacatttctttattcattcatccctttgcagacacttaggttgattccatatcttagcttttgtgaatagtgctgtaataacacagagtgtagatatgttttctacatactgatttcatttcctttggatatatgcccagaagtgggattgctggatcatatggtagttctatttttaattttttttagcaatctccacagtgtttttgattatggctgtgccaatctacattcccacaaacagtgtacaaggattcccttttctccacatcctcaacaacactgatcttttgtcttttttgatagtagacattttaaaaggtgggaggtaatatcacattgaggttttgatttccatttccctgatgattaatgatatttagcaatttttcgtataactattggccatttatatgtcttcttcttttgagaaatatctgttcaagtcctttgcttattttcttttctctgactatttttttctttcttttttttcctttgtagagtctcgccctgttgcccaggctggagtgcagtggtgtgatctcagctcactgcaatctctgcctcccgagttcaagcaattctcttgcctcagcctcccaagtagctgggactacaggcatgtatcaccatgcctggctaattttttgtgtttttaacagaggtggggtttcaccatgttggccaggctggtctggaactcctggcctcaagtgatccacctgccttggcatccgaaagtgctaggattacaggcatgagccaccacagctggcctctttgcctatttttaaaatcagattatttgttttcttgctaaggttgagttccctatatattttgaatatgaatattttatcagatgtatagtttgcaattattttctcccaattccaagattatgtgttcattctgttgtttactttgccatgcagaagctttttagtttgagtctatttttgtttttgtttcctctgcttttcgggtcatattaaaaaaaaatcactgcccagatcaatgtcaagaaactttttgcctatgttttcttctagaggttttataattttaggttttatatctaagtctttaatccattttgaattaatatttgtatatggtgtaagacaaggatccaatttcattcttctgcttctggatattcaatttccccaatatcatttattgaaaagactgtccttttctagttgtgtgttcttggtaccttttcaaagtttaattgactgtaaatatgtggatttagttctgagctctcgattctattcctttcatctatgttctgctttcatgccagttctattttgtattggttactgtagcttcgtcatgtatcttcaaagaaggtagtgtgataccttcagcttagtgcattttgctgaagattcctttggttattcatggtcttctatggttttttattagttttgagatttatttaaggaaagaaaaacacacacacacacacaaccaaactcaggaggctgcttattaatagaatctaccatatctttaaaataaggttttccttgtgtcatctctgtgaatttaaacctattttaatagctaaaaatggacagttggataacatattcttcatactttttatatttttaaaagttaataaatcacctatttattcttttactcagatttggataattccaaattttttgattaatgtttaaactttaattatttcggtttctcatctctgttcactgttctaaatttctctgcacattttaagcatgaggaagctgacagtgtacacaaataccctcctactgggtgcatgtcttcttgttagaaacaaaacaatcaagagatttcaataagcttttcaatcttttgtgaggaaattatttcagcccagtttagaatttctgtatttttcctcccatcttgggttacttgttagactctatacaagtgtgtaaatcttgattggagaagacactgctgatggtgcacatgatttattataaccgtgaaattaagtcctgggccacatgcccagtatctaaactaaatcaaggagggcttaattgaaattaggcagtgagcctggaagaactttactttgttcattctcaagtttccaaatccactggattcatgtttcatagaaatctgaatttgggggtcacaggaagagagaaatttaatattaaaaatatactggttatacataagattctgtagcaaatgaacctaaccaggaaaatataggttcaaggagtaggaaatatatgtccagcatataatggatactttgtaaacattgaatggtaggatacttttcaggttaaattatgtacagtgttagaaaatatttgcaatacttaatcagaatatagaaagatcaggaaataattcagcacatttagaatctttatttcaaatgagaacagcaggccatgacagaatatagaccttcatgattctacagacgataaaattctgtacttggattgttttttcaggaaaaaaaaatatatatacttttaagccctctatgactcagaattttaaaagtgggaatctattaagtctcattctactttagtctctcattataatggaaaactggattaaataacagaatactttcaactacttagtgataaatactgtgcaataggttgtttttattctttcagatcattccctggagacaccagtaacctaactacttgagaattagcatagagatgtgatgttaaaactttgaaaatcaaattcctatcacgaaatattggggataatagacagatactgagtaagaacaggtaaatactgcttaattctacccgtaattctgtttaaattttcaagtgctgggagatttggagtcttggagacatgattcatttttaaaagtcaggtatgaatatattcaattattagggatggagtcttgaatagaacagaatgtaagcaacatctaggcactgagtttgagatgtacaagaaaagaacagctatcatattcacttcaaagcaagtgttttactgtcataatagattatacaactttttcaaccacaaactttattctcaagtccatgattcttatgagatgtaactaaatgttcttgttaagtgaacttttctcttcagaaataccaaaatacagttgtatgatgcatttttaacccagttagtgtagtaggcaatgaaccacagggtatcaggaattaatattttctgaaaattcctccttctcactgcctctagttttgatcacacttggtcgtgctctctgacgtccccaatatgtgcacatcaattcattcattcaaaaaactttgtattgagagcccatcatgtatagtgtgttatgtggaaacagagctaggtaggactaatttatctttgtatttccagtgcctgaaacattagaaggcctcaggaagtgtttgctaccctaaactgattctttcaccgcaaagtatttgtgtaattcaaactctcttagtcctcgccttggctataatggcctcctaactcatgttcatttgcctactctctctttaattcatcttaaacaccactcccagattcttcctaaagcataactgtaatcatgtcatcccctgcgcaaaaaccttaatggccctcttatctcttcagagtagtattcattttccttcctcaagatactcagagccttccacaacttggcaccaacaaaccttttcaacaggactccttatcatttgccttcacacatcctacatgctagtgtcaattagattggtagcatagagtaaggcaaatttaagagtacagactctgaaagcttcgtgactatgaatcttgacttttctgacttggcactgtgtggccttgggcaagttacttgaattctctgtgcctcagttttctcacctgtaaaagaaggatactgataactcctactgcatagttattgtgataataaaatggattaatatatgtcaagcatttataatagagctgggcacatgtttattaggtagtaggtggtgtctactgttatctgttttcccctttaagctttgctcatgttgtttcctccatttgaaaagcccagtttactcctttactctcattgttttatatgcatgtccaaattctacctatccttcaaactctcatttatatggtttttttgtttatttgtctgcagtctatacacttagccactaagctcaattgcttctgccgtaacaacagaaaaattattctcatgataaaaatcattttgttttcagatgaaatatagtaagcatggatacagaaatttggggtcatggaataactccaatgacaatgttcattgtatgcagggcaatgcagagtggaagattatgaaaataaaagtcagatttgcaatctctgagcacctgtcttaataattataagaatcaaactgtccttgtgccccaggatcgtggagtgattcagaaggttttgtagtaaagtgccatcagcattctttattttgtggtcaaagagacatttaaatatgcctttctttcaccttgagaattatggcccattcttcaaacactcagcataccgttaagcagtttatggagtggaacatttttgattcactgagaggtggtttgtgaagaaatttttagccatgagtttccagttatattggaacccatttttaacaggcttccaacaggagaataaagtagagacttcctggtgagatttagcagacgggactgttctgctgtgcagaattatatcttccctctcattgcttgaggactccagggtactgggctccagtgaaaagcaaacaaagtgtttgtccagaagaaagaaatggaacgtgtcctaaacaagttttttgattgcagaaaaagaaatcaactttaagaaataagcaaaaaggaaaaaattgcaaacacattgatagaatcaacagctggttataagaccaggctcatgaatgaactggattaaaaagaaacatgagatccttggaagcaggaaatacggatttatctgttaacagaaactatcccattggcaagcagtacagtgaattatattcaactgttactttcatccttgcactactggatcaagattttatctcctgcaagtgagactctctttatgacaagtctaggtcatgcacccactcgccatatctattgacaaagggagaaagaggatctggcctctctgccacccaatgcagaaagaaggcagtcacctagattaaaatactcctttctctccaggattaccataatagggcagggcagtcacagtgctctgagggtgggagaatagacatagggcaggcacaaaatgacaaatgtcccttccagatcctagggggcaggtgacatgaaaagtagcccaacaaacatgtcatgaatcccacaggaccttgccttagattcaaacctggcctacgtcaaggctaacaattatagaaaactgatgctgtgagggaaaaaaaaaaaattcatctaaaactcattcttcatctataagcataactcgtagcaagagatgaattctcactaaaggatatagagcagaataaagttaaattgaccccaaaactggctacagctttttgccattgatttccatagagagcggttcttttaacttctggcggttttcacttttattttttttcttctacggttttcagaaaatagtgtctccttgaaatattagcagaaaaactcccagttttctctttcccaggacacatttatttttcaacctgtctagatataaaatacttaagttttttttgcccaaatcctttctacttttgaaaaacatgtattttccatctcttctactcccatattactagacaaaaatgacacacttggacaaatgcaaaaacaacagtgggcaatgggtttttcaaaatgagatcaccagcgaattctctgtatttattatgcaatttgcccactttgcatttgatttggctgttttatgttttcttctaatcaaagttctcagtaaaacatgaggcaaaggtgtttgttttataagcatgctttttatataattcaagtattcttagggattctagaaaataggcttgaagattgggttaggggtccagtagagaacaagcataaatataccctaaaatgacaatgttccctaaaacaaataacacacagggatgacagttcgctcaaatgtgctacagagggtaatcattgtgatctggaacagtcagatgcattttagagaagagtcttgagatagccttcagaggacaggtaggatttttgtaggcccagaggagctgagccatctggctgggagaacagcatgagctaatacccaaggagattaataatctataacaaatgaacataattgttttcaggcaaaatcaagggttatgatgatgtgatgactaaaaggcttgactcagtccattggaaatatgagactaaagggcaggggaaatttaggagtatgagtatagctatctccgtgcacagtatcaagagatgaagctgtagcagtgaattatctcacttgtagtcaacaaggcagattcaggttttgtgaagtttgaagcctattccaatttggaatgtcctatttatggaaaagtatacaaaattgcaaatgcaaacttgctagagctcatcacaagccttggaagatgccaattaaatgagagaccctgaatcctaagctttgttagtttttgaaatgtctgcttccaactatagcagtgctgaccagtagaaatataatgtgaaccacgtatgtaacttaaaattttccatcatgaacatcaaagaagcaaaaataagcagtatttcgaccccactctagacctactgaatcagaatatacatttttaataaggtccccagattattcatatgcatattaaagtttgagatacgcttttgagatatgtcgctctatagaatgaagaatagagtgtctgaaaatagttgctgaaaaaaagagacaaagaaattctcaaagaaggcctagggaagggaattaaaaaaaaaaaaaaaagtaacagagatggtttctgggatcaagaagacacagtgacaaatgacacaggaaggctgaacaagatggttagaattgagaataatcattatcagaatcatgctgaatgctagctataattataagaccatcaccaccggcagcaccgccaccttcatcatcatcatcatcatcttttttagcccattggtaaactttgagcagtttcaagggagagagcagtaaaaaataatgtgaatgtgaaaggattgagaaggaaatgatgggccataaagtgtgtttagattgcttttgggcagaaaaaaaaaaagacatttcaatgtaaaggtatcacggtatattaaggaaataggacagcatcctagcagtattttcaagtatttttcaacctaattacgaaaagcttatagtgactctttctcattccttctcatactcatttccctacctcagtaacccagttcaaataataactctgattattcacagtaacttcagaatacatttggaatagttctgaaatttattattgaaaaagttttcacgtggattcagagctgaaaatgaaaaatgatccttctgaagctgcttaattgaacacctttatgcctgtggccctgcttggtgatgcatgttatggctgccagtgggtaaaaagggttgcatgcagttattgaaatgctttgtgacttccgtgattgcaaagcttaatttaatcataacaacatatctcattactgttgcaaatgttttattcacttttgctgttaatatagtcctctatttttatttggattcaaggaaatataaatgttttaaattggaacataaatcacatattagaatccaaatgagcccatttcattctgtgagcagagattttattgttgttgttgttagaatggattttccaaaaagtgcttggttgatttagcaaactgagtgagtccatatataaagaaaagcctagatataggagactaggtattcaactttgtatttccattatcaagatgctatctggaacataattggcactcaataaataccacaaggatggatagcaagatgaatgaatggatgacaatacaacagttatttcccctacttacagttgatccaaaaaccattgcttccagtgtgtttggttattttcatgaaattaaccagttattttaatgaaattcctattttacccctttttaatacattggagttaagaacttaaacaaatttacaagaaaaaacaaccccatcaaaaagtgggcaaaggatatgaacagacacttctcaaaagaagacatttatgcagccaaaagacacatgaaaaaatgctcatcatcactggtcatcagagagatgcaaatcaaaaccacaatgagataccatctcacaccagttagaatggcaatcattaaaaagtcaggaaacaacaggtgctggaaaggatgtggagaaataggaacgctttttcactgttggtgggagtctaaactagttcaaccattgtggaagacagtgtggcaattcctcaaggatctagaactagaaataccatttgactcagtgatcccattactgggtatatacccaaaggattataaatcatgctgctataaagacacatgcacacatatgtttattgcagcactattcacaatagcagagacttggaaccaacccaaatgtccatcaatgacagactggattaagaaaatgtggcacatatacaccatggaatactatgcagtcataaaaggatgagttcacatcctttgtagggacatggatgaagctggaaaccatcattctgagcaaactattgcaatgacagaaagccagacaccacattttctcactcataggtgggaattgaacaatgagaacacttggatacagagcagggaacatcacacactggggcctgtcatagggtgggggaataggggagggatagcattaggagagatacctaatgtaaatgacgagttaatgggtgcagcagaacaacatggcacatgtatacatatgtaacaaacctgcacgttgttaacatgtaccctagaacctaaagtatacttttaaaaaattgaagttgattatttaatactagttgatctaatcaggcatttaattgtgtggataagggcataaaaagacagaaactggtcattatgaattatgtagaaattatcttctgtatttttagagtatctttttcttgaggataaaagataaaagtaatccttcaaaccatttatactatatttcttttgtcctttttgagcaataaacacacacacaaaattatgtgctatgtagtctgacaaaacatatggtataagacttagaattgtggttcaagactctagtcattaaacatatgtagaatttgtactatgtgtcagttactgtactagtccttggggaaatttagctgaaaaagactgtttcccaactcactttctttttgggaaagtttgtatacataaaaccattatatgatcaattataaaaagtacaaccatagactaaggagaaaagtataaaaggagcaaatggagaaggccatgaattcttactgaaggattaagaaaaacttcagagatgggaatattttaactgagccttaaaagattgaagactgaaaatggggaaagagaatcacaaagggtagcaagttcaaaggtatagactcaggatttttatggagttagtgaatagtgtactggggcagtaagtgtggagtgtattgggtggaatgttaggagtagcactagaatgttggatctagtttgtgaaagacttagtaggctctactagcgagttcggcttttaacctatggaactcaggcaactaccaaatgtttcggagcaaaggagtggtatgattagaattaggttttaaataatgaattttagcaggtaaaatttacagtagaaactgtaacggtgtccagtgatgaaaacagaaccagaaaaccgcaatgagaaagggaaagagaagataaatataaaagagattatggggccagattgggcaacactggccagattttgatatgaaaagtgaagatgtagaaagagtcaaaaacaaggcagatgtttttagcttgagcaacgatgtggatgccatggctgtgtgagaaactctaaaagaactcaccaaggccagtttcctgttctatacagtttcacatatgattttcatcttatagcttattccttctattcaatttcacatcaaccttaaagctgtttagaaaacaattttctggctggatgtggtgactcatgactataatcccagcactttgcagattcaaagtaggagtcttgcttcaggtcagtagtttaagagccgcttggacaacatagcaagaccccatctctacaaaaaaagaaaaaaaaaactaaaaaattagctgagtgttgtggcacatgcctgtagtcctacctactctggaggctgaggtgacaggatcacttgagcgcagaagtttgaggttgcagtgagctatgatcaagccactgggaaacagtgagaccctgtctcaaaaaaaaaaaaaaaaaaaaaacacacctgactttttgatattgtctctctcttcttagatatagcaatggaataaactgcagaaacttagagagaattattagatctctaattaggaatcattttttctacttttcaaggaaacattgaaaatatttccagggatgaaaattaaatttttaatttgtaaattttaataatggtttcaaaatttaacatttatgattctttgaataaaataaacaaaagatagaaactgaattttattaatttctactttaaaaattattttgttgagttttgtttttctttagttttatctccctaaaattttgtaaattgaaatagagataagtgttattattaatatttttgagataagctacccagtgggttcattttgctggaatacaatttatattttcttgagtgaagaaatttatctttaagtgaattatgaaattaaaccagaataatttcaggaccactaagaagttcattttattcaatttgacaaacataatttgacagaatatcatcagtattgtggcaaaacctaaaataatacaactcttaagaagaataatcatttttctttctgttgtttggcccatcaattcatgaattaattttcatagccaaatttccaaaacaaaaatacatttcttcagaaaaagtaataaggatctgtgttcttccacaggaatctcttttcttatgacactgtcctaacatggacagcttatcacttactacccacttgaaatactcaagaacataagtctcttagaaataaatgcactctcattttgcatctagtctattgtcaaacactgggcttaaagcattttcatggctgttgtgttgagttgctagtccaaccctgtgagttttgtataatcattaccatcttagcagtccagatactgagggcgaataagataccctctttgaaaatggttctggtacagaaagatctcaaaactccatctttgttaagaaaaataagatgagcattggaaccaaaccaatctgatctaaatcctgactctacaattacttaaaacttcctgaacatcaatgttctcatttttttaaatgaagaagatagtacctaattcaaaatataattaggagggtaaaataaaatagtatcttcttttgagaggatgtcagtggacatttaatcagcaacggcttggggatagcttcattattgttataagagtatgtcaacagtgccatctgacctgtggacttttaaaagctgctcatggttgggaacagcaaattattgtgctccagatctcatcagccactttattcacaaacgttctgctattcaagtctgttgtcacttctgagtacaaatctcttacttttcattattaactgaaaaaaagaatctcacaaaactcacattgtaacaacttgaatcgttatctgggcataaataatttgtatcatgtaatgattagatgagttaagcaaataaaaatctaaattgcagagaaaaattctaaagcaaacattataaagaaacaaaagttgattttgacagataaaaattaaaataagagggtacctaatttgcggtatgaaatgatttcattatgtgtcactaaaataattttacattgccttgctcaatataattaatactgaaaatttcaaaaatccgtcttagttatgttgccattgtactgattatatatggccatattattttgcctagttatctgaatcttgattttaagaccgtatgatcagtaaactattatccacccatagtcaacattttatttaagacaaatgtattgtgtcaatcccttttctcttttgtaagccaagattctattttgtacctaattgtacattttaagacaacatgtttatggtcaggatatgaaggaaaaagagattaacaactgaattttgtggtttttgaaatgttgtttcaacagtttttatttttattttttttttgtctttctactcatccctccttctatttcttgatctccttcttccttcattttttaaaatgtatgctgctctgtaaaagaaattatactaatctcaagtctaaggagaatattaagatataagagatattgtcatcgacctcaacggatttttattttggtagaagagaaaaaaaattataggttgattgctaaatagaggtagagagagctagaggtatttatgaatatgtgtgtgtgtgtgtgtgtttgtgtgtttgtgtgtgtgaaacaacacaagggaaagcaatgtcctgggaaactgtgattttagcaacacatttattattaaaaaagaaatgtaaatgagctttaaatgatcaatagccttagagaaattaatggaaatcaaggtgttgacaaatgaaaccttatgtttgtatgtaccatataacaggaagatttcattctacatggaagaaatgtggtgacatccgtattatgtgtcctgtgactccagccctagctcccctttattctgacaagcattgctagggcacaatctctgctgctaaaatgtagatgtcaatagaaatcaagtatatctttggctgcctctccaaccacaagcccgacactaagttggccccttgatggtttttgacacatgaaagaatataagcaaacttacataaggagcagatgacactggctgggaattaaattggaatgattcctttgtaagattctctagtggtttgagaactaaaagtgagtgaatccttgtgacacaagtttgatgtaaacaagtggccttttccttattccattatgcttaatttactccatagcatcttttgggacagaccaccttctattcccctcaaagaagtacagcagtataataatataccataaatgctacttacccttgaagtgaaatatctgctagttctgagctttgccagaacaatacttcatatcataaatccacccacatggtagatgcagctgttgcttaattatttcatcaggcacaaggttcatggttccttggctaaatctttaaaagcaattgttaaatgtgttcagtagaactcttgtaaaagtttatttatttatttatttattcttttttatttttttgagatggagtctctctttgtcacccaggctggagtgcagtggttcaatctcagctcactgcatcctccacattcaaggttcaagtgattttcccgcctcagcctcctgagtagctgggattacaggtgcctaccactaagcctggctaattttttttgtatttttagtagagacgtggtttcaccatgttggttggccaggctggtctcgaactcctgggctcaagtgatccacctgcctcaccgtcccaaagtgctgccataaacatttatttctattattgacaaaaataatatctaataactaaagactccaaaatattgttaattatatataaatgtactgccaaaagcaatatctcaatattatttacaatatacctattgatactttttatttttcaagaatgaaagaaagccaattgttttgaaataaagcatgtttttcttgtgaatatctatgaaagaatgtcttctacatgtcaaatatattgtctagtatatagttccttttaaaaaatgataccaaagtagaataacataaaaacactatttttagatacgtacagccttccttctgttatttagaattgagaatgctttattcaagctaactgggtttttaacttgctgttgtcaattgtaatagtgttaaataatgatgacttaggattatatggctgaattagatatagggaacactcttactgaggaaaaaataagaggtgacatttcaacattatacaaaccatatttttaaagctcacattttttttaaagggttccggggactataaacactcctactgagtgagcatcgtagaagtccttctgggtattaatcttattcatctagtcttgtccatgtgttatttatatttctatactgctcaaatttattaagatttatttgtctcttctgtatgtcttcaaagtattgttttctgtctactaaatctttcaaagattccaggctcaggcatcatttgtcttttcctaagctctgactattttgagctctatattgtgttcacagtgcaaaggtcctgttgatttccccaagatgaaaacattactgagttatgtgcagagacctgaagacaaaatctggccctgaagttggttgagattattcatggggagaattttccagctcttttttttttcctgcctaaagccattgaatgcctcttaaatcactgacataaaatttaggtcaacacattgcctggggtcatttaaatttcaaatctgctgccattttcttgcttgtaactattgggagagaagaacattgtgcctacagttagtgagctggagctgagaatctggcacaagaaatttcaactcagagtcaaatttatttatgctcagctgcaggaagtatgtcaggaaggttaatgagtctaaattggcattctgtcttctgactcagagctgaattgaaaaccacgtatagtgataagggttagcctctgccagattttgtaccacttgttggagtttaggacttggtaaattttttgtgagtgtggaagaattttgactccatagaaattataagcaaaactcagatttcataatttgctcaaacaatttgttttgttttgttttgagacagggtcttgttctgttgcccaggctggaaggcactggttctatcatagcttactgcagcccttaacttctgggctcaagtgatctgcccaccactgtggctagccctttttttccaactgcagaacaagtaatatgtaccctatggtgatgtggtgagggttaaacatgaaaatacatgtgatggacacagctggttcatagttaagaccttaagaaatcattagagccatcatttttgtaactggtatgaatctttacaattctattcaaaattaggactgttttgtgttttagaaaaaaaaaatatatgagttttagagtaactgcaaaaagaattacaaagcccatctcctcaaatgatcctgacctattattgtgcatctcaattcagaaagcatctcaatacatctaaaagtctattagttgtatttatttctttaaattttattgtttctaaaataactgaaggtagctttagacggaagtgcttacatgtacatcatttcatttatcctcaaaataatattttatatcaggagatattactttcatgttatacctaatgtatatgtatatatatttatttaatctgagctgttcacgctaattcgccatcccaattttttaaaataaaactgtaattgtgttctacatactcttctcctgctgccaaagttaaatgcctaaatattatcttattgtgtattcatcatcttcagctgctttaacaaaatatcatagactgggcgacttaaacaacagccatttattttcctatagttctgagggctggaagtctgagatcagggcgccagcatagttgggttccggtgagggcactcttactggcttgcaagctgctgtgtcttcctatggtgaaaagggagatctgatgtctctttcttcttataaggacaccagcgctaatggatcagagctccattctaatgacctaatttaaccttatcctttccttaaaggctgtatctccaatacagtcacacaggtggttaaggcttcaacatatgaatttggagaggggaagggagtgggcacaattcagctcatagcacataatatggactgaataacacattttaggaggaaaattaacagttaattagcactgttactgtgtactttgaaattgctaactaacaataagcatccaattgatctgtttttaatttcttcagttaaaatctcagtaaattgatcccagggttatataattagttttcccaatatctattttgcccccagttaacttttgttacttacttctacttaagtcgtggtcacagaatatggttgataccttttttaaaaaaataattcattgagacttgatttacagcctagaatctgactagttaccataaatgttccatgcatgctttaaaagagtaggtattcttaatttctggtcagtattgtacatatgccccttcaacgaagctgattaattatgctaagtttttatatcttatacatattttccttacttgatctatcaatttcagaggggggaaataataaaaattatggctttatgataaatatgcttatatttgcctatgattctttgtttttagctgtacatattttaaggctgtattagttgatgtgaatgagtttaaacttgctatatcttatttgttaattgctcctttcataattatgaagtaactctccatctctgttatttttgtttgtttgtttccaagcctatattttctgatattaacatatctatatattacttggttggcctatattttttatccaaatttaccacttgaaacagcccatagtatatttttaatttcaatatggtaatttttcttagaactgttatgttgaagtatacgtacagcattattttcagctttatattgaccttgctttttctctaattatgttcattttatttctatttttattatttatatttcattatttttctttatttttttttccttctgtttcttctcttcagttaacatttaaaaatgcaagataaggccgggcgcggtggctcacgcctgtaatcccagcactttgggaggccgaggcgggcagatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcagagcttgcagtgagccgagatcccgccactgcactccagcctgggcgacagagcgagactccgtctcaaaaaaaaataaataaataaataaataaataaataaataaataaataaataaaaatgcaagatacacttttaaatcaacaacaaaagtacaacttaatcagtatttttatcctactcctgaataatactgaataactaagctctgatcatttcctctaatctcttaataatgttgtagactaatattttgctctattttttttacttccaaattgggcagtgtcatttttgttgttctatgcaatgtttgcttagatttcctgtatttttacctatttattttgtcaccattttatcttatattttagagatttttttatgggataattcatgtgctttctaaagtatatttttagaagtttaatcaatgagaatctgatcatgctaaattctgctttatgatcttcttaagtaagatctttcttaagtaagaaagtcaggaacaaaattctaagtcaatagctattttcagttagcatgtgaaagatgacactgtctggctttcacatttactgttagatggcaatataactgcagttcctttacaggtattagtttcatagaattgccataactagttaccacaaactgggtggcttaaaatgacagaaatgtattctcacagttctgaaggctagaagttcaagatcaaaatgttggcagggccatgatccctctgtaatctctaaaggaagatctattccatgactctgtcctagtttctttttgccagcaatcctttacctttcttggcttgtagatgcatcacttcggtatctgcctctacattcacactgttgtctgccttctgtatatttctgtctcagtgcctcttcttctctctctctctctctcttttttttttttttgagatggagtctcactctgtcacccaggctggagtgcagtggcacgatttcagctcactgcaacctccacctcccgggttcaaacaattctcctgcctcagcctcctgagcagctgggattacatgcacctgccaccatgcccagctaattttttgtattttttgtagggacggggtttcactgtgttagccaggatggtcttgatctcctgaccttgtgatttgcctgcctcggcctcccatcttcttctcttttataagaatactggtgatagtgaatttacggccagctctactccagtatgaccttttcttgatttaactaattatatctgcaaagatcctatttccaaatacagtcacattctgaggaaggacataaattttaagggaacacaatttaacccagtacagtgttgtgcctttttgtaaactatctatttatctttgattttctgtggttctactatgatatatatttttacatgtggatttctttatgttgatctcatttgagattttttttttacctatttcttatcaatttagaagctcttagcctttagctatttgaatagtgtctacctttagtctcttaatgctctcttcttggaacaccaatttaatgtattttagaccttcttacccttaatcttccatgtctcctaagttcttgctatattgtatatctccttaactctgtattttattctggataatttcttcactctgtcttcaagtttactaattctctctttcttcctgtctaatctgctttttaattcattttttataatttttgtgattatactttttatttctagaatttcttttttacatttctttctgatatttctgaccattttttaatatttatagtttttctttatgttttgcctttcttgttttatttttataaacatcataaacattgctattttatagtctgtatcttatgggtctgaagtccttggtatttaattttgctatttgatttttctgactccttcatgtgggatcatatttgattgaatttaatttgtgaaatcacaattgacctggatgttacatgtcttcctaaagagaaaatacatgtttacatgacccaggccaccactgagatatcttcacttgagttattcagattcacacaggtagtaaaaattaaaacaactaaccaatttgactaagttgtcaatttttaagagggctttcacatttaattttataccctgagtcaagacgaagccagccaattcttgtgttggtttccttgatgatcttataagttttcctgtttcacctttacactgaagtgtaaactttcataggcacatgatttgttcaaggatctcagttgtatcttctagctagcagagacccaaggttctgtctttcattcaccatgtgtctattaaaactcaagacctggactggttcttgtactgtaaaaaacctccagagccatcccaaggtcagtccatgtttactactctagttttattcattcttttgtttaataaatgtgtactgacaacttgctaggtgcctggcactaaaaaacagagcagagtctccactctgcctggctcccattctgtttgtggtaatgccaacaaataaaatatgaaaggtggtgacaagtgctaagaagaaaaattaagtgaaaagagaaaataaagaataattatattttatgaagagtagccgggaaaggccaacatgataagatgttctttgatcagagaccagtgaaagtgagggagtacttaggtggatatctggatggaatagacacaagtagaaatcactgagatgggagctgtttgaagagcaatgaggaaattggagataaagtcagaaagatggggagtgtggtagtgaggagtttcagtaaggggaaaatcatgaaggatcttgtgaaccactgtgaagtatttttattttacactaagtgataaaatctgaggaatgatgtgatatgacttacagttctctggaccactgtaattttcatttctcatcttgtgaccccactgtgtttttaaagaatatcttatttattgaatgcatgtgggatattgtatctttcagtaagcataatccatcagaaatataaatccacctgtatttattcaatttatatcactttaatgtatattatcatgatcgagatttgagaatagactttttaacatctgaagtctaatgatttgctttaatatatttttagccataagcagctatttatctcattcctgtgatatgctgcttttttaatgtgaatataatcttgtattgatcacacacaatctcagggaatttttccccctttggatagtgtcacaattggagttcacctacttttaataacctagactgtgctagtgaccatgtagtaccctaagtattgattagaatgcagaggggcatattggagaataccaagagacttttgtctctttctacttagttcaacctgtaatttcatttcttcctttgattaaattatgcaaggctagaatttaaatggcctatcttaaaagtgaactggaagttttttggtttttgtttttttattatactttaagttctggggtacatgtgcagaatgtgcaggtttgttccataaatatacatgtgccatggtggtttgcccccatcatgcacccatcaacctgtcatgtacattaggtatttctcctaatgctatccctcccctagcccccaatcccccaacaggccctggtgtgtgatgttcccctccctgtgtctatgtgagtgaactggaagtttttgacaggtgtttggcataggactggggtttcatcaggatgtataaatcagttatacctacttcttttttaacttcaaattttcatatcgtattaaatttcttatgatatgaaaaaattatcatttcataaacaagaaatttggcagattctattgcttttaattacattgtgtggtgaatcacaagcagtattttgaataaagaataactttacatctcaaaactgctcaacagtgtggtcttaaagacaatttaaaaattaggagttcgaatgtaagttagatttcaactcaatgtactgctaccaatggagggaattaaatcgaggtgacaatttggatgaacccgagacgttctagcatagctaaaatataattagtggggttgaacaatagtaattttgtcaatactgtttcctatacttggagtctggcaagtttattctccaggttgattctaagatacatcttgaatgcataaatattaatatgcgagttaaaaaagaggatatggaggagggaagggatcttagcattaaagaagcaggattttaactactccaaggctggctttatgtttattcaaacttttttgggtatgaagcaaatgttacgtaggtatctaaagatggaactactaatatatttctgctttatgaagagaagactgaatggttttcagtgagggaaaaatttttacaagaaactctcctggttactttatagctgtaatccttcaaacacagttggtacatcagtcttactattagatagcatatgaaatataacactgacccagaaatcataaaagtggttcaaaaggtgactgttttattatgaccactatgtcctaaactatttgggaaatgaccaaaaaatgcttttgagttgatacactagcatacttatactggcacagcaggaatgtgtgtacacaaatatgagtgtactgtatcatgtcttgctgaccttgttgagaaagactgattctgcaaataacaaaaggatataaaattgcaatttttatcaagtcaagacatcatccatcaagggaaaagtttaaacaccattaagtctaaaaaataagattccctttcagggtatttgagacaccgagttgtcaaagttctacatggtatggcctcaagactagagcattagtaagtacttactcaaaagcatttactaagttaaaaccaaaagatgtctagttacttatctacccaaagtgtttccagtcagctgctccactgatttttgtcctccccttcgaattgttttaatataagtatttaaagtttgctaattttgctaatttggatacatttaaaaattttaaagttgtttttcctggggccccatgtaatattcctaaagactttaagattctatagttcttgaacaaaatttccagagaaattcatctccttctgataactgtggaagccaataaactacacttgccttcttcatcttctctgaaatcctcccagtcaagccttgttggactccacccatttcaccagcctgtcatcatttcagggagggtcgtgggcccttatgaaagaaggtgggaccagattgtcatcaagacttgcactgtcagtgctagtaatcctagcattttgagaggccaaaacaggagaatcacttacagccaggagtttgggaccagcctgggcaaaatagtgagacttatttctattaaaacaaaaaaaaaaagaaaagcaaaaagacttgcattgttcagtagagcaatagagtagcaaccagacacatgtgggtcatttgaatttatattcaaattaattaaaattatattaaagtaaaaatgtatgtcttcagttacgctcaccacatttcaagcactcaggagcccatgtggctagtgatcatcatcacagaggaatatttccatcctcacagaaagttctgctggaaagcattggttcaggccaaacaaagaaaccaaacaatccttcatctaaaatttatgagcatgttaagacctcatttaaaccattatatattactcagagtttcaaaaagtcaccaatgcacaaaaaaaaaaaaaaaaatagtatttcaattcatcattttcctcccactgttaacctgagcaaagaatgatcaaaaagtatgtaggagaagcaaaggaagtgaagaaccaatcagcagcattcttttattttgaagacagttgtacctccatttccctgtataacaagttatctgtgaaaataaaagtctgctaaattttgaaatactgatttatttatttgttttctgcttcacattgttgtgttgttttccatggtcacaaataagccagaaaccatttgctgtggagatttatgtgacaacacttattttaaagtaatagcgggtgtctcattaatctcagttgtctattctttttttgcttatctcctggcattgattcaaggctaatgtaattaaatgatcatcctgaaagaaatgagcttcaaagcagttttacactttttattaaaatatgacatgatgaaaactacacaaatcataagtgtacagctcaattaaatatcaccaaatgaacataccagtgtaagtcccacccatttcaagcccctaaagccccctgtatgtgccctcccaataattaccccttccttttttctcagaagtagccactgtcctgacttcttacatttcagatgaagttgtcctatttctgggatggaattatacaatgccttttttaatgtgtgatgtcattggctcaatgttatgcttgtgatataccaatattgttgcatgtgattgtatttctttcatttttattgttgtctagtattccattgtatgcatataccataaaacccactctactattgatggacatgtgacttgctgtattgttatggacacttttgtacctttcttgtattcaataatgcacacactcttgtttgttatacctcttaatgcatttttattttttgcattttaaagtggaagtgacttgagacagaatgcataattcagctgtccctattttacaaatgcaaagtgtgcaaagtttgggatttctattgtcagtgttggtgttgttttaaagaagttataatgtgctttttcaggaatatctggttcagaatggggcaggtctgccacaacagaacagtaagaattctgcacccttaataaatacactcgccagtgtctaaacaagtaacaaagactcataaagcactgtctgtaattctcccagcttctagctatgattagagtcagttgccacaatgtccaaagataatgccagccactaaagcagaacccagggtctcatcccccatttgtgctcagagaggcactaggttttggggacagtttggaaaaatgacctcaaggtttttgtgtatgttaagtgcatctttaacaaatccctggtttgcgcatcagaaggagagggaattgggcaggagcataggtgagatagggacatggaagatcccatattttggtttcatggtcaacctcttggatatgagaggtttttttattatttgcagcatagggtcaagacaaatgttatattcttccttgtgagttgagtaaaggagaaaaaaagagaattaaagatcagtcttttgttctcattgttggcacatttagccacttgataagccattaattagaaaatgaagagctgagtggattcagggagaaagaggtcatgctttcccagcattatctcaaagtttagcttagaaacaatcattaacaaatataaagggcaacacctatgcagctagctccacaagctattcttgacacgctggggctccctacaagcaacaagcaagggaagccattgattgggagggtctgggtaggcttctgaacagaacaagtagattatatgtagattttacctcctatctgagcaaatagaatgcattctgggaatttacatatttctaatgttcaagcatagttgggattgggattttttaaataataaattgaataaaaataaaaattcttagcatacaccaccaccctagatctacttaagtctgaatccctggggatggagcccaggaatccttgtttttgataagtttacaggaaattctaatatgcagtcagcatcggaatgattctaaatagagcctggtggtgtttggattatctttgctctatatgataaagggttattagattgcattgttggattgtttaataggattgaaaaggtggcataacttaagaaaatgggtttgtaatttttatttctgtattttacattaaccagaaaacagtgtgtgccatagttaaatgtcttatttggaggcagctggttcaagctgcaaacacatgatccctggagctcaagaaaaggcagagacgagtgtgtctggtagagtcaagtctgaaacagtggctggatgttccacacaaactaccccaggggcttcagggtgaacatcagttattatcttgggatataatacactgatgtctttggggactactgcagtgcattattaatctgagtggtctcctaattcatctgtatgatttttaggattcattcatttatagatatttataaattttaatgaatatttattgatcacctagtaccatgccaggtattaggctagatatttagaaatacaagaaggaagacaaggtctctgacatttagatgttattcctcccttatttttaactgttgtttcttattcctacaaatgtcctcttgcagctgtccatgtgctgaaaatctatgttgctaagtcagaaacattatttttcattcaattctgagtcagtagtctcgcaaaaggacctgttttacactcagggttcctaagaagtaacctattgcttttttctctctgttttcctctttctttctttctttttctttcttttattggcttttgactgagttattgatggctggagttgctgaatgtttcactcagaaaaatttagattctgtgaagagatgggatcctttgtgagttacttagagccacagaaatattttccacctagattcttgtgatttttcttaataattgctctcctttggagaaatctgaacttttcatttcgctttctaaaactcttaagttacttcctataactttcagcataaagatcaaactccttagcttatctctggagacactggggaactaggtcttgccttatctcctagtactcctttatattccccacatcaccaaaccatttacatagttctgtgatagtgaggcaggagaatagggtctgggggcagggaacttttttttttttttttaatgtttttttttttattatactctaagttttagggtacatgtgcacattgtgcaggttagttacatatgtattcatgtgccatgctgatgcgctgcacccactaacgtgtcatctagcattaggtatatctcccaatgctatccctcccccctcccccgaccccaccacagtccccagagtgtgatataacttaaggccaattaacgggaacttcctaaagctaaaccaaaatgaaaaaccccacctccccacacccaagaaacaaaggatcaaaggctactctacctacaacctcccccttccaccacatctcagatggaaaaggaaagtgccttggagtggccacaggccacacacgggccaccacttcatctgcatatggtgtcaatctgctctagtattgggttagccgcaggccaattcacctcagcctttaattagccacgagccaaatccttcatccggataaaaggtagctgataagaacctcaaaagaatacttaatgtatacatatgtaactaacctgcacaatgtgcacatgtaccctaaaacttaaagtataataaaaaaaaaaaagaatacttaaaccccaaaatctttgtaaaggaggcccttgagccccttgctcgggcccactcccgccctgtggggtgctttcttgctttaataaatccttgctttcgcttctttgttcctgggtttcattcctctgttactttgtgcattttgtccaattattttttcaaaaccccaaggatctggacaattcacactcaaggcctgccttctgataacaatagcagcatgctagtttattccaacatcttgtctcatacaagtcctctgtctagctctcactaactactctcaattttcaaaactcggttctgtttcaagaaaacttccatgatgacttatgaattcagattctctttaattgtgttcctatagtactatggtgctacagtactctgtactttcctttaatttggggactaagtctttctagacggtctagccttcttcagaacaaagcatatgctcagaggaactgggacaaagtagatattgaataaatacaaaaatcagtgggagcaggatccgttctggttttgctgaatcctcattgcttgtaacatggtggcattagacaaatgttggctaaaagaaagatgagtaaaatgagctagttgtgcttttatttcttgttttctgagcacttcttattatgtaaggatctattaaaaacgaggtgcattcatttatacaagtacacacgtactaccagttgactacctgttttaataatattaatgctacaaatcagtgatgacattagttagttgatccatttatggttttgaaccattacccaaaatgttatctagtcataagataacttgtgtcctttttatctgtgctagtcaatctgggagctgttgcaatgaattaattaaatttgagtaaattttaaaatgtatctattcaatttcattagtgacaggctaagttctcaatagctttatgtagatagtggctgccaaaccagaaacacaaatacagaatattaaattttatatagaatattaaatttaaatcaatgatgtagtggcaggttcacaaactggaaatttaccctctttgcttctatttttcagaagtaaaaatttgaggagaaatacagtagtcagaagtaaatattattcaaaacatgactatttctacataaatctacttatagaacccaaaaagtatttgctaaattaaccaagtgaatgttaaagaatatactcattagatgctccttaaaaaaacccctcagatttctctcttatatctctaacattggattttgatgtaactcagaatgtggtagttcccaagtaatggtaaaatatgcataattataggatttatgtcattttaatacacttcacttgagctggtagtttttcataaaatctttttttaatacatataattttgtaggactattttctttaagtaaggctcagaaatactatttataggtaaaacacaaagatagtagatgaggattaattaaatcataacattttgatgcatttattctgaaatgtttaattgatattataacatgttgtgtaccacctttgaaaccaggaagaaagagctttcaaaagtcctttcacttcattcataaaacaaacattgaagatatatgtgcgctatatatataacattttaacaaatagtgcaaatagttcctcaaacttttctattgggttattaaagtttgtcttagataaagaaagcacattttttggataatctgtcctctattgtactggataaatctataggaaatagaaatatacaagccataaaagctcaaaccagataaaatcctgataccatttctattggtttttctaaaacaggatttcaggagcttgaaacttcttgggtcaaacagagtcagctgttagagggtttttccacataagattgccttcaccattgtcaactttgtattagatttcttctcgtacaaaatatagctttgctaaataaagaaatacgaggaaagtggtacaggaaaaaagtggcatttttcttcctctgcccagatcttacagtcggctccaaaacacagcccagacctctctaatttaaaatgcctccttctctggtaacaaatcttccttggagtgtctctttcctcttctgaagtagaagtcctcatagctgatctcgtttcctccatcttctaaccctctctttctcaatgcctggagaagcaaccagtgctagctcatgtttcatgtggctcctagagtttccatgcccatgggtttttttgtttgtttggttggttggttgttttttaaggaataataataactggcacatatcacatatcaagaacttattatatgtaagcatggtacaagtgctttatcaaacagtcctcctaactacccttggaggtagtttgtccagtgtacagatttgaaagtgaggtgtagaaatgagtcacatggttagtatgtgctagagccagaatttgaacacaggcagagattgagctctttactataacagtgccatctttggaaaagcactctcaattcccttcagattcaaccaatgtcttcagagctgtaaaccatgaaaatgattacctacctgttccaaaagggttaaagaatatcattgaaaactctctcttctacctctgcaacttgactcctccaatttctgtccagttattaagtcataaaataaataattcctttcatattttagggacactgttatctgattatccatttacttaccagagaaatggtgaaatcatgaaacatgttattttatttatagtaaatagatcacagggaacagacatttctctgcataagctaaacaaatagccagtaagcacatgaaaatgctgaaaatagttagccatcaagaaaatgcacatcaaaaccacaatgaggccaggcacggtggctcgtgctaatcccagcactttgggaggccaaggcggaggttgcagtgagccaagattgtgccactactccagcctctgcaagggagtgaggctctgtctcaaaacaaaacaaaacaaaacaaaacaaaacaccacaatgagatacagcttcatatctgaatagctataattaaaaataaaaaaacaagtgatgacagtgttactaagcaatcaatgggctcattgcccaatgcacatagaggtcatagtgctggcttttgagaaaagaaaagctttattgcaaatccactggcagggagatagaaggaagccctcaaatctgtcttcctgccctggggtttgggtagggttttataagcatagggtaatgagatgtgatctgattggatcttgcaatgagctgatgttgagggcatgatctgactggatcctaccatcatagggtggtgccacggcttgatctgattggaacctggaccctgccatgcagtgttcacttcttaattcagtccccaaccctcagtctgaaaacttaggttccccccaccaccctccagcctgtggttgcacacttgcttcatctgggcatgctcaacctgggagtccatggcaactgaaaaactcacaactttgttacaaaaaaacagaatcagattggtctattgcagttacaagaggatgtagagaaactggaaccctcatttgtttttcgggggaatgtaaaatagtttggtcgttttggaaaacagtctaatggttcctctgaagttaacataaagttcctatatgatgtagcaattctactcctaggtatatacccaagagaaatgaaaacatatgtgcacacaaatgttcacaccggcactattcataatagcctgaatgaaaacaacacaaatatccatcaactggtgaatgaataaataaaatgtggtatattcatacaaaagaatactaattgacaataatgctacaacatggataaattttttttaaaaattatgttaagtaaaagaagctgaagaccatacgttgtatgattcactttttaggaaatatccagaatatctatagtgaggaaaagtagaacagtggttgcctaaggctgagagtaaaagagtaggaagtggatccagtgtttctttctggggtgatgaatatgttctaaatgtaggtgtggtggtggctgcacaactctatgactatcgtaacaaccattacattggatgctttaaataggtggatcttatggtgtgtaatttatatgttgataaaaatgttaaaaaaagacaccatgggaaaaataggtcacaggattgtttaaattagatattgactagaattactttatatatatatataaaatttggccaggcgcagtggctcagtcctgtaatcccagcactttgggaggccggggcaacagatagtttgagctaaggagttcgagaccacccaggtcatggcaaaaccctgtctccaccaaaaatacaaaaacttagctgggcatggtggtgcatgcctgtggccccagctactcaagagactgaggtgggaggatcgcttgagcctgggaggcttaggatgcagtgagccaagatcacgccattgcattccagcctgggtgacagagagagatcttgtctcgattaaaaaatatatatttagttttatggatttcttataaattattgttattccatataagtatgtcttcattctaagttttggttttcattgcctctataatcctaaaacccaagtctagtacttggttcttgggagaaaaaacaacaagaaaaaacataagggcaaaagattgatttcataaatttttcactgttgcccaaaaatcacatgttctagacctgtaatgaccttcatcacttagtgaaaatgatgcctaatatttctccacattcagccctcagtgtggatactgttcgaccttattacttgtctctttcataaaactgaatgatataatggggacagtaagggcttggaagtcagacaaacttggattcaatggtgcttccacctcttatgagctgttgtgacttagggcaaattagtcaacttcctccaattttagtgaagttaaagatgctgcgtgtcaaatgcctggcatttcgtaggttctcaatacatgctgtttgtatgttatttatgacccaaccttccaaaagaggacatagaactcataagtggcatgtgttggttctggaacacttgcaagagccttgctactaactccctccctcaaaaataaataactccactccccctaatcttgtggctgatgtctgaaattgcactattatagtctctttccatcaactcaaagtatttgctcactgtgtaaattaaaatgcctattggaattaaaaaacattttaaataattatatttcatgtctatatcaatatgttatatttcattttttattaaaataaaagactagacaaaaaagcttccataatgtggtggggaagacacagaagactttctgaacagctggaaatgaactggagacagctcctcctgcttggggtgaccagccatgatcatatatgtggagtaagtctgtggttttgtggggaaaacaaaacaacaacaaaacaaaaaaagtaactattcctccctcattctttcctgcctcctctcttctttgaagagaccactcttcagccctggtcatttgtgagcctttgccacagtgctggccctgaaaggagatcagtttcacaatcctgcttggctggcatgggctgagtcactgaccagcccatcaatccccttccttctatgtaatcctgggtaaatgaaagaatgggcaagagatgcagataagcctcttttttcctctacccggaataatccagcttgaattcctcaggacgagtagttttgggccattttattttactttattctttaacttttaggttcaggggtccatgtgtaggtttgttatacaggtaaactgcgtgtcgcggggctttggtgtacaattaattttatcacccaggtaataagcatagtacccaaaaggcatttttttctgatcctctccctcttcacccccatcaagtaggccccagtgcctgttgttcctctcttagtatgcatgtgttctcgttcggctcccccttataagtgagaacatgcaggatatggttttctgttcctgtgttagattgcataggataatggagctttggccattttaaaccaaggttatcactggccaaagctcaactagcttgcttgtgtcagtacaggcactaactaggggaaaagtttctaaaaacatgtttatctgaaaatgatgacaatgaaatccccaccaatcaaagatcctataagccatcttccttccaattcacaaaacattctagttaagcacatttgtttcccccataggcaaacaaagccccaattaggactggaatgcaagtagtctgaacacatgtgaaaagggaagattcttaagttcccaatttttctttacaaccttttttgtttgtttgtttgtttgttttttctttttagaggaaggctagagtgcagtggtgcaatcttggctcactgcaacctctgtctccctggttcaaggtattctcctgcctcagcctcccaagtagctgtgattacaggtgcccgccatcaggcccggctaattttttgtatttttagtagagatggggtttcaccatattggccaggcaggtctcaaactcctgatcccaagtaatttgcccacctcagcctcccaagtgctgggattacaggcatatattacacccagccatctttacagcctcttgatggtttgatgtcaccacttgaaaggccttgatttgaatttaaattgttgtttgctagaaatgttttgagttcactcatttaaggccaatgaaaactttcaagaaaaaaaaagttaatttgcttaatttacaaatgttgatttggttaatttgtactcttaattatgattaggttcaaagacaaggttaaaagcacaaattgcagtatagagttttgctaccatttccaatacatttactgaaaatgaagtaacagaacaaacactgggctgatcctttgaactattcttgttatactggtcctttctttttgacactttagaatacttagatgaggtttgaaaaattgttagcagcagaattctgttgagggtttattcacactgaatcataagcatgctgatttgacagcttcaaaatttcttctagaaatcttgtttctagtctagataagctctgtgtgatgttaggcaatatttctgggttatagggaaagacatttacaaaagaaaatggagtacccagatgttagcattcctatctggatagtatatcctaccagaaaaataatgagatttgtgggattagagaacaatttaggttttatgagataattttttgacgaatggtggtggcattcattccagagagtcacagcttggctgaaacaatttttggtgtgccatgtttctggtgatcatatataataaatataaatgtttctaccaattcaatacaacttcttctccatatctaaggaaaaaagggttacacatatggacaaaatacattcaggtgtcttccccaaacaacaataatttcaattatgctgtcttaggtttcccagtagatccaatgttcactcaattatctgtgaaggaacaagatttttgtttgtctgcttgcttgtccaatgtggcatctaatacatgggctatctcctattttcctcagattgggtaaggatttttgccaattcttgattttctctgctagtggaagggaagccatgtaggtaaattaaaaatcccttctatttgtcataatattaattttatggtgcttttatttgttgttgtcattgttttcactttcttgtaggattaaagcagtgcttttcaaacatttatttgcatgtggatccttggggatcttattaatatgcaggctttgattcagcaggtctgggtgggcacctagattctgcatttctaacaggctcccaggtgatgctggtgctgctggtctaaggagcacactttaattagcaagagattagggtatattctgttctcctcagtatataacatcacaaggaaggggaaggaggaggactggaatggtggcaggctggtgtctctcctgcgtaatcccgtggaggttaaagggagacaactatggcagcaccaaacctcagataacatttcctcaaggatttttcttcctctgcctgaaaaatttctgtgaggaaattaaagcattgacctgctttgtctaaaattgccagtaacaatccttttttttttttttttttttagtgaaacaaggatttggatgcttacaaagtatcagggtaaattctagattttaaagatttttaaagtattttaaaaaattaccttgcccccacagtatttaacaatgttgtatttttagctccttttataaaatcttgtagaaacagtcaacatagttttcacagaaataactttttcacactcatgctaatatcagtcaatcaatctatataaaacaaaaaatagtacaattggtataaactggtttaccatctgatatggtttggctctgtgtccccactcaaatctcatcttgtagctcccataattcccatgtgttgtgggaggtacctggtgggagatgactgaatcatgggggtggtctttcccatgctgttttcatgatagtgagtgggtttcatgagatctgatggctttaaaacagtggtatccctgcacaagctctctctgcctactgccatccatataagacatgacttgctcctccttgcattccgccatgcttgtgaggcttcctcagccacgtggaactgtgagttctccattaaacctctttcctttgtaagtttctgagtctggggtatgtatttatcagcagcatgaaaacagactaatacaccatcaaacacagttgacataataaatctatctactatctatctatctatctatctatctatctatatttcaaagcattcaagatagttttcagagaaataactttttatttttacaatcatatttcatacatacacacattatctatacctatgtttgtgcctatatgcatattcatatattataataatagataaaaccagcatagatttgtttgggaacaaacatgatttacatgataaatataacatgggcataatgaagagtaactcattcatgacaatcatcaagtttggtgggtgcatagaagaaccattatgctttgcaaagggttggagaatatggattaatcccatacaatgtgtaagtggtgctcaggtaagataactactcttaacaaacaaacaagaaagacaacaagattatgagagagaattgggagaccatttaaatttacgtttgctttgtctgtggtttcccaggtgttcaggaaaaggcctctgagtaagtgctatactatgtaagccaagacctgagtaaagagaatcaactagccattcaaaggcctggggaaagagtgggtgatgagcaagagaaactccaagtacagagatgaaaatgagtctggcaaattcaattaaataaaactaggcccaaaatatttgtagaagtgagtaaggggccaacggtagtgtgcgacattggtatacttaaggcttgtattagttcattcttgcatttctataaagaaatacctgagatggggtaatttataaagaaaagaggtttaattggctcatgtttctgcaggctgtacaggaagcatgatgctggcattgacttggcttctggggagacctcagggaacttagaatcatgacaaagggaaaggggcagcaggcacaggaccagagcaggagcaagagagcagagggggaggtgctgcacacttttaaattaccagattacatgagaactcactcactaataagaggacagtaccatgggggatggtgataaactattcatgagaaatccaccctcatgatccaatcacctcccacaaggcccctcctccaacaccggggattatatttcaatatgagatttgggtggggacacatccaaactatatcagggctatataggacacataaggattttgaattttattctaagagcaatgtaagccatgagaggttttaacagggaaataacatgatctggttaagggcttttgttttgttttgtttaaattactgtgcctgttatatgaaagtttatatagtgggtcattttctataatctacataagtagattcctaaattggtacaggctgcttcatattcattccaggcaacaaagtgagatagtagagaatcagagagtcagaggttggcaggtacatcaataacagataaagaaattaaagaattttgggccgggcgctgtggctcacacctgtaatcccagcactttgggaggccgaggagggtggataaggaggtccagagatcgaggccatcctggccaatatggtgaaaccccgtctctactaaaaatacaaaaattagctgggtgtggtggcgagcacctgtactcccagctactcaggaggctgaggcaggagaatcgcttgaacccgggaggcagaggttgcagtgagccaagattgcaccactacaccccccagcctggcgacagagtgagactctgtctcaaaaaaaaaaaaaaaaaaaaaaaaagaattacgttccattatgtatactatccatatcttcattctagagctgttaacatttaatatctacatatatgaataatatatatcatattttataaatatatgttttcattgaaaaagaagatattgctattttggattaatatttattgaaaatgcaaacatttgtgggctaaatatactgattggcttagtttcctaggacattcctttgctcagtatagctcatcaaaatccacaaaaaaaaaatgcatcaagatttttgtttttgtttgctttgggttttccttttgttgctggttgattttgcagaaatacatgtgccgaaccagttgctaaacaggtttttctttttatctttttttttttttttttgagataaggtcttgctctgtcacccaggctggagtgcagtggcgagatcccggctcactgcagcctccacctcctgggctgaagtgatcctcccacttcaacgtcctaagtagctgggactacagagccatgccaccatggccaactaatgaactaatttttgtatactttatagagacagggtttcaccatgctgctcaggctggtctcaaactcctggacacaagcgatcctccagccttgggctcccaaacagctgggattgcaggcgtgagataccttgtctggccttgagcaagtttttctatgctacatttgtcaaactagacactaatattgatccaatctaataattatgtttttatactgagtaaaagcaggagttgtaagctcgaaggctaggaggaggttaggcttgtggccaaattggagaatataagctgcttctacaggcatttaagttcaaaattttcaagaaaattgactggtcaaataaaacatatctgtaggctcaattggtccacagatcaccaatttgaggtttcttgtccaaagatatttaaaacttttagggaacaaaacttgaataacattgacaataattctacaagtttcaatagtgtaatttctctgatgcttaaaatagatgaggatcttttcctctgatgattgataagcataaaaagatgaaatcattttggatataggcttagccaaagataggaaatatattgtattaatagttgatggttgtatttactctcccatacaaggtttgtgtctggcaatgtttttagtcctgatttatgtcactatattgattaacatgagaacaagagtgatatttccgatatggagtatgatttaataaatgttaaggcaccaagcaagccctatattggcctttttaaaaaaaaaaaatcacattatgaattcaactataccatttctctgtcacccaggctggagtgcagtggcgcgatctcggctcactgcaagttccgcctcctgggttcatgccattctcctgcctcagcctcccaagtagctgggactacaggtgcccaccaccacgcccctggctaatttttttgtatttttagtagagacggattttcaccattagccaggatggtctgaatctcctgaccatgtgatctgcccacctctccatcccaaagtgctgggattacaggcatgagccaccacgccccgcccaactataccattttccaatgttggcactcattttaaatgttattaaggtgagtctgtaggattcacttaaagaatgtgtacatcgccatactcagctaatttttacattttttgtagagacaggatctccctgtgttgcccaggctggtcttaaagtcctgaactcaagtgatccttctgcctcaacctcccaaactgctggcatgagccactgcatctgcacgtcagatatatttttttaaatgaccaacctttgtaatacatatgagattcatttcaaatgtctgcagatattatacatactcaatcatataaaattaattatgattgagaatgttgtgtattttttgtaattagctacgtactttttatttttttatttttaaaaccctatgattaaagggtagttacctagtttgggaatctaaaccaactcttggttataaagggttgttattaaatgccaggtgtggtggctcacacctctaatcccagcactttgggagggccaaggcgggtggatcatttgaggtcaggagttcaaaaccagcctggccaacatggtgaaaccccgtctctactaaaactacaaaaatcagccaggtatggtagcacacgcctgtaatcacagctacttgagaggatgaggcagggaaatcacttaaacccaggaggcagaggttgcagtgagctgagattgtgccactgtactccagcctgggcagcaaagtgagacaccacctcaaaaaaaaaaaaaaaaaaagctgttatttggtaaatatttgggtgctttttaatagtatttaataagcaccaggtttgttatttttaatgatgttaccccaagtgtcacttatttttaaattcattttattttgagacagagtctcatctgttgcccaggctggagtgtagtggcacaatctcgactcacttcaatctccacctcccaggttcaagtgcttctcgtgcctcagactcccaagtagctgggattactggggcctgccaacatgcctggctaatttttgtatttttagtagagatggggtttcaccacattggccaggctggtctcaaactcctgacctcaagtgatctgcccacctcagcctcccaaagtgctgggattacaggtataagccaccatgcccgactcccaagtgtcacttttgacacaattcatgccctcaaatgacatgttatatattgttgtagaataatatcaagaacaaacatgatagttaatattttatgagaaaggtaattggtaatatgaatatttgtgaaggtgaattttcaaccaaaggagtaaacttttgtttcagggtgcataaaaacaaacgaaaatatttaaagatctgattcagttaacatttgaaataaatatatataagcacattatatagtatgccaatatcatgtaatatccctattaacatttaatattaaaatttatatttatggatacttacaatatattaatgatgtccgtaatatgaattagttcttaaccagagcattcttgataagagactgatgaaaaaagtaagcttcaaccaggaaagtccgtctagagattagctaatataaagcagtgagagactgacattcttttgtgagaagactctcagatgtaactgataattcagtttctctgccacagtaggttgttgcacataattatccttagacctcatcagacctaagagaaaggcctgacacaccataggaaattatgttctgtgtgcttagctaatgtcccatcacagcatggaaaaacaagaagctctgcaagccgtgattacgttaacggttttctttcttaaatgtttttctaccattaaaattctgaaaagtgtagttgaaaagccaaacataatcttacttagataagcctacttttgactgggattcacattggcttatatcttatcaaatactcccaaatcctaggaagtcagcagatattaaaacatatttttggtattaatcatcagtaatattagggcaaggactaatgggcaggcactgattaaagttgatcatttcataatcccaaaaaacatgtactgcccaagaggataagccttaaagaagcattagcaaatcactgtttcaccctgtcatcttcaactattatgatgaatgaattggtgattttattttagtctacacatcctagggaaaattcaggatgtgaggggttataaacgatgattgtgtagaaaaacacataaaagattctgattgtggcaatattgcttgctttattctttactatcaaatgaaataaggctctatgctttctacatcaatattggaatgttcaatgattcagaagtgaggagaatctatttccttagctttcacagagtagaggtgattgtttttaataacctgtttctaattgttttttgaaatggaaatagttgttatagctcatttgttctgtgttgcatctaaacccttatgaaggcagcatatgtgctcttaatgggattttttccccctaataactctaataaaatattttgtcctgttcccatctgtgaatatgggaatgagataggctgtccctgtgttcagtttgtggaagtggacgtaaaaagtgcactgcaatataactaatgttgtcagtaatgaagatagctacgaggtgctattgaaatacagaggaattctctctggggaacataagcttaatatctgactaccgccaagatgttgcttataccaaccacaaaatggcccatctttatagttatttcaactgtcaaactatatagataatggctctaagtgagttccatccattcctgcaatttcattagttctgcctttttcattaaaaacaaaaggtaatcaggccccatgtatatccagaatggaagacttttgtataatgtattcattaaaaataaacatatcagatactaatgtcagccttaattgtatctttattttctgcatgaaacaatgcagagatttgactaaagactaacatttaataattttcagttacagcccttcagtgaaagctttgagataaagcaactagaatctcaaaatgatcgagccaactctgtgaattagtattaagcataactatcacatatgtaaacgcgagttatcctctccaatataggggaggcatataggaaacatgggaaagtagcagtatgaacaagagtaaaacaggtagtagaaaacaacagcatagggatgaaaaccttgcaaacaaagaattactaatttaaagtgtaaaaattttgcaaagggaagataactcaatttctacattttcagctctttgtattaaacattttttcatctgtaactagatattggtttttcttctccatagtaagatcacctgatatttgataatttatgcttttattactacttgttttatgataccaacatttatgttcacatcctcaaggctttattttcaagaaaaaataaagtcgtagtagcacaatgtgataagctccatcttccaaccaatttttaattgtctcattggtatgtatattaggactaaatggctgtattccatgcaaaaagtaaaatgagcagtaagtcaagtgagtattcaggctatataaaaacttctacctacctgggccttgattattcctggtaagatgattaatgatagaaaagtagattatgaaataagaaaactaaaaggcatgttaaatgctctttaaaggtttttaactcctgtctggtggagcaaatggacaccatctgtataagaaagccagataccaagaaactgagagttttacttagtgaaaccttccactacttatgaaaagtcaaatatcatgtataactcatccagatcaactagtccctagacactgatttttgggaaggatgtaagagaattactgactcagatttagggtttaaagactattgagaaataggaaggtattgagagattattgggtttcatcagagcagacttaagtagcctggttgattttagatttgtcacagcaaaatcatgcttggatgctcgaggcctggcagaaccttgctggtctctgtagggtgggataagtgaagcaacattaaaccaggtgcagtccttaatttctcaggtaacataactttagaaaaaacaattctaatacaagttaactcctgtctggttgagcaaatggacaccatctgtatacaaacgtcagataccaagaaactcagatctttacttagtgaaaccttccactacttatgaaaagtcaaataccatttataactcatctagatcaaccagtccctagacactgatttttgggaaggatttttagagaattactgactcagatttagggcttaaagactattgagaaataggaaggtattgagagactgggtttcatcagagcggacttaagtaacctggttgatcttagaattgtcacagcaaaatcatcatgctcagatgcttggggcctggcagaaccttgctggtctctgaaggatgggataaatgaagcaacagtaaatcaggtgcactccttgatttttcaggtaacataactttagaaaaaaacaattctaatacaagtgtaaccttatcctgttaactctgtttcaaaaataattctaaaacactaagacaatgcttatcctattgcctccaaaataggattttgtattttaaatggtttaccaaaaaatgtatcttatacttttgggtaaacttttattttgttatacaaccaaaaatcttaaaactatcttagtacattaacgttttaacaggtcaacttttagtctttatgagcagttttcacgaagttttactcgacatttaaaaaatgtagttaacatactgtagatgcttcaatattgctgcttattctttgtaatcttatttggcataatataatcatgttcagagttattttaaagtaacttaaagtgaacagacgcactccctcctccccccaccctcaattaaaaaaaaaaggaaaacagaaagaaagaaaaagaacaaaaaataagattaggttctaggaggagggaaaccctaatccaagtgtggggatacagaagtcagctttttgcacccattctccatgctacagaataaaatttgagactacagccaaatattttctaaaacctttcaagacgctccagtggatttctggatttgttcctttaaaatcaggatactctgcctttgctcagggggcagcatggcaatctgatctgcagtcagttgaagaacctgcatgatcaaagctgccttctcctgatcctgtggagtgacctggctctgcccaggactaaaactgctaggctggcttccaccttgcttgcttgccccctgtatacctcctccttgtatacctcctccttgtatactgactccttgtatgcctgccccctgcatccctcctccttgtatgcctgctccctgcatgcctgttccttgtatgcctgtaccctgcataccagctccaggattccccacccctgaaatgcctgggacctgtctgggtccctgaggagggccacctgcccctatattaatgggaccaggaccctgaattccaccagtcatagggcctcttgaactggggacagggcccctcatctccaatcctcttgcatccatgccccttgcttccatccctctggtttccatcgcacaggtctccattcctctcctctccattacacgtgtctctaagacctcagtttccatggcacgagtctccatcgctcgagaatctctaccacctctaccatccataggtagacccctttgatctatcatggggcctctgggctctccaattagcagtctgggatctcctaatggccctcccctcatctcatgtgaggaagggccacgagtgtcatgaccagaggcatgatgcatggggggaccctgatggggtggacccagataacctctgggctccacttctccagtgactgaaagcaaagtccctccacgtgggtcatttggagcatctcctaacagtcctcgaggaggcagaccaccaggagtcacgggtccgcgaggtataggagctctaggatctgacatctgcacttgtccccgctctaaaggcactgggccaacccctggcattccaagttggggctgcattgctcctccaggagttaaggaaccaggaccagctccgggaactgcagctggtattggccctggagctggaattccaccctggataggagtctgcatcagaggaggaatgtccttcacaggtcttctagccaaatgctgaggctgaggagctggaggattctgctggttcagcagaacattaggtcctgggcagagcccagggccagggccagggccagggccagagacagacacagactgagatttgcctgggatcagtggtgtgacatgtatcttccgatgcagaattttcagagcaatctctggatccatgattctcatcactacttgtgcctgcaacagtgcataagccagttgtggattttgaagtaacatgtttcgagcttcctggtggctgttttggacacagagcttcatctgcttcatcagctcaaacatctgctccggggggagactggctactgctctggtaatcgattcaggggcatcttctggatcgatgggatccccatagggtgagtcaataatgggcgctgcaggcccaaggctctttaactcctccttattcttttcactggcagcattgtccacccgaagcgctctcccactgaactcccgcccattgaggttccgcatggcactaagcgcggtctcctggtcttggtattcgcagaagccatagcccttgggttttcccgtctctctatcgtataccagccggaaactgacaacagaaccaacctccgagaaaatgtcctttaactgctcctcagttgcctcatatggaatgttccccacgaacacggaacgcagtgatcgatccattgccgggtctctcaccgccaaactcgacatgattccggttgtgcagacagccgatagcggattcttcgaggcgtctgtcctcttgcgaccgacacttccgctgagcaacggaagcggctttcaagatccgggcagaaactttactaattcgcttgaatcgttccgcttgcctgtggaacctgcatcccactaacaacttatctaatgctttcagtccctgatccttcatggttctgtcagcttcttattacagagtcgcatgattcctttcccatttcacgttccgctgactttctgtggggccccaacagccccactacgacacgcttggtacgagatgaccacagtaaagatggccgcatagacttcaccgtagtaactgggaggggactcttcccttgacgtcaaaggcggttttgcttccgttccgctggcgggaaaccgccaaccgaaagcggatttaaggcggcgtgtttttcgttctgacaaagtattttcatgtggccttttattatagtatagttaagctagatttaaaatcacattccagactgagggaaaagcgtagtcgtttcagcacatttgagatttgccccttaaactaaaacagtattatatctcctttttagaacaacgtttttggaaattaactgacaagaaatataaactgaagcgtgtgccggctgggccctgcccccattctgttgcttcctataaccgctgttaatggatgggtggcagacccttctaggtttttcctgagcacacgggcagccgtcgtgctattcctaatattacggttttcttccttaataacaaccgatttcaatattaattggtgattaaataaattagtgattaattagttattagtattttatggcttcagagtatggaataaagaaatttacttaactatccctacgttgattggttctgatttttattatatcatgcagtgagtccaccacttccatgaagggagaaacaaatagcgggtgtttgtcttctgctgttagctttgcaggtaggagttaaaacatattcagtgtggtgtttccccgcctgcaattcgaagctagaactgaagcttggagagggctaggtaaattcccaaggacaagcagctggaaagaggccaagtcaggattctaacccagcttggtctcgcatagctccaattctacactgccttacgtgtattgaatatatgaaatgaagctagtgtgattgaagaaatgaattttaaatctcattttttatttaaatataaaaactaatgttcagtaagctattggaaaacttttttagtatttagaacaacttggatatagaatctacttttgcaataataaattgtgttctaaataaaaatcattttgaagaacactaagacaaaaaataaaaacaaataaaaagaaagtatttccagtcaaaatttaacatactggttgaggtgtgccatacatgtaacatacatgaaagattttaatgatcaaatacaaaaaaagtaaaaatagcccatcaattttatattttttataagtcgaaatgtaatatttttatatatttgagtaaaaaattattttgaagttaatgttattcatttcattttacttttttaaatgtggctattagaaaatttaaaattatatggatagattgcattatacttctgtggactggactgctccaagcctgtgctttaattccaaaacagagaattattttattctgaaatatgcctcttaagtggattatgaaacttttaaatttcagcaaaaaaattgtattatgtatcttcagtatcctattccaatgaatagatttgacatgagtatgatggtttagctgcaaataagacatccatttaccttcaagtttttgaaacagttctgcacttagctgttcacccaagatgcgcgacagtttatatttgcaagtgacaaggttcatttacatcacctaataagattttcctgctatgtcaaagaaacggaatagtcacctgctagcaatgtttccccagtgtgattcttttattggggacgaaaggggaggggttaaggatagtatcatttaaaaaaactaaagacaaatctatttttcttccttctataccatcactttacaaagagaaggcataccttttttatacacattctgtcaagggtaacttacaagttgaatatgtgtgtaattgtgtgtgtattaaatgtagtaatcatgaagatggtaatggggtattataatatgttgcaaaattcgtagaagattgcacatcttgacagagtttctttactgctgatactgtctaaaccagtggtcttcacatgtagcagaaccaccttgagccatggcttgttaagtcagattctgctttatcaggtctggagaatttgcatttctaataagctctcaggtgatgctgatgctgctggtttggagatctttaagaatcattggtcctagggattggtagtagattttctcatttacatcagaccaaactaaatttggtacactctattaaaaggtttgaggtaaaggtttttaaaacattatgaatttactattaatatactattctagtacatgctgatctgctactgaagataccctggacatgaagactgggtgaacagagagtagctgaaggactatgggacaaacaagaagggggaagttatgactgtagagtgtgctttagtcacaggctttccatgttctctttagtcccactgttccaaactagaagaatggtttgtcatgcccccgttcatacaggaccagtgtgacccaccatgtaattccatgcccagaacacatgaactaatacttattgttaactcaatgtccccaaatcaagagctcagataaacctatgtatatttcctggtaccagtacatatttttttatagatctaacttggaagaacatccatttttatactgcttttttattcccataaagtttaaattttagatatttatagcatggcatacactctgaagaaaagtgtacatggtatagtgtatgtccagacgttgattctttcaacagattgataccagatatattaagactgatttcaaacacacaagagcatctatggccaaatggaaactgtcctttaatcactttcagaaactacaaacttaatccattgttcaaaatgaatttttttttttttgacacaggatttcactcctgtcagccaggctggagtgcgatggcgtgatcttggttcactgcaacctctgcctcctgagctcaagcaattctcctgccttagcctcccgagtaaagactacaggcgtgtgccactactcatggctaattttttgtgcgttttgtagagacggggtttcaccgtgttggccaggctggtcttgaactcctgagctcaagcgatctgcttgcctcagtctcccaaagagttggcattacaggcatgagccattgcacctggcctcagactgatttttgaacttctaccctgaaattgctttgggccttcatttataagtcatactagaaaatcggtacattaactgaaaagtatactttatttttaacaaagaacaggattatgcaacaaaatcacccaacttcctgaccagatttggcaaaaatatcatgcttagctaattccaaatatcaaaccttacatcagaatacaaaaattctatacactttgaaggaattttttaaaaaaagattcactatagagtgtaaggaaaaaagaaaagattcactattgattcagtagacaaattccaaagacaagaactacaaatattttgagtaatgacagtcatttttgaaataagtgtacgggtccttcaaggaatagctcaaataaactactccacaaagctttctatgacctttctaccctttcccctaggttagaagtaattttgtttttctttggatataaaccttgatataccttgtacctttctgattatagtaactcctttacctttcagcaaaattgtgattttccttctaaactgtaaaatcattatatatccccctttatcagttaactaagtgcctcaaatttattatttcattccatcaatatttatttcaagcactgacaatacagcagtgaaaacaatagtctgccagaaaagaaggtctgtaaatgtggtccttggttcagtggcatcagcatcaccaggaaacatcttagaaattaaaagtttggggccctactccaaatctattgcatcagaaacagagaaatctttgaacaagttttccaggtaattctaatgcaagctcaattttgagaaccactacattataagattgcaatcatagttgccaggcacagtgactcacgcctgtaatcctggcactttggaaggcggaggtgggtggatcatttggtcaggagttcaagaccagcccggccaacatggtgaaatggtgaaaccccgtgtctactaaaaatacaaaaattaaccaggtgtggtggtgcatgcttctaatctcagctatttggaggccaaggtttgaggattgcttgaacccgggatgtggatgttgcagtgagctgagatcgcaccactgcactccagcctgggcaacagagtgaaactgtctcaaaaaaaaaaaaaaaaattaaataaataaataaataaaattaaattaaataaaaagaatgcaattatagtatagtagctgatagatgatagatagacagacagacagacagatagatagatagatagatagatattttgttttcacctctgtatcctcagcacctgggatagagctcagcacaggtggatgttcattatatatttgttgaatgaatgacaggaaatgactttaaagtttgctaattcacaaatatttcattttaccaaggacggagcctgtggcattgaataacgtgcctcaaatcaaagacaagacatgctgccaggacccttgtcattttattcctaggtcagtgatagttcttccatgttgccatttgatgaaatggatatgcaataaagtatgtagagatggaagagagtgatatgttttagattatcaaggaaagctttctgatggaaatgagatttagggaagggttataatctggcatagataggtagaagatgaagaaaataaaccagaagctagtaatagccaacgcaagaaattgggacctggtgttttttacggcctcagaggaaaccaagagagttggtgaggagtgtgacaaaagatgggcttctgggacagattataaaaggttttgaagttcagattcatgaatgtgaacttgatgtgagagtcagtaggcttccttcaccaccccctgaaacatgaacatagaataataatggcagaggcttaagaataccaaacttatctaatccttttctatatattttctacctaggctgttcttttttaataccttataacttttaatctaaattgtggtggttgttcttcctacatataacacactctgttacgtagcttcattctcattacttctctccatcccttcacatattctcctctggctaaattgtaccactcactttttatcatacatgatctgtattttttcacctcctagctttttgtgatactatttgtcagggatgcttccttttttcctcttcttctcttccctcccccatgtttaaatctttctgttcttcaatgctcacctcaaagacttccatttagagtactggtttggtactcattatcttctatattagaggtatcaatattcttgtattaccataaaatccatatctgattgatattctccacaatgcctggtccagtgccttttatattccaagcacttagtaaatatttttaaattaatacaagatcatcttacaataacaaaatatagatgttaaccaaatgataatttagtgccttttgcttacaaaatacttttctctgggttcccacatttagtcttgataacagtcttatgaagtacatgcaattgtttcctgatttttaacaatgaagaaactcagagagttattatgtagaactttacctaacaatggactcactcaaaatacagatgctttataaaggcaaactctgagcacttagtagggagaaggctctttgataaatgctttatataatataatattttattctttctgcaaccttttgaagataggcagtcatagttcctcaatttataggtaaagaacagaggcacagagaagttaactagtgtgcctatgtcaactagcagaacgaggatttgaacacaaaccatttggcttaagaaatcaagctcataaatcattgttctattaaatgagttgcctaaggatacatagctactaagtggcataacgacaacctgaaagcaggtctcctgaatttgaactttctatttcataagtagtacagtaatcacaagttattgacgcctgggcaccatctcccttggcatttttcctgtttgtctctgagtgtaactaattgcagttgtgacatcacaatcagtgctgtggtaacagatggactgtgaggtataaagactgaagcaatagagaaaatgtttcctttttcaatttgcaggactatagttaaacttcacctaaagacttttataaagcatccagttagttaaagcatgcatttttccataaaatgaaagagctcaaattaatttggtatataactttttttcccaaaatgcttagtgtatttaatatgaaacaatgtacagaggaataaaaagcaaatttcatgtactcaaactcctaacctcaaatgctccacctgcgctggccttccaaagtgctgggagtgagccacaatgcctggccctgaatttcatttacttatacacaggatgaatcactgttattggcaagtgcagattacatgaatttggggctgctgggagtctgccatttctggacttgaggttgaacagaaccaaatgttctccctggaagggattgcgaagtccagcccaatttttttttttttaatagataaagaaaagaaaatgacgcccaggaaaggaaagaaattagaccaggctcaaatgtccagttactgatctagcttgtaaaaggatttagatattcagatttttctcatccaaactatactctcagcacttagaaaaggcagtagagtgaaggaattaagagcacagagattttaatgtcagaatgacttagattggctacctagttcaacacgtaattttgtggcattgtacaaattacttcgcctctctgtggttccatttccacatcttttaaatgagagtaatgtcacctgtattggattattgtgtggaatacatgatatacttatatttttattattccttacattgtatggtcattattaatctacattggttatctagtaatagtagatgaagtagcatcttatgtggaaagagacacaagttttagtctgatgctatttatttgggggcctatatctttatttttattattgaaaggcttgtacttgtactaatggtcttgtcagattatattattttcaagttgtacaaccttaacactgccattttagcctttggtagatttgtagttgaaatggatactttttaggcttgatcccatagaatacttcaatgagaattttaccgatcatcttggtgcacattaggttcttgtactaaaccatgaaatgcactcttcaaatatgtagtcggctagaattccacttgtccatttttattaaaagggcctgcctgaactttgactgtggaggatataggcttatttaacaccacatcgttctgccacacaaggtacctactcgagcgcatagtcctgttcagggtgatattaggactactacttttaagtgtgcactggcagacgtaggccatttattcaaacatagaaaggcatagctaattagacaagaagcagagctcccttattcgtgcttcaggctgtcacccgaaggaacgcagaagtatcctcataaactgtggaaaagtacaagccctgtaactaggtctgaataaagataccctatttaagtggaacaacgcatgaatcttttttttttttcctgtgaccggaacaatacaacacctcacttcagagaaatgtgtaaactgccactcacttcagaaatttggctagtatatctcttctgaggctaggttggtctgagaatgtgcctatatttgtaccaagttacaggaaagaggcctttctgaaaacatttgattccaggctcagactgttgaaaacaacaaatgtcagtttaacagaatatattttagattcattatcacagttgaatgatccttgaaaaacattatgtcaagaattccagtttaaatttaccttctaactctggattcttgagttagaaattagaaaacctaaaatctaatgtttataggaatgtagtagctagcattttatggtacacgtacagaaaccaattccaaccaaggtaagcaaaggaagtggtggttattttcatgacattttgttatctctcagaacccacagaaattaatctgctaggctgctgtattagaataccacagacttaaacagaaatttattttcttacagtcctacatgctggaagttcaaaatcaaggtgcaagtaggttaggtttttcctgatcctctctccttggcttgcaaatggctgcctcctcagtgtcctcgcgtcacctgctgtgtgcatgcactctggtgtctcttccttttcctgtaggaacacccattgtattagatgaggggtccacacgtatgacctcatttaattataattatctctttagaggctctgtctctaaatacagtcacattgtgggctagggcttcaacatatgaattttgagggacataattgactccgtaacaagcagtaatgcagtaacctctaggaaaagaaaaaatgggtaattgttggcattcagaatactctattcccatctctttctctctctctcaaaatctttgtctcccactcccttcctcactccctcttcgctgcatctctttgtacatttgtggtggttttcctctgttgaaggatcagatctcctatttctctctctagtccattgtcattccagttttctggaactgggaatctgaaggtccagctttattctggtgtgtatctgtgattcaattcagcattgttaagaggttggagccagagtgatagtgagaccatttactagtctatgtctgctggggccgggtagtcagctggagcaggaggaagcctacagacctttgcggtgccagttgttaacctcctttaccttccaggtcatggagaggtcaggagactgacttgaggggcttgagggagcatctatcatcctgtaccactggtgtagccatactggttactgctgaatgtctatcctggttgaccatgaattccaaaaatactttggtgacctactcttatgaaggaagggagcagttaaaagggctgttttgagctagacagccatttccaatgcacattctgccagagaaagtttgtccacaaccttcctctaaatcattctctcaatctctacaaaacataaaacattatttccaaaaatagatcattttcttagaaatgtttaaatgtggacttccagttagaaaaatggtctaatataaaacagtagaggaatgtttagccaccaattcacagtttttagaaagttcccaccatatataatgcgtgatcttcttgaaggtgaatacactgtacttttaaaatatcaaactcttccatccttcatataaaaatattgaccatttttcttgacagtttaatgacaaaatcatagcaacaattctttcagttattatcatctttatcactatcatctgacatttatgctgaaatagctgtgtatacgttcttgcagagcagtacaatgagaaacttttctctctggcctccaggtgtttgtcaattccatcctggctctggggaacaaaacaagtgcctgcaggaaaacagggaagtgcaaatgacctattcctctagagctcagccttttgttagccttgaaaatggaattgcctgtgttggtccatagcccttgaggggtctaggaaagagaagctgatgcctgcagggagaataaagaaagtgccaacatttttctgcccatgtagtggtctggagtttgctgccaagtggtctggagtttgctgccaaggtcccaggactgggtaatagttgcaggtcttcattcttatcagcaggacttccacagggaggagaggttctgggaaatcctcctgacagcaggtgtctgcaaatggggaggcagagatgagggagggaaggaaagtgtttgcatccccaccaggaaggaaacttacctgacacatttcgtagcagcaagggtttgacaatgctttaggatactaaagctaggatactcattattcaactaaatgttgaattttatatatatcagcatgtattttataaatactgagtatatactctgtggaaggtaggcacacagttgaacaatatgggagtttaaatgtgaacgaaaatgtgacttctcttttcagtagtactttcacaggaaactttatcattagcctttctcttgaacttacactgaggatttatggtgctcagatttgagtctctggcagaacagctgtgcctgcaaggagtttcccttctgtcagacaagatagagaatagacgatttgagcagacagcttccaaatgcattttttgatttgtttgatttcctgagaggtatatagaaaatgaaaatgtaactgctgttcatccattgaccctctttctgaggttcaagatgaaagattttttttttctttattactgagaaaagcactgtccccgaattctatctacctgtacatactgaagatagggattatgatttatagtggcattccactcaaagtcagcataacactaacagctcctcacacaccccttcatctagaagcagaagcttcaggcaagcctgctctatggatagtacattgttgccaggccattgattcattgagcagctaatggtcctttcacgaccagagttcttaaacgttaaccttaaagcgtaatttcttgagaacaaatttaagtaccacataagtaaacatagaaccaagtttattacttaaatgactacgattaaatttaaatatcattgtgctttaagcaaatgatgctatcagtttcttctcaaaagtgaagcatgataacttgctaaccggggacagtagagtcaatgtgcctgttgatgccatgatatatcgtcctgttttggggggggcgggaaatatttttatttaattttcctttttgttaatagagatgggggtctccctatgttagccagggtctcgaactcgtggcctcaagcaagcctcccatctcggcctcccgaaggtgctgtgattacaggtatgagccactgcgcccagccagtggggttttcttttttaaagacgtgaaagacttacaattccccttttgggctggtcagtgactagctgtgttaattatgttatttgagaactttgcttcctaagctgacctttttaattttttttgagatggagtctcgctctgtcacccaggctggagtgcagtggtgcaatcttggctcactgcaagctctgcctcccgggttcatgccattctcctgtctcagcctcctgaatagctaggactacaggcgcccgccaccacgcctggctaattttttgtatttttaatagagacagggttcatcgtgttagccaggatggtctcgatctcatgacctcgtgatcgacccgcctcgggctcccaaagtgctaggattacaggcgtgagccactgcgcctggcctgacctttctttttcatatacagtctcctaattttttctctttctcctgtttctataattgttgcccactatgtccattactttctgacctccttcttttactgaaaatataagtgtgtatgcttcctgttgtctaggtagaggagagttatattcttctagaaagaattgcaccatacgaaactgaagttgtcttgcctttagttccctcctcatggctccaaggcaattctgattgtttatctcaaagctgtagcattttttgtctacttcctttggaagacaccagcacttttcctgtgtgtaggaggaagctgtcagtgattgtgggtggttgggtgagaaaccagataagatggattgttggaaaagttaaattggtggagagtgtttgagctgtgggtgaacttagaagaaaacactttaatagatagatccagaatggcaaagactgcaataaaccaggggggtaatgagtttacattcttttcttcttttctctttaaatagtctttccatatacattgtagggaaggaaaaatatattttcctcacccattctgcattcatggctgaggtttctataataaacagatgaagcagaggaaagcgtataaatttaatgactgtaagttttatatgatacaggagccttcataaggaaatgaagacctgaagaaactggcaaacatgtgtaattttatgctaagtttgatgaagattggatagtcatggagaaatatgaaaggaggacaaaagtttgtgatctaaccatagtaaactgggggaaacttagcaaagcctgtttgttcagtttcttcttggcacctctgtgtctcctttcctctgagtatagagagggcacctcttacatggtcttatgacttgcttcaggggaagatcagaaagtccttactagattttatgacatggttccagaaagaaaggtccagagaaggtgagagtgatcttcctgtttctgctgttttctcaactgccaaggtgccatattttggggaagtgtgttctaaactctattgacgtttatctattacagttattgtcaagttttgatgcttatttgcaacactatttggaaaattgaagatttaatatatagcagtatcattatacaactctgtcttttttataaatgttgactctaaaatattattcctttttttttttttttttttttttttttgagacggagtctcgctcagtcgcccaggctggagtgcagtggcgcagtctcggctcactgcaatctctgcctcccaggttcacgctattctcctgcctcagcctccggagtagctgggactataggcgcccgccaccacgcccggctaattttttgtatttttagtagagacggggtttcaccatgttagccaggatggtctcgatctcctgacctcatgatccacctgcctcgaattatttaatcctcatcctcacataagacagccatgtgaatccaaacaattattattagaattacaatgccatcccatgctaagtgttttacacataactgctcattctacctacacaataactctatgagggtttttttttttgatggatgagaaaactgaggcacagttagggtaactaattttcccagggttatacagcaagtaaaagccagagctggaatataactgtcagcggtttcattaaggaaaatcattaactcctaaaagttctgctttatatttttctgcacttagaatacatgttttattcccccaaaggaaacattctattaaatttcaccagcagccacattttctaacttttcttgccttgtcagcttcctgtcagttttgtaaagaaatgcagcataaaactgacaggaaaaaattctgaaatctgtaactacatgacagaatactgaaaattttttgcaaagggttattttgtcatttattgtatagcacttaaaccagaggccagttgaacaggtgatttaataaaaaccatttagctaatatattattttgccaagaaaatttattgtgttgaattcttttctaatttttgatggttgcttccttattaaaacagagtgcctaccaactctaagttatttcacataggggaaaagtaaagcagaagaggtagctattaatttaagctgttttacatttacactgtcattcaaaagaaagaaatatatgtggaataagatatatatgattctttggtaaagaaaaacacgtaaaacagcagatttcatgtttagatgttcaaaaggcattatttttaaatagagtattaagatggattgaacatttcctagctttagaactatggaagtcttttgcagactctaaaacatgatgcacacctcaggcttccataagtttatgtaatgcaagtgattgtgtttagtgtattagtattgggtcagacagggcagcaatataattatatggtttctaatatcttttaagaaaaaggcatccaaacattatttagaatcccagatgttatttagaatctaaaagagctattttaattcagtagatcagtgttcactgttgtttttatttattttttatttttattcttatttttatttttttgagacggagtctcactctgttgcccagactggagtgcagtggcatgatctcggctcaccgcaagctccgcctcccaggtttgcgccattctcctgcctcagcctcccgagtagctgggactacaggcgcccgccaccaagcccggttaattttttgtatttttagtagagacggggtttcactgtgttggcaggctggtctccatatcctgacctcgtgatccgcccacctcggcctcccaaagtgctgggattacaggcgtgagccactgctcccggcctattgcttttattttttacacttatatagggcttaccatattggatgaccatagttctctttgtagagagggaaagagtgtctacaaactccatgtaaacaccatgggagaggcatgagctactgtcctgcagcaaccttcaatcaggtgggagacttaaggcacatttatgacaacgaaaatagtagaatgaaagaaagatgggtagtttaaaggggtagaattttaggagagaaaaagttcctttatatcttgaaagatagaaggaagagatgtagaaggcaaagaaatgacctaaagaggaagatggagggatgtggtaggtcaaaatttttgtgtactacagtatgtaccagccattccagagaatgtcagatatgtcacccaatggccatgacactttcctgtggtcactgaaagactgatttatccttctccttatcatcacttggagcagtagttttgaaaggttggaaggtatcattcattgtttgtactcacgaaatgcaggaaacaacctaaatatatattaacagtgaattagataagtgaattatatttattagagctgtatgtcataaaaatgtatcctttattagagaattacatgcaactattttaaaaatgagagtaatctctatgtgttcttatgaaattatctcttataaatatatttaatgaaaaagagcaagggacaggacagtgttaccgtatgccactattctttttttatttccccccgtgggatgtgcatatatatatatgagctgttcattggtatattcataaagtatttctcaaaggatatctaagacactaataatagtttcctgtgtgtaagaagactggaagatgggataatagggaggtttggttttttgtgatatgcttttatttattgttagactttatttaccctgtgttcctcatcacctcactccacaaaagcatttcattatatacaacttagatttcatttttctactgtttttcaagcttcatatataaacaaatttacaaattatgcaagatttcttaatctaattagcatgtgtcagaaatctctataggaactcaatagaatgaagatacctgggtgtcctctaggcaggttaaataaaactctggacagagagccctggaatctgcatttggaatgaacatttggaatcaagtcctcagggggtatgcagacttcactttgagaaacccttcatttgaacatgattactatgattatattcaagtggagggcattaatgtgtcctgaaatgtaactgttctatggaatagaaggtgattcaacagtctaagcaataaacatctgttaaaaatagcagttattattgtcactattgttactattctagatctcctatcctgttgacttcctcccacataaaggggacatattgccatttttctatgattgcaccaagattcaccctgccttatatctaaggggatgatgtaaacggccctgatatggaaagtcagaatgaaaaaaatgtttgaaaacttttcttagaaaacttagatgtgtattactaaatttgatgatgtccatcaaaagtgttgacatttttatatgtgattgtgtgaactttactttcccaggcctttccaagcttgtcattagacgggtgggtcttaggcattcatagacatggggattattaggatgccaagccgttctatattctcctcccaaatctcacttcccccaaatgctgaggcttcttgctatgtggatgtcaagcatcataatggttccatattctttgctttgcagcgtgatggtcccttattaccccttctcctggtgaaatgaaacacttcattctttctttctaccacctgctgctactactgcttgcttcttgcctgttcctatctgctgctcttgtggggagtgggagagaattgacctcacacagcttccaaaagcaattacatcttttatttggctatcaagccgaaacctggctcttttagtttacagtccgtcacccctgtttttgataattgtactggaggatatttgagtgtcttcatctaggcttacagtcaaacataacattctctgccattctaaaatccatgtctcaaaattaagcccaggtatctggacagtcatgtaccccaagacctctgaagtacctggtgttctgggacctaaacatctgtccacagtcttttacaacattttacttaaagtgtttcctggaaataagttccctgatcacttaccttaataacccagcactcccagagtgagcatacagattagcctccaggttcgtacaaacatgggcttaagattgaattaaaacaagttcttcattgcctgatttctggttttgtctctctcttgacctcctttgaagtgaatgtagggcagttttgttaataatattgctgttttttctgagatggagtctcgctctgtctgttgcacaggccagagtgcagtgacaccatctcacctcactgcaacctctgcctgctgggttcaagctcttctcctgcctcagcctcccaagtgactgggattataggtgcaggccaccacgcccgcctggctaactttttgtatttttagtagagatggagtttcactatgttggccaggctgatcttgaactcctgacctcaagtgatccacctgccttgacctcccaaagtgctgggtttacaggcgtgagccactgtgcccagccaataatattgctttttgcaaagtataaaagtcttgtcaggattgagggtgggagggagtggcaggcaatgtgaacacactggtgggcagcggaattccagctggttcttccagtaaggaagccgtgaaagcaccctcaggtcgacgtacccaggtctgaaaatagagcagagcaagacttaagactggggaagcagatggaagacaaataccagacattccccctctttgcagtctcctttctctccaccttttttgtctggttttgttcctgtgtagacatgagctctgagtaacagcttaggcaacagtttgggaactgtttgggaattagctttggcaactgattgggagaccaaaggaaggatttgtcaaataaagctaggggatgcagagccaagagggcagctaattatttttgaaaactagtcactgtgctgatttaatgtaaaggtggctttgtgcttaactccaggcacatccctagattacagtatgaaatttatgatcctcaagtaagaagggaagcatctttagaaatggagaagtaatgggccaggtactgtggctcatgcctgtaatcccagcactttgggaggctgaggtgggcagatcacaaggtcaggagattgagaccatcctggctaacatggtgaaaccctgtctctactaaaaatatgaaaaagttagccgggcatggtggcatgtgcctgtagtcccagctattcaggaggctgaggctggagaatggcgtgaacccgggaggcggagcttccactgagctgagattatgccactgcactccagcctgggcgacagagcgagactctgtctcaaaaaaaaaaaaaaaagaaataatgaacttatcatcaacagcacagacagcacattacaagtcttctatgaaatttaggtcttcattggtttctgccttgattattacattataatagttttctaaatcatctttctgtctcaggtttcttagtcctccccttcattcatgtttatgtatacactcattaaacatttaattatttcttgtgcactagacatagttctgagcgctaggtgttgtgaaatgaagcccgtcttctcctagagtttacattcaagtggtgctggtggtggggaaaaacaacaaattgatatagtaaaataacaataatggctactatgtaaagaatataagaataactggttactttggaataggtgatcaagaaagccttctctgaaaaggtcgcttctaagctgagtactaaataaaaaccagaaataagagtattcctggcagagaacacctcatgcaaagtccagaggtgggaacaggggagcagtccaacaagctcaagtgaagaccaggccagtgtggctatgctactgtgggccggggaaggcgagagtagggagtgaggagtgatatgagatagatgcatcaagctaggtgcattagataggctttgtcagaaggctaaggagtttggattttcttcttagattttcttctaaagggtagccattggggcattttaagcaaacaagtgacacatagaatttctatctttgaaagcatgttatagaataaatattcatgaatcatagtgatataagtaaaatgtttgaataaataaataaatgaggaaggaagtacaaatctttcttacagataaactcctaggcaaacatcatatgttctcacttctttgtagaatctaaaaatcaaaacaattgaacccatagagacagagagtagaaggatggttaccagaggctgggaagggtagtaggggccaggggtgaggggagtggggagtggagtaaggatagttaatgagtgcaaaaaaaaaaaaaagttagaattcctaggccaggtgtggtggctcatgcctgtaatctctgcaccttgggaggcctaagcaggagaatggcctgaggccagaagtttgagaccagattaaataacaaaggaagactatctctacaaaaaattttaaaaattatctgggcatggtggcaagtgcctgcagtcctagctactcaagaggcccctgagaagggagcatcacttgagcccaaggagttcaagattgcagtgagaaatgattgcaagactgcattctagcctgggagacagagcaatatcctgtctcaaaaaaaagagagagagagagagggaaattccaagcagtaaatatagatcttccctccttgaggaagtggagcttaattccttgccctttgagtgtgggcaggttttagtgactcacttgcaatgaacaagaatatggaaagagaaaaagcagtaactttataatggagaaacctgggagacaccactagtaccaagtaatgaaggttaatgttacccaacatgatctgataagagggatattttacttctgtgataatcatctcccaaattcataatcatgagaaaacaaaagacaaacacaaattgagggacattatacaaaatacctaattaatgttcctcagaactgttaagtcaatgaaaatcaaagaaagattgtgtaactgtcatagattggagaacactaaggagatacaacagttaaatgcaacacaaaatcctggattaaatcctcaaacagaaaaaggatattagtggaaaaacagtgaaatctaaataatgtttgtaattaggttaatatagatgtacccatttttcagctttgataaacatacctgggttgtgtatgatggtaacattgggaaagctgggggacaggaatacaggaactctctataatatctttcagaacttttctgtaaatctaaaattatccccagaaaagtttaaaaagaaaacaaataaaagagaggattctagcttctctgtgatgattaaactgagtttgaggttcaagagtgaaagcagagagcccagtaggagctaggtctactggagtggtccagatgagagatgataactgtgcccagaaggctcttagatgatgggggagatgctgggaagggtacatatttgaattgttctggaagtagccaagaaaagatttggggattggctgaatggaattggtatcacagggaaaataggagagaggggcgggaaaagagaaactgtaatgagttatttttcgaaaatacagatatagtcatgtcaattctcatttcagaaatcttcactaccttcccccttaaagtgtaatagagaccacactcttcattctgacctacaggaccttccataattcattccctgattatagcttctcgtatcttaccatcttacctcctacacacgttgctccacatgcagacattcatacctaaaagttccaattctgagtcatttcagatcctggaagggttattttcacctcttaaaacaccagaacatgctcactatcttactatcttgctagttaataacaataatagaagaaaaaaacttttctgggcttttacagcctgtcatgtcctgtgcgaagagttttaccgtcatcaccacagtaactctcaacaatattcctatgacgagagtgctttgcttttcctttgtctgcactttgggaagctgatgcttatgggtgggatggctttataatttattgtccaaacagaaaaggagcactgtgcatacttaccttggaacaacatgtgcaactgggaaagccaggacacatggtcttactagttggtgtaaaatttgccaaagtccacaaaattagcaagtgacacagcagagctttaaattataatattttagaacacacactcttaatagttataatgatactctcttggtagtgggttatgagtttggttaatgactagacctctctgagtggtatgttcctcgtggatacaaatggtgttgctgagatattgattactaaagcacttaactaataagatgatggttagtaaaacaacatggctgggggtgttggctcacacctgtaatccaagcagaattttttgggaggcagaggtgggaggatctcttgaggccaggagtttgaagccagtttgggcaacatgggaagaccctgtctctacaaaaatagacaaaaaaccaattagctgggcatggtgatgtgtgcctgtagtcccggctaactacaaggctgaggtgagatgatctcctgagctagggaggttgaggctgcagtgagcccatgattatgccactgcactccagcctctgggtgacagagcaagacctattaaaaaaaaaaaaaaaaaaaagaaaaaaaaagtaaaacacttaacattggcaaacattcaataaatgagtacctagcacattattttgctgttagttggtgctggcttttttataggttttattaaatgcactcatgtacttcaaggcaaagaatttgattgactggccaaaggggtgaccaggaactacgtggaacccagaagtagattttggagaatgttcctcagtaacagaaaccttgccttcttgcagttgcttcagagccagagccagaactagagaaatctttggtagaaaagtgcggtggaaatccacgttattcaccacagtaaaccgaacagctatccttggatctattactccaagggaagcacaaggtataaggaggctctctttagtgcacgaggctcacactctctgataccacttgctgctaatataattaataagcatatattttctaaatattttaatctgctgtgtagcccaggcagtatagaggatattattatcataaccagtggtattttcttatattttcatgttcctgtgtgaaatggcaactctaaatatcaaccatggatgttttgctgaattttcagtctataaccatgtacgctaacatgatgcattttctccagggactgcctaataattccatttagctataaacatgcatttttgccttgccttcttcagggaaggattcatactttaacattaaattattcattacaggcagggtgcggtggcttacgcctgtaatcccagcactttgggaggctgaggcaggtggctcaagaggtcaggagttcaagaccagcctggccaagatggtgaaaccttgtctctactgaaaacacaaaaattagctgggcatggtggtaggcacctgtaatcccagctactcgggaggctgaggcagagaattgcttgaacctgggaggcggaggttgcagtgagccgagatcgtgccactgcactccagcctgggcaacagagcaagactctatctcaaaaaaaaaaaaacaacaacatagttttcaattatggctgtttgccatcacaattttcttctgaaaatctttcatgtgatttgtattgttataatttaaactgtggacaatttaccttctatttgcatgacaacatacctggtgccttacttagtatggagaacataaaacaccattcctgtccacaaggaacttcctgaatgattatatttatttatcatatatatatttatttgttttatattatgttgatacttattaagtatctactgttttataagtgtctttacatggaaaatttattcatcttttgcaataaccttatgatctaaacagagctgtgcctattttatgtattacaccaacattcagagaggcaaaatatttcacctctatggcaaagaaagcatttaaacctagtttatctctggctctaaggcatctattcttactggaaaaccatagtttgttttcatggaacaagtagagcagtaagaaagcatacaaatacatatatttatatttagaattctatctacatttttcaatgttgatagtcaaggattataaaagcatttatagatacaagagagagttatctcactgctaaaggactgattaaatgttaaatctcagtctcgcagaaaagttcataatccatgtaaaataaacaggtagaattcttctgcctacttgatctctctccaagtggaaggatttacccaaatgaacgtgttctctgtggctcatccagccctttgtttagaagttttctttcatgaaagtatgataacatcaggttttggctcttttatcttcttttgttattgagaaaattatgttaacctgtttaaactgaatttgatgtttttgtcataagtggtcaccataccactttctgtctgaaaggtagatatgtcaaggtattataataatcctgattaattgagtttattgcagcactgttcacaataagaaagacttggaatcaacccaaatgcccatgaatgatagactggataaagaaaatgtggcacatatacaccatggaatactatgcagccataaaaaggacgagttcatgtcttttgcagggacatggatgaagctggaaaccatcattctcagcaaactaatacacgaatagaaaaccaaacaccacatgttctcactcataagtgggaattgaacaacaagagcacatgaacacagggaagagaacatcacacaacagggcctgtcagtgggtaggaggctaggggagggatagcattaggagaaatgcctaatatagatgaaaggttgatgggtgcagcaaaccaccatggcatgtgtatatctatgtaacctgcatgttctgcacatgtatcccagaacttaaagcatgacaaaaaaaaagaaaaagttatctgatggtgccagtcaatcccaagacaaaatcccaaacaccaacattctgaatgctgcaaccttgaaagatcaaaatatttaacataaaaaatcctgaaaatcacactccagaagattaaaacctcaaatgttgaaatcctaaaagatgaattttggagaagaaattaatgtattttctgttgtttgcagaatagttgcatcatattagttggatcatgttaggtgaaactattatcttgttattgtctttatttggaaactaagtatggtttaaggagtttcgtatgggtttcaactgataaggggtggacttgtggacttaattttaggtgccaacttaactggataaaagaatacctgtaaacccagtaaagcattattacgggtgtgtcgatgtggagattagtgtgtgtgtctgagtggactaggtggggaagatctgccctcatatttccagtatttcaaagatcatagagggggtaaaaaagcaggtgaaaaatacaagaaatctcccctgccaaattattcagttgtgtacactatcagtctctttacacacaggaccatgcttgctttccaaaaacaccttttgtcataggataaaaataattcaacaggctcagtgaccttctgcactaaatatatttgctgatatggaagtttctcccgtgattataatgtacatagatggtgaactattcttggttagggatttgactttggaagaagatagatttcctatatttaccactaaatttatcatagacaaactagtgcatgcttcattttggccaatggatggcactttcaaaaccgtccctactgtttttcttatcaactctgcctaattcatgcccttattggatctgaaaattctagaacttatttacttcttttaaatttttgaataatgatgattattattctttaaattgagatggggtctcactatattgctcaagttagtcttgaaattcctggacttaagtgatcctcttgctgtggcctccaaaagtgttgggattataggcaagagccaccgtgcctggcttcattcatgggtttttgtttctcgagacaaagtctcattctgttgcccaggctggagtgcggtggcactatcacaactcaccgcagcctcaacttcctgggctctcaatccgtcctcctgcctcagcctgagtagctggaactacaggtgagtgctaccatgcctggctaatttttgtactttttttttttttttttttttgtaaaaatagggttttgctatattgcccaggctggtcttgaactcctggactgaagtaatcctcctgccttggcctcccaaactgttgggattgcaggcgtgagccactgcacctggcctcatttatgttttaatgactggaaaaaatcaagcactttataaacatttatttgaagatttggtggacttgcagaagaaaatgaattacaattgaatccccaaaccataatgacagatttggaattaggtacaatcaaggcttctaaaagtgaatttcaaggtgttaccaatagtttgttttctccattcagcccaatgcatatggcaaaaaattcagatgtgtggattgccacatgatatggcaacaacgaaaacttcagtttaaaaatgtttcaggtgtctgcactggccatttccttccagctgatggaattttaggagatttgaatgaattaaagctgcatttgtctgaagaagccagtgaagttactgactagtttgtaaataattatgtgcatggtagggtaaaaagacacttaggcaactttttttttttttcctttggtcaatcactagtattgtttccaccaaatttgtggcctgtatatgagtccatgcttaatggatttctgcatacccaaaacaaaatagaagcatggcacagaagatgggaagattcgatagagcatgcttatgttggtggatatggaatcatagaagaatttcttttttcttttcttttttttttttgtgggggtcggggacagggtttcattcctgtagcccaggctagagtacagtggcatgctctcggctcactacaacctccacctcctgggctcaagcgatcctcctgcctcaacctacagagtagctgggactacaggcacatgccaccatgcctggctaatttttgtatttgtattttttcagtgatggggtttcatcatgttggctaggctggtcttgaactcctgacttcaagtgatccacctgccttgacctcccagagtgctgggattacaggcatgagccaccgtgcctggccaaagaatttcaaaaagagcagcaccactagaacatgaatgtaaacatattctcctaggtgagcaatgccctaaaagaaaataaacaaacagctattcatcacaatgcaaaacttcaaaatatagttgatcatgaaagttgactagctcttatacactacctctgtgtaatttcccataatgtaatactgtttgtcaaattttcttttttggtgttttgaggtctttttttaaagtttgtttttcccctcactattttaaatcatcagcattatccttttacacatcactatgctatgtattttagttttgcatcctttctaatactggaggcatacattttgtaaagacttttagagagttctaattcattttatgcatttttggcaaatttgactttgcaaaagagtgttatcacaatgttgactttgtgtaagcattgtgcatgtatgtaaaaccattgaaacttcctcaataaatgaagagatgtcctcttgtgcatctgcatttgtgaaagataaaatttcttaaactctcagctatttgggtggctgcatatgcagtagtgaccatcatggtttttgataaattttgtcagatgactcaggttgtctgtcacgatatttcagatgatcacagttataaagccgggtgcacacaattgccactgtgatatgtgtgtatacattgcactttttaccaatttccttatgaatatagtctgttcatagttgttgtacccatgtaaccatggttaacgtaactgggtatatatacttgcaaatatatttgttattaatgcctattgaatgaatgcctatgaagtagtctgacatattttgtttgtttgtttgttctgagatggagtctcgctctgtcgcccaggctggagtgcagtggcacgatctcctctcactgcaagctccgcctcccaggttcacgccattctcctgcctcagcctcccaagtagctgggactacaggcacccgctaccacacccagctcatttttttttgtatttttattagagacagggtttcaccatattagccaagctggtctcgatttcctgacctcatgatccgcctgcctcggcctcccaaagtgctgggattacaggtatgagccaccgcacctggcctagtctgacatatttttatggacttctcaaataaattcctctttaaaaatgtaaacgaatgtcttttaaagaattttttaagctaggcatgatgacacacacctgtggtcccagctatttggggggctgagacgggaggatacctggagtccaggagtttcagaccagcctgggcaacacagtaagaccccattgcaaaaaaaaaaaatatatatatatatattttttttacttttctcagagttatatttttggaattttgatgtcttgggacttcagcattcaggattatggtgctcaggattgtgtctattggaattacggttcaaaccatcttctgataagtagaaaggggtcaatgtgtcactcttagcagactgctatcgagtgaaaccaagattctattgaaattaatgttttgcttttgccagctgcatagaaatttctccgagttaaacctgggattccgttgacattaatgttttgctttggccattagcacagaaatttctactatttaaatgaagccctaatattcccagatgaacagagaggcagtaccttaagtctgtaccctatatcttaactcatatctccggagagtagttcaataggctggtagctgactataagatttatgtagtctagcagaggaattggatgaggggtaaatgactgtttaaacctatattattgccttttgaaattaagagttccaagggagttattatattttaatatattgaagtctaaaagagtattcattaatatgtatgcattgatacagtggcccaatttgaaacttaattcaaatgaagaccgtgtgccccaagagataaatacttctgtccaaattgctgtaacaaaaatgaaaagcagaaatgagagttgtcttccctgcaatttggaagtcttgctttaatgaatagttgacttttttcctatttcaaaaatagtacctccttcagagtttaaaatttaaaccacacagaagaaaaaaaaggtcatgcgcacagaagattttctatatataatatagcacacttcacctgggaaacttgatgtataagctatagattgctattcatagatcattcagaaatatattaaatttgagatttttttttacccccagacaagagaaagtgcaaagtaattgattctgtttctgtttgcaactgtactaagatattgcctataatgcccccaaattactttaaaaataaacttcaaaaagaaatgaattaggaaatgttataaatctatggaaaatgcttcacattttgtcttgaataaacagaagtttctttgaaattagcatctttaaaaatgtgctctttacaacaaacaatagcaaaattccattttttctttgtttttttttttttttttttttttttttaatcagaagcaaaaccacaaaatcctcactctcaaggaatgcacaggctattgcagaagccaggaagaaatctatattattacagagtacttatctcagaagggttgttataaatattaaatgagagttattttatggaatacatctgaactagtgcctggcacataaaaagtgttatataagtatcagctattgtaattacagagtgacaaataaaaggtcggagtgctatggttatggaatagaatgatgagaaaggaaacttccaggagcttaggtgtactttaagtgcaggtatcaaatattgatgcttcattatggcaagggggctaacaagttgccagtgtgtcacaagtcaacatgcaggcaaagatggaaacattttccagatctaaaatgtagttaaatatgttgtactttggaatcgtatatgaactttattcccctttcagaattacaaatctcttagaaagccattttatttctttctgaaactaagttatgatcatctactatttagcacagaaataaaagggagggataaaatctaccaacccagcaaagacacatcttgctttgcatatcttgaggaaggccatcagcaaaatggaaagatgactctctgttgattactctatgttgagaaccttaagattcagatggtataggattccagctaggcagttgtgaactgtccatttgtcttatgcaagaaagtctcttcagctttctgaacttttctgtatttcacatactcattctagttcatgctcatgttcaaagcttggctagaatagcatgaaaaagtttccaaagtaaactcagcataactcaaacatttttctagggtttattatctctagtggaaaggtgaaaagatagcttgccttttatttttaaacactttacctgagtgataaaataacccaaaagccactgtcaagaatgagaaaaattgactgggcacggtggctcacacctataatcccagcactttgggaggccaaggcgggctcaggagttcgagaccagcctgaccaacatggtgaaaccctgtctctactaaaaatacaaaaattagctgggcatagtggcgggcacctgtaatcccagctgctcaggaggctgaggcaggagaattgcttgaacccaggaggcggagtttgcagtgagccgaggtcatgcaactgcactccagcctgggcaacagagtgagactccatctcaaaaaaaaaaaaaaaaaaaaaaaaaaaaggatgagaaaaattgagaagccataggccgtggtaattcaaactacatcatcagctactgaaaaagtagaatgagtgatgttttcaaatgcacttataccccttttaaaaaattattagactttattttgtagagcagttttagattcacagcaaaattagcagatgatccagagatttttcatgtactccctgctcccataccacatagcttcccctgttatcaacctcccacaccacggtggtacgttcgttacaactgtgaacctatattgacccgtcattacccaaagtccatagtttacattagggttcacttgtggtgttatgcattatatgggtttggacaactagagtctctttttaaaaagaactcccttgtggtgaaaatgaaatctgagtctgagaatagaagtgttttcagttgtagtaaaattggagctgatgctccagaggctgttgcaaggatgtgccctcaggcgagggcacagacctctcaacctagagcactaatagttaaagtttggtagcctcaagcctttgcattgctttgtactggcttaatggcttttactgtttaatatgttacaaagactctggtcttcaaaagtaatgaagtgcaaacatgaatgacaattgaaaatgtagtttgactgatgactgagaagaaagggactagaaataacgcattttagactttgaccttgcagagagttctttactcatgtgaagtgggatgggtgaaaaacatagctttttttctttcttttcccccctggcttgcttccagaattcatatgtaagcgtactttgtagaaactgtgtatgtattgcaataaattaaactagtggctttcaagttttttggccatatcccacaataattttttatgttgcaatctatcaaatacacacacgtatctgacaaaaaattattagtattagttaaattctggtcacaatctatgtaaccccagtttggacgaagataaagtgagttaaaccttcctgcagcactgcctgggaggcaacatttttaaagagggaaaattaaacctgtttattcaaatttaaaagaataacagatatatgatcaggaggaggagactattaatgtatttcaacttacaaaaaccttctggccgggcgcagtggctcatgcctgtaatcccagcactttgggaggccgaggcgggtggatcacctgaggtcaggagttcgagactagcctggccaacatgatgaaaccctgtctctactaaaaatataaaaattagccgagtgtggtggtgggtgcctgtaatcccagctactcgggaggctgaggcaggagaattgcttgaacccaggagacagaggttgcagtgagccgacatgatgccactgcactccagggtgaggctcagtctcaaagaaaaacaacaaacaaacaaacaaacaaacaaaaaacccacttctgataaggtcttatattgagaactaatatcaattcagttaactggtttttggaagaaatgttcccaaagtaataacattagcagaaatgggggatttcaagtttgggaataaagtttttattgaaagtgtttaaaaaatgatctggattagatggtagcccgttaattcttaaatttaaaaaaaatggaaacaaagtggtgtctgtatttttaatattcccccacccttggtatttctgctgcaatttgtcttcataggccatttttagaaatgttttcacaaactagaacagtattagtaggcctgaagaaagaagcccagacttgagaaaatttagccgttaaaatattcgggacttccagtatttagttttctagagacaaaccatcaagaagagaaaataattaatatacaaggatagatctgaataagaataggtcaagttaaagtgttttttgtgtatgtaacctgtatgcctatgtgcatcagaaaattgaatatataattttgtctctcaaaggagaagtttagatttggagagagagatttggaagctatgttagtttgttaggactgccataacaaaatatcacagaccgcgtggtttacaaaacagaaatttattttctcaaagttctggaggctagaagtttaatgtcaaggtgtttaaagtaggattggtttcttctgaggcctccctccttggcttgcagatggctgcccttcttgctgtgtccttacatggtctttcctctgggtgcatggccccctggggtctttctctgtgtccaaattccctccctctccccctccgcccccgtccctccctcccttccttccttctttccttccttccttccttccctccttcccttttgtttttgttgaaacagagtctcactctgatgcccaggctggagtgcagtgacacaatcttggctctttgcaacctccgccttctgggctcaagtgatctgcctgcctcagcctcccagagtgctgggtctacgggcatgagccaacacacctggcccaaatttccttttcttataaagacatcaatcaagttggattagggtctactcctatggtttcattttaattcaatgacctcttcacaggccctgtctccacatacagtcacagtgtgaggtatgggggcgaacacaatttaggtcataacaggttccatcagaacatgaaaggatagtaaataaacatatattaagcattgaatccttagaagcacttacatctaacgattaataaaggggtggaaatccacgacaaaaacagaaacatggtcagagaggtatacagagagcaagaacggtgagattcaagaaagtgaaattcttttttgatatggaatgcatgatcaagttccttcctaataatatctaataatagtagtgaagaaaaaattatttttgtttggaaactagaaattattaaggatcttaacgaaatcagattctgttgagtggtgctgaaagttagattttgctgagttgatagctaaattgaaggcaaaaagaataaacacaaccaatttaccaagccacgaaaataatagattttgaaacttgtaagatctcaccttaataaaaattataagctaggctatcttactagatgggagatgtcttattcattttgggctgctgaaataaattaatataactggatgacttaaataacatacatttatttctcctagttctggaggcttcgattctgagattagggtgccagtatggtccagttctggtgaggatctctttctggtttgcagacagccaccctttggctgtgtcctcaaatggtagaggagagagagagagagagacaaaaaataaaaataaaaaataaacaacaacaacaaaaaaaacacacctctttctcttgtctcttcttataaaaacactaatcccatcataaggcactactagcctcatgacctaattacttctcaaaggccccatctccaaattccatcacactgggatttagggattcaatatatgaactttagggggaaacacacatagcagaagtgactttcagaagcctaacacctgagtcatcatatactgaaaactcaagacaaattctggaatgcagaagaaaaaccctagatggctgtaagatttttaggaacttgtgtgggggtggttgatacagttttccacaggattcttcttgatgttattaatactattagttgcaccaactaataggaacgtcttgaaccaactaatagtaacatcaataataaatctgaaccaatgatctgaaatttattatcttacactttgctttttttctctatataagatggagttgaaaagcaagtaagtgatcacttgatctccctcaagtatctttaagagttagagtctaaatatcagaaagtactttttgttgaggatgatttgataaaaagaattccaataacaggcttaagtgaagttttggtcttataggaatagagcactgtaagcaaatcaatactgagctcggccataagtggatatgattgctggtgtaatgggtgagctgccaacagtcatgatgctagcacttttgatcctgcaattgtcgcaatgaatattttgagtaccttgggaccctcagtagttatatattatttttcttctctgtgttctcaagtttgaacttctggtgttaattagaactctgcatacctgaagttaaaaaatataaaattttagattattattaggaaaaaactccatatactccagctattaaatagtgttattattctgtatttaattcttggcattctaataaacaaaatgtttctataacaggttcttgtgatcacctttttaaaaaaagtattttagcttttttaaaaaaaaattattattttttttgctcctggcatcttaaaccaaacctaaaaattaccaatattttccttcagtgaataacattatatgactgataaattgtcaacattcattcaatttcatgtcctgcccttataaatattggggatgatcaaggtatgcattttaaaaatgttaaaatatgctgggtgataatggcttgcatctatttgaagaactatttaaaataaggttagaagtgaaaacatactactagagcaaaacttacctcattgtacactgaaattatctacagatcttcctcttttaaactgtgaattaaatatgagagatattgttattttattttattttatttttatttcagtgactatataatacctggcccaagagcacacaataaatatttgttgaataaggaactgaatttagaagtcacaatgagatcagtgtaacgctgccccaaatgtaggccttgagaaggaatgtccaatacggagtaaatggatactaaaaagtttggttccttcttagttgagggatcgtgaaaataaaataaatatttctaaagaaccctccaatttttcactaagggatggtaggtcaagataaacacagactgaaataatccaagaggtatggaaacactggcttcttccaaaacagaataaatctgcagcagctgtcacagtttttctactccactgaaaagttcaatagtaatttaaaaggaggaaagaattcagtcttatctgaaaatgggctattgttctatttgtattgttagtaagcagcagccatggaaacatataggctcatttaaaagaataaggtcccatctatagtgtgttatatgctcaggggttaagtgaaggattctgcaggaaagtaccggtcattctcatttgtgggaggatttctggagatattcaataaaaatcccgggctctgaagaagcagagtgagatagggaattaggtaggaattataaagacaaaacaggagagcacacacctaccatcccatccttgtgccctagaagacatctgttaggggatggaaatggaaaccacgcaaaaacaaattgctcacttccagacagattagctatctttatgtattgtttgctacatgtgtttcttttatgaagaatactttctagggtcaatgtggagaagtgaaaattccttgcgcagagttcagtttctaagtccttggtttagaactgaaatcaggaattgtcatttgagcttgatgtatgttttatttatgggtaatgcattaggatttattaacaaggagtaaatggtaattttctatgccaattagttttgccttttgtgggaagaaatggattttcctcatcttaatgtgtgaaactctacagtatcctgtttttcatggttcccagaagggaatgaggacatttggataccaataattgaggaatcatgccttaaagaaacacaagaaatatacaggcattcctcagtatttgtggggggattattccaagactgtccttggataccaaatccactcaagtccctgatataaaatggcataaatttgcccataacttatgccaacccttctgtatactttaaattatctcgagtagttataatacctaatacaaaatgtaaatagttgttatactgcattatttaggaataatgacaagggaaagtctatatgtgtttggtacagaggcaatttttttttcaaatgttttctatccctggttgtgtaacccatggatatggggcagggggcctgactgcatatatatatatatatatatatatatgtatatttatttatttatttatttatttttccctccaactttaagttgtcttttttttttttttttttttttggagtgcacgactcactgcagcctcgaccttctgggctcccacaatgctcccacctcagcctcctgagtaactaggaccacaggtgtgtgccactatgcccagctaatttttgtatttttgtagctatggggttttgccatgttggccaggcaggtctccaactcctgggctcgaacgatccacctgccttggcttcctgaagtgctgagattactgccgtgagtcaccatgactgggagttatttcttgattttgtttcaaaagttctcaagtggtggacatagtgtcatctggcattggctactttaaaaaaattatttattatcattattatttttaagtaatagagatgctgtctcaatatgatgcccagactggtctcgaactcctgggctcaaacaatcctcccacttcagcctcccgaagtgttgggatcacaggcgtgagccactgtgcccagttggatacttttattaaacacattcatccctcaatactttattatgaaacatttcaaacatatagcaaagttgagagaagtttagagtgaatactcatatacacacaatttagattttaccactgacattttactatactttctttatcacatagttatccatcaccctattcatccataaatccatcttacttttttttttttttttttaagagacagggtctcccctctgttgtccaggctggagtgcagtggcgccttcatagctcactgtaatcttgaactcctggtttcaagcggtcctcctggattcaagcggtcctcctgtctcagccttctgagtagctaggactacaggtgcgccactactacacctggctaattttaacttttttttttttttgtagagaaggagtctcattatgttgctcaggctggtcttgaattcctggcctcaagcagtcctctcaccttggctttccaaagtactgggattacagatgtgagccacaccacctggcccataaatccatcttacttttgatacatttcaaagtaaattgcagctatcagttcaccatccttcaatacttcagcttacatattattaactagattattaacaacttttaaagattatttacaaacaggtatatttgaagtttattatcaagtacactttcagcctaaaaaccaccacaaatttgaccactgtgtacctaaaggaactactatttgaataaagaagtctgggagccttctggctaccttgagaaatcagttatggtcttttcatcttcccccactcccacattcttcccctgccaattgtttttccatatagctactgcttcacatgcccactagacactgatgtagctcaaacgctttcttaccgttcatggtatgattctaaagagcgtgtctctgcttcttcttgttctttcaacccatccttcttgaaaatgcctattatctactcaaaacagattggagagagttaaagcactgattttgttgttgcctggtttattgctttcaatctaattgagagacgttaaatggcagggagtcacattgttgtatttcccattacataaaggggtaggtttcactggtgtcgaaggaatgactggatgttgtcggacagggactctcactgcagttcattgactgttgcttgcctggtttgtgcaagtcatctacagagctattagaaaagtttctggttcctgccctgatctcaagaaatctggacttctggtctggtagggagcctaggactctatatttttatttatttatttatttatttatttatttattaattattattattattattattattattattattattttctgagatggagtttcactcttgttgcccaggctggagtgcaatggcaccatctcggctcactgcaaccttcatctcccaggttcaagcgattctcctgcctcagcctcctgagtagctgggattacaggcacatgccaccacgcctggctaatttttttttgtttgtttgttttttgttttagtagagacagggttttgccatgttggccaggctggtctcgaactcctgacgcccacctccacctcccaaagtgctgggattacaggcatgagtcactgcacccggctgaattctgtattttttaaaagctcccaggattattctgatacacagcaaatttgggggaaatgaaaataagagtattggtcaaacgttgcctgtttcttgctggtgatcttctcaagttatatatcctcttacagtcctcagtgtctttaactgtaaagtgaagaggatgtaccagatagatattacctagagttttttgttttctaaatttgtgcgctcagtttagtccttcaaaagggacgtttgtaggatccatgtctaggagaacagaaggaaagattggaaatagaagagcaagtcacatcacctgagttcaaattctatttgtatggcatggtgcaagttatgtaattgtaagtttctttttctctaagatgggcatagtaataattcttcctgcatgaagcagttgcaagaatgaaatgtgtggcacaatatatgacaaattctaaacattcaaaaaatgttttgctaatttgttttgtttgctgttttacatggatggaagggaatgggaggtagataggttatgagaggaggaaagacctcctattagtctatattctggtgagaatgagctgactgggctctaatttcaccttgatcttcaccacaatctgtgtcccttggcaaatcatagcatctctgggactccatttattggactgagaaatgaaacagtttagatgaaataaacttcaatccccccttttaaagttaaaattctattctaatgtgattctgataatttttcatggcactccctgatagtgaatgctgtgaattgtaaaactgataatatttcctctctttgttttgtcttctaagttagcttcaagttgtatttaggaccaaaaataagcaactatgaaagactttagcagagctggcttcctagatgtgcattctatgtaggcacatagggctctacatttagaagggccatgttacttgtttaatgctcctagtttaatattgctgtcctgaaatacttattttttaacaaggaaccttgcattttcattttgctctgtgctctgcacattataaagtcagtcctggatcttagtatatatttttctattttagcctcatcgtaattgccatgcatcctaaatttattgtctttttttccctaattgctctgtgtgtgttttttgaaatatcatatattcatttggtaaataggcagataatggataaataaggacattattctcctatgaagatttgcttcccaaaactcctagctatatttccctcctaatgtcaaacctaacagtatttactgtttgtcattcatcttgatactaggttatatattaccttgcatcactatctaactttgccttgtggacatcttaaaacttctcaggttattataacctctttgaatttttatatccccaacaatgcccatcttcatgggtattgctcctaacagcctcccagaaaaataatttttgaattaatataactagaaattgaattgatttaaccagctagaagaagaaaggaggggagatctcagcaaagagaaggaaaagaggaaaaggaccccaaaggatggtcacagaagataatcatttgtcattgcttgatttccattccaaaaaccactaggccaggcgtggtggctcatggctgtaatcacagcactttgggagtccaaggtgggtaaatcacttgagttcaggagtttgagaccagcctggaaacatggtgaaaccctgtctctattaaaaatataaaaaattagccaagcgtggtggcgcatgcctgtagtcccaggtactcaggaggctgaggtggaaggatcactttatagtgcaactgcactccagcctgggtgacggagcaaaaccctatctcaaaacaaacaaaatagtagtacagagattttcaatatttttggtctccagagcactttacagtcttaaatatgattgtatacccacacagatatttttttcttttgtgatagagtttcactcaatcgcccaggctggagtgcagtggtatgaccttggctcactgcagcctaggcctcctgggctcaagtgatccccccatctcagcatcctgggtagctgggactactgacacaccaccacacccaactaacttttgtattttttgtagagacaggttttttccatgttgcccaggcttgtctcaaattcctcctgaggtcaagcagtccctctgccctggcctcccaaagtgctgggatgacaggctggaaacatagcaactggcccccacacagcttttaatgtgggttatagctattgctattataggggaagttacaaatttttatgataattataagattttttaaataacaaaactattacatgtcaacttaatatttttcattgaaaatattttttctcaaacaaattttgtgatgaatgacattattttatgctttgcaaatcactttaatatctggattgatagaagacagctggatactcatatctacttttcattctttctgttgtgatatcgtgtagcttctgtaaaactctaccctatacttctgagaaaatattagtataaatggcaaataatgttttatggttgttatgaaaatcatttttactccatggactcctttaaaatgtctcaaggactctaagtgttccctggaccacactttgagaactgattcagtagagtgacatcttgctgccataatatttttcagaatcaagatagtaaattctacacagctatctccattcctttagctgaggtaggtggaatttcgctctgaggctcaaaaaatagaatactttatcttcatatttgccaacctgcattgattgcccattgatttgtcccaaaactgaaaaaaaaaaaagcatcaagagatttgagagtttttaaagattctttctcttccttgcttgcatgttataaatgatggacagacgcagagaaggagccaagtgtggggacaccatcatacaatgctaagtttctgaatcgaggtgatttcattctattattttttaaacttaatgttgggaaacaatgggaggtggatctgaatgaaacctttggtgaaaaaaaaaagacattgaaataactactggaataaattactgagtcattctgggtgtaaaatatacattttaatgcatatttcaattgctgtaatttgaagatatgtatcatgcactcagtttcaattcattactattgggagctctgcattatcaagtctaggagtgctacagttcacattaattattcagaataatgttattgacaggcttttattataggttatatttaattttgggggtccattttctgcattccttctctttactaaaatctcccctgttttcttcttctagccagttaaatcaattcaatttctagttaaattaattcaaaaattatttttctgggaggctgttaggaacaatacccatgaagatgggcattgttggggatataaaaattcaaagaggttataataacctgagaagttttaagacgtccacaaggcaaagctagatagtgatgcaaggtaatatataatttagtaccaaaatgaatgacaaacagtaaatgctgttaggtttgacattaggaggggaatatggctaggagttttgggaagcaaatctacacagaagaataatacctttattatcctagggatcctacggtaaaaaataaggttcttcgcatttacctgtaaccccagagttttcagtgctaactttgtagctaatctttataaaacttgttttaaattggtatttggaacaaaattctatttcccagtggcagatcaccaactggaggcaggaagaaactcttagggagctgtaactggttgtcaaagattagtgttctgtgtttaataaacatgtctccctaaagttataagtagactggctttagtaaacacataggtagaagttttcgcttctgtcttacacatccatccaaagcatttgtctgtggcattattgtgatcttgtgagataactgtcttccttagggaagagacacattcttacttctagtgtggtctcccctaaccatctgggaaagaggctgctgctgagattgttaactggaactcagaaggtgtattttattcagcaatcatgagttagtgcaagagggtaagatttacattgaacctgaatgtcttagtgattatatggccttgggcaaattacttaatatctgaggacctgcttccatgaagacattacattttcggaagatttactgtagtaataatgtagaagatataataaggagaatcttgatactccaaaaccaactatttggtttgccgcttaatagccgtgagataagaacatgagttaagacacttgttgagagactaacaaagagggagaagaccagagagattattaaacagaatcaataagtttagtgactagttggatgcaggtggtatgaaagaggtaagaccctcagccatgctcaagttgccggaactggttgtctcacatcatttgctgaggaatctgcaagaaaaggtaatgtggagttgtggtgggtgctgagttttacctgggtcatgttgaatttaaggtaagaatgaagaggagtggggaaactaattccaggtgtaaaggtgtagtatgggtttatgtatgttggccgggaggtcaggagaaatttgggagaaatcaactctttatgtggtaaatgaagccatgagtatggtcaaagtcacccaggaaaaaagcacagaatgaggaatctgggattggcctagaccaggaaaagttggctgcccttcaggaggtggggggcaaggggagagagagcattaggacaaatacctaatgcatgcagggcttaaaacctagatgacaggttgataggtgtagcaaaccaccatggcacatgtatacctatgtaacaaacctgcacgttcagcacatgtatcccagaacttaaagtaaaattaaaaagagagagagagagagaaaggaaggatacacagagaccggcagctctttctccgggaaaaccacggcacacacagacatttgtaataagttctaactacgaagcaaattagctttcaataccgggcctatttgaaaggaatttaaggacagacgcggtaacagggctcagccaacaaaagtcagtctttggcctcccacagacagatgtgcacagagtcccctggggatagaataggcaggaacccagatatgctttctaggggtgggtgcccatgtgtgcagtgctgccctttcagtttcttcaggaaagaaaaccaagctttgagtgtcagtgttagtcaaaggctgggcctctgctccaggagatgaaagtggcagcttggaaataatcacatgtgataatccccaggaggaagccagcgacaaggcaactggcagaagtctgttgcctcagtaacatcttcccgagtagcccaaggtgggatatatttgctgtttagactgttgccccacctccaaaaatcatttttctctcttcctctttctctacctttatttctccccacttgtttaatttattttatatatatatataatataaactaaatatatatatatttatatatatataatttattatatatataatataaactaaatatatatatatataatataaactaaatatatatatatatatatatatatatatttagttgcctatttggtattacacattcaaatcttgaattacccaagattattcttttactgtttagcaaatgtaacagaaagacttgggatttctgatttctgattgttttaaatattcggctgaatacaaattgaaatgatttttaactccccttgttcttttgattggctaaaagcgacttcaacaggttgttttaattaactaattcagtacttttataattgtagcttgttcttaatacctttattgtcctttcttctcgatttctttccttttaaatttcttgtactgtaaaccaccaacattctttttcagaataaaataatggttatagtaatactattcatatacttaaaatagtagtagtaataaactaacatttattgatcttttactatgggcaggccatagattttcatttaattctccctaccactgtgaagtgggtacagtactgctgttatcctcattttcttgataaggagaccagagcactgaatgttgagaaacgtgccccgggtcatgaagcaccaaagcagaagagctgggacttgaatccatggaggctgcaaccagagtcccaactctaagccctgtgctatagtgataggcctgtggaccagtccagctttttagctgaggaaaccttgtttcaagttagaggctgaagagaggaaccacagccagtttcagaatgaagactagggcccaggaccactttctctcagtctcctaccctattttaccaaaattttctctcagtatagctttgtcctacccttacataagaatagtgatagttttttatgttagtatttcatgtataattttcttgtttgtatgagaaagacatttcttatgtgtggaagaagaatagatgcgtttttgttttttatgactggagatttttgagcttttaaggctgctgcttactggaagctgttgcattaaccattattgatgtgtacagtaaatgttaggaaaaataccaaatcacattaatcatgggtcttccagttgtctcccagctgaacatgtttggtggctaatacaagcacatcgacctgtagagagcttcatgaaagattaatctgcaaaacagctaccatcgaagtgggaaataattggaaatgagctcaaacctcagtccagctaagagattttgaaattttattttttcaacgcctggttgttgagggaacagtatgtttatagtaaagtagacttttattagtccatcttaatatagacctgattaacatagatcttcatacaataattgtatgtttaatgaaaattgaataccttttctcaactattatcaaaacattctaaagattaaaaatagaaagtaaaaagttatatattttttgtctcaccatctttatcctaccatcaccttattttaaatatatggtttttaagagtcaaataattgttgatatattctggccaatcattgggaaaagtttttttttacagtgattatacatttattaacttatcaaactagctcattaggtgccatgatgtttttctttcttatttttttctgaagacttcatttttttagagcagttttaggttcacagcacaattgacaggaaggcgcaaagatttcttgtgtaccttctacccatgatgtttttaaaagtcaatattccaattagtacactttaaatacaaaagactgaaatgacattagtacttcatagcatattatatgcatttttagatacattaaattatctctggaactcttcctatgaatagcaaatatatgtacatatacatatatatgtgattcatttgtgtgtcttaggtaaatgttaccatactctaagcttacatatagtagttttaatggtagtaagatattttgaataaatgcatgagaaggaaggaatgcaagtgatagttaatgatattgtcattttttcctagctaaaaaaagtccaggctgggcgtggtgtctcacgcctataatcccagcactctgggaggctgaggcaggtggatcatttgaggtcaggagtttgagaccagcctggccaacagggtgaaaccctgtctctactaaaaatacaaaaaaatacacaggggtctcatgatgtcacccaggctggagtgcaatggcgcagtcatagctcactgcagcatcgaactcctgggctcaattgatcctactgccttagcctcccaagttgctcgactacaggcacatgccatcttgtctgtctagttttttgtttgcttttttaaatagaaactaggtcttgctttgttgcccaggctcgtctagaactactggctttaggtgatctcccgccttagcctcccaaagtgctggcattacaggcatgagctacaatgcatggcctgaatacaatctttaaaagcatcttcttcctatttagactatttagattaatacacactgtgtgccattatttggtactttgtacaaagccaaaccgaacaagcaacctgtgtagatgttgtaagcaatttggtcgtcaaattagtttacatttaaaaaaaaaaaaaactccctgctacctgcataccaacctgaagtttcccttacctgtgggccattctcacctctatcttagagttcctccttggactcaagctctccctatactccctcctatttggaagcctttgcatctgggcacggtagctcaggcctgtaaccttagcactttgggaggccgaggcgggcagattgctttaggtcaggagttcgagaccagcctggccagtgtggtgaaaccctgtctctactaaaaatacaaaaaattagccaggcatcatggtgggtgcctgtagtcccagctatttgggagactgaggcaggagaatcacttgaacccaggaggtggaggttgcaatgagcagatatgaggtcaccgcactgtagcctgggtgacagagtaagaccctgtctcaaaaaaaataaaaagaaaaagaaaaaaagaaaagaaagaaaaaaaaagaaaagaaaagaaaaaagaaagcatttgctccatcatgaaaggggccagcacattggcagtcattcctcttcctctctcccaaagcagttcccctccatgtacggcaacaaaatattattttccaagtatgccaacgctttgctgtttaatcctctggactttcactagaacctaaagggtggcttttctggctaccaccttatttcaaaaggactattactctcctgtcattcttgattcacaccaatcacagccagcaacttacaggtacaaatctttgtgtgctgttattttacctggagtcactgggggtttttgcttgtcagagaagtcagcatttccaagagtggagaggagaggaaagaataaattattttgcattgctctaaagtggttcagatttacacagaaagaattcaacatcagccatatcacctgcagttcacagttattatcaactcagactgaaaatgtgcaggtgcttgcctagtgtgaaaaaaggtgcacttcttttgctaaggaacaagctgtgcttgtcactgtttctgaatttgactctgggcactctcaggttagcctattgaagaagccactcactgatcagaggcagaattcagcatgcttcccacagagaaccatttgctcatgttctgcccaaatcacaagtcaccctgctgggatgtctgaaggcgcagatggaaagacaatgcaggacatgtgaactcaagggaaagtgagataattcccaataaatccaaggttttgattgtgtaggtcttctaaggcctattaatggcagttggcagaaaacttcaatagattactgacaccaggtggttagcaacatttcacttttcagcacagaattctttgattttttttctttgttttgaggttagctgatttatttatttttatttaggtaaaaatcacataagattcaccattttaaccattttacaaaatacagtttatagacttttagtacttaggacttttttttggagaggggcacgagggttagggtctcactttgtcacccagcctggagtgcagtggcgcaatcttggctcactgcaacctccgcctcccaggttcaagcgagaattctttgaattttaaagcactaaggccatgaagcaccttagcaatcatttagtctatccctattaattgtacagattataaacttgaggccaagtgaggcccttacttgcctgaggtctgtatagcagtagagccagaactcctgaccttcagtactattgtctttctactagttcaagtcctataatatgattaccaagtatatattttgtctctacagaagatgattattcacctgggaaaaatctacaagcttccaaatatttcagtgcccatccagtcttatccaagggagaagcagaccaagtctcaagactgaccattatgcttgtaatggtggaaatgactgatatgtttggataggtgccattacatgttctacgtaactaaccaagttctcatttctgattccatggtcactgggcaacagtatttttatagtttggcctgttgtgtaggcctgcctatgggaagaaaatatactaatggtgctgaagggaatatttcagtctgtatgataattaaatttttcatgacatttttaataggttggtatttaggttttatcttttaaaaggcatcctaaggcaataattgtattttctacagaaattctattgtactaaaatgtttatatagttaaaacttcttccttttggtagggtatatgagtgaatctgaaagatagcatttcaataattaaaaaagaggactctccacaaatgtttctttgaaatgattatttctttaaaattgtttttctgtcttaattggatgtttaagccaaaatacgggtcatgaaaataatgctacaaatcttttgaagttcacaaactttatttcatgctattatctagatagctgaaatatatttgaggtatctttatgcagatttataaacttacaattatatagttttacaatccaggtaaccaaacatatgtaacactctcaaaatagcatccaatcatatgctactataatttccattactctttgtgaacattctcgtaagtttatagttcactatttcagattacctttggtccaatgtcaaatttattgatatagggagaagaaaggaaaatgaagttaaaatactcttctacattttactgttgcttaatctatatagatagtgactgtggctatttcaaataagctttaatgaacttgcatagaagtgcctgctttccattagttgggaaatgagacaatctttgaaattaacaagataagattgtgaaacatacatacactacattgttgacatttcagaagtgagtactgaactgggaaatgcaggttgtagtgtatgccatctatgagaaaatgcttaagtttttttttattattatttcagttctgtcttagtcagctcagactgttataacaaaatactataaactaggtggcttaaacaacagaaatttattttcttacagttctgaagctggaagtctgagaccaggctgccacgagcatggccaggagctggtgagggcccaattcctggcttatagacagccaccttctcgttggatgctcacacagccttcccttggtgactggaaaggaaagagatcactctctcttcctcttcttataaggccatgaaacctatcagattatgacccctccattatggcatttaacccttaattacctccccaaagccctgtctccaaatgtagtcacatttgggggttagatcttcaacctgtgaatggacagggagggtaaaattgtcctcagcaagttctttgctatgtaagatgccagctccagctgctatattctatagtcttaaaactgattagacaataacatcagttttgacttctcaatacatttttcccaacatcttttgctagattttccctggaagaatcatttataattctcattgcattaaactgctcctcagaggacagatgccaatctccagcatttaataaggtttatatgactttcaacagccttgtagcactctatttggtgggcttaacacaatttgattctaaaaaatatattaaaactgtatctctaatagtcttttttttttttttttttcctgtgacagagtcttgctctgtcgcccaggctggagtgcaatggcgtgatcttggctcgctgcaacctctgcctcccaggtttaagcgattctcctgtctcagcctcctgagtagctgggattacaggctcatgccaccatgcccagctaacttttgtatttttagtagagacagggtttcatcatattggccaggctggtctcgaactcctgacctcaggtgatccacccacctcggacccccaaagtgctggtattacaggcatgagccactgtgcctggcctgtcatttgtttgttaatctccaaatattagccataattctgcaggtgtggtcccgcaactgacttgcaccccaataatatatttatcaatttgagtattttttgcatgtggacataagaaatcactaacagacataacagagatgaacatagactgaatatgtttataacaattttgcctttacggacatgtgtacattttactatgagacacagcttataattttactattcatttaaaacatttactaatgatttaagatgtaggtgccaggcaatgagctagctgctgggtacactgtgggaaaaaatgtacttttgctattaggcgtttactgtttcaggcaaaacagtccaaaacgcatgaagtagtgcatcaagatctgtgagaagaatctccatagcttagagtcaaaggaccaggaagaaagctaacacagactatgaggctttgcactgaatggcacttctaagggtctctttcaaaagcattttcttcctcccacgaaacataaagatcacaagggattataacatgtgcttaaaagcattggaagaaaaactatatacgtaagttgtatttgtgaacttgtgatacccattaacaacccctttctaaaagaatattttcaattgctgcttttatttcataagcaaaaaaaaaagttcaaagaaaatttcaaagataaatataaatgatgacatatttgaggtcttgaggtgactatttttcatcagtgccccttttctggtgctgaagtttttatcttccactctgtcccataatggacaattaaagagagaattttagattaagatctgaagttaatctattcacttctctccatgtccttttccctccccaaccttactcagagttcagattaattcacttcctcagggacactttctctaagccctcagactaagtcaaggcccctcagatgtaggattgccagaaaaaaatacagggcattcagttcaaccgaactgtttgtttgtttgtttgtttctttgtgtgaaatggagtctccctctgttgcccaggctggagtgcagtggtgcgatctcggctcactgcaacctctgcctcccaggttcaagcgattatcatgcctcagcctcttgagttgctgggattaaaggcacgcaccatctaatttttgtatttttagtagagacggatttcaccatgttggccaggcaggtcttgaactcctggcctcaagttatccgcctgcatctgcctcctaaagtgctgggattacaagtgtgagccattgcacctgatggggtacaactgaactttggataagcaacaaataattttatggcagaagtatattttatacgttgcatggaacatactctatactaattattttattgtctatctaaaattcaaatttcactgtgcattctgtattttatttgctaaatctggcaaccctacctaggtatacagtttcacagaaacctatgctttccttcattgtagccagcagatcttgtagtttaatatttttaaggtccttgaactccatgtgtttccaaaaggccaaaattacctttaaagctttttttttttagctcatcattatattcttagtacctaatctagtgcctggcctacataagtatttgttgcgtaaagtaataaatatctgaatggatgataaacaaatacttggataataaacaaatagtcagtgcatatacattttatcttttacgtgcatgctggtgactatttttcaactctagtacaaactttttttactgatctttaaacctttccttagtattgccagtgtctgttttattctgcattaactcccacacagtttggaatgctgtttcctcagctactgttgcattttccatatcatttgccccctttccatcattgtttatgtccatctcatatatgctacttccttcttaaatgcagctccataatataacctcattatgccttttagtacttgtgtcacttctcttctatgttggatcattatttgttgcttttctcattctttacatcagtgttttgaaaacttgcatgtttcctaaaactgctgaagtatgaaaacctgtgcaagactatctgccttatgaggcaggagtttatcttttgtctcctctaatctccaaatattagagatagcagctattctacacattttgctgaattgaatttataatggtaaaacttacatagaattttagggatggagagggtcatgtaggaaggccatttcttcaaatctgttatttaatgacaagaaatgtataagaacaagagctcttggcttttagtctagtgagtgtgtcttctaccaaccatatgtgtcaaatgtggtctttgtttctacggttaaatagatgcagatgaacatttaaccataccaggcctgtttttgtcgttaccgtttgttttgtttcatttgttttgctatttaattctgtgaaggaggggttcgaaatggaagaatattgttcctttaaaagttaaaagtctgtttgaaaactgtatacttcgtagagtgagagtaacagacaatgaagattattctcataggcagaaaacagtacccttaaaatatgtattcatatatgtatatatataatattgagtagttcctacacaattgtagctgcaactgttctaagcatagcctaagaactttttgcaatgttgattttactgtctataacatggtcattatgtattgctgtaaaacactaatgttaagatgtctcataaactagctaaattagggccatgtgtctgttacttgagtaaaataaactagtgctactgagtctagtagtaactaagtacttggcagtgtacaattcttaatcttggtgtctaattatattacaaatgatagatagttgtgttcttttagtaagcttttggaaaaatggcacttttttttagttcattgcttatctaatcaattttatggaagaaaatatttaggaagaaatcatataatgattaaaatctacatatcatgaaattttgatccttagcctacctgttttgaaaagatgagaatttctagataccaattcgtttagattataagatgtcaattactgtttaattgctttttttgaatctaagcataaattattttagatggtctatttatatttatctgacaaaatcaagtatagcagcactgtccccaaaattgttaaaaatgaagacactcggtcggtacaaatcaggagcaactaagatgatttttttaattatattgaatttctcgcaatacaattagttttcctcaaaatgactggccttatcattaaattgataggcatgtggtcaaagagagtagaagttacctatgcctggatttcatttagagagcccaatgccttgttcatagtaagcctttaataaatgtttgctgatagctttaacattttaaaaccatctattccaactgcacatagtcaacaagtatattttttagaatgtgctggcataggttgactctgcttcaatttatatggtcttaaaatatgaactgtaaactgtgaaatagcttttcttaatgtaattttgtttaaccctctgagttgctaccaaaacttggtagcatgataaggtctctttttcatgaagctcatgaacattctttttgttttttaatacctgaattttgctcttttgtctttgatcgttttgttgttgttctttttttgtatttttgttttcaggattcttgtgagtctctaggatcactgtaacatggactcttgaatcctggatgggaagtcctttttgacctcagggagtcattagctcctttcttcttctgggctgtcatctctgtggctgattgacttttctctggatttagccattcctctagtccctggctcttctcttagtttgataatgattgttagagtccctgatgaaagtcttactcaggcagactcttttctgacccaacttagtccctgttattgatttggatctagtccttcaaatctcaagcaagcctcaggtttccatcttgatctatcctgggacttcacttttgcgcctattgataattctctggcaatacaactcctctgtcattcagtggcaaggagtcaattaacttctgctggtgacctatcatttgctaactgttctttcaattacttccctctttagtcacttgcccaaatgggtggcttaatcttatttcactcaggatggtactgaatttcacagaggttaagtgagttagcaaggagtaaggctagcttgaagcaagctcatagttggaacctaggtgtttctgctttcagagcaaaatgggacttcctacattgtggaatattttgttcatttgtttgtttccataatctatgagcagctgagctattggacctctacccagacttacagaattaacatgctgtcttgcagaaggtgcccattagtgaagtagtcaccgttgctgccttctgccatttaaaggaaattgcatctcccttcaaagtaacttttaggttagagctgcatgaatttcagataaactatttaaatactgcaagcataagtcttaaacaagggctagtttaggtcatctacccagaaattttatttctttgtgaggtgtgttgccactataaaagcagtgctggattggatgagaatggattggctccccacaggcactgtcaactatgaggcaattcaacttggaatgttaaccttctcaattatgctttggaataacatcagaactcaattacaaaaaaaaaaaaaaatagacacacatatgtattagctacatatgtatgatactactttctctcattttttaagtatggaataagagccaatttaatacttatttactgagttaaccaattctgaacttcttaattgctttagatcattctgactctgaaatttccagccaattagaggtcagaagctgctcaactgttaagctgtacactggatacttaaggagaaggtgtccctatctgacatgctgtcaggggcaaatcaatgctgatcaatattggccatctagagtactgatggcttactaactctgcctgccttgtatattctttaattcataacaatgcagagagggggaaatcacttgaagctggaatgggtttgggagctaggctttctcaactatctcacctagtaaacaatccacttagaaatctaagtcatcagaagctagagatctgctgctaacagcaatagcaacagcagcagcagcaacaaacaaacccaagaatagcccagcaagcatcttgccttataacctaagcattttttgcacagctgattagatttatacttactttttgatagaattgtaaaccaaccttttcaaatttaactttatatttgtggttaaatggaatctaatcaagcttttaagttactattcaattatttatttaaccagcattctgtattgcagactgatggatcctgaaataacactggcatcatgcatttggattttcacatattacctttcctgtgtacagaatcttaaaatcaaaatggtacttataaatctgactatctacttggtttaggaattttccttatcatattccaaacaagtggctaaccatctccatgaatactttcaataatgaaattcttatgacataagaagccaacccatttcttctttcaacagctgtctgattattagaaagttcttcctttcttttgcatttatcgttatttaaagcaagttcaatcatcctggatcacgcttttgagacagacgataaattaaaaatgataggagaaacatataaagtattttaatttaataagttcaaagtgttagataacattgggggcagacaaggaaagtagaaagtataaaatagggtctttattctcaggaaccttagaattcaattaaagatacaataattgtaataagtcagtagaggctgggagcagtggctcagacctgtaatccctccaagtgctttggaaggctgaggcaagaggctcacttaaggccaggactttgaaaccagcctgggaaatatagtgagaccccatctctacaaaaaattaaaaagttatccaggtgtggtaatgtatgcctgttctcccagttagttgggaggctgaggtgggaggattgcttgagcctgggaggttgagaccatggtgagacgaggttgtgccactgcactccagcatgggcaacagagtgagactgtctcaaaaaaaaaaaaaaaagtcagtagagcctacaattaaaaataaaaagtaggctgggcacggtggctcatgcctgtaatcccagcactttgggaggccgaggtgggcggataacgaggtcaggagattgagaccatcctggctaacacggtgaaaccccatctctactaaaatacaaaaacattagccaggcatggtggggggcacctgtagtctcagctactcgggaggccgaggcaggaggatggcgtgaacccgggaggcagagcttgcagtgagctgagatcgcgccactgcactccagcctgggtgacagtgcgaaactccatctcaaaaataaataaataaataaataaaataataattaaaaaataaaaatataaaaagtaattatgtagacattgcatgctacagggcttatggaataatcagtaacacattgttatatgtggtgaagcttgtgttggtccttgaaggacagaaatgattttggcaggttgattagaaggcttatatttgcaagaaactgagaaaaatgacgtggctggactcagtggcctacttcattttattttattttttttataattttgcatttcctcactttcattttattttattttatttttatttttattgagacagggtcttactctgtccgaaggctggagtgtagtggcacagtctcagctcactgcaacctcaacctcctgggttcaagtgattctcctgcctcaacttcctgagtagctgggattatagggacctgccaccacatccagctaatttttttgtatttttagtagagagagggtttcacaatgttggccaggctagtctcgaactcctgacctcaagtgatcagcctgccttggcctcccaaagtgctggggttacaggtgtgagccaccgctcccagcccctcagtggcctactttaaaaagaagtaagaaataatgagtatagataagactggaacaaattatagataaaaggctttgaaggtagtttgccctaggatcattgaggaaatatgtaatgctttcaatactaagggaagacactactttacaattttgtttaaaataatgtagagttgagttgtccaatatggtagcagctagccacaagtggttactgagcacttgaaatgtgactagtctgaattgagatgtgttataagtataaaatgcatactggatttcaaaaatttaattagaaaaaaagtaaaataacttctaatacttgttatggtgactatattttaaaatgatatgttctggatatattgtgttaaaaaaattacaattaatttcacctgtttctcctttttatatggctaatagaaaagataaaattaaacctttggcttatattgtttttctgttgggtagcactactataaaaagtgtcagtctcttatttttagttgtatgctacctgagtctatcagttgcagcctaggagataaccgagaaactcagatggtaattttgatctggcatttgttcctttatatgtaagttttgtagatactactgtttactctgcaactgtctataaattcaaagtaaagtagcgtgctaagaaaattacacaatttatcacatatgaagttttcaaaagcctaggatgtaggaaacagtctagaaaaaaaaatttaaactatgtgcttatgtgatattattgtttaattgtccgtgtacgtacagtctattactgcagttatttctcaacagactgttccaatggtgggtggagagtaaaattgacagttcttctaatttgatgtataaatctttaaaaaaatatacataaaaataccagttcattgcagaaaataagaatagacaaatatgttttatatatacaaacacttattgttcttattataaatgaaataaccaacgttaatcatttgttactagtcagtgggttattggccctcagaaaatagaaattgaccaacagtctaagatgggattgagcaaggcagtttattggggctttcagcttgagcagaaggggagacgacaacaggaggaaaacctgcagctggctccttggaagcaaactagtcttggtttttattcttctctgggcctcttccaggtgacatcatcacatatttggagtggaccattggctgtaccatgcctcattagcatcttaaatctctacccaggcctgtgattttttttttaaatttattatactttaagttctgggatacatgtgcagaacgtgcaggtttgttacacaggcatacatgtgccatgatggtttgctgcacccaccaacctgtcatctaggttttaagctccacatgcattaggtatttttcctaatgctctccctcctcttcccccccaccccccgacagggcccagagtgtgatgtttccctccctgtgaccatgtgttctcattgttcaactcccacttatgagtgagaacatgtagtgtttggttttctgttcctatgttagtttgctgagaattatggtttccagcttcatccatgtctctgcaaaggacatgaactcatccttttttatggctgcatagtattccatggtttatatgtgcaacattttctttatcaaatctatcattgatgagcatttgggttggttccaagtctttgttattgtgaatagtgctgaaataaacatacatgtgcatgtatctttatagtagaatgatttataatcctttgggtatatacctagaaatgggattgctgggtcaaattgtatttttggttctaggtctttgaggatcttttcttttgtttttttttgagacggagtcttgctgtgtcgcccaggctggagtgtgatggtgcgatctcggctcactgcaacctccacctcccaggttcaagcgattttcctgcctcagcctcccaagtagctgggactacaggcatgcaccaccacacctggctaatttttgtatttttagcagagatggggtttcaccatgttggccaggttggtctcaaactcctgacctcaggtgatccaccctccacctgcctcagcctctcatagtgctgggattacaggtgtgagacaccacgcctggcctgatttttacaattaaaatgaaacaaatgttaagttaggacaaggtaagtttctacacacaaatgcatttgaggagagtctttcaaaaagtgcaaggttatagagctgagagcaaccatagtcaccacagtatgtaaagaagtgggaaaggatcccttgtcctgtgttctctgtctcagttttggtgtgtgcatgtgtgtatgtgtgtgtgtgtgtgtttgtgtgtgtgtataataaatgtgggatcaagcagttttataattagcttttgtcactgaatatattgtaaacatctttctggtcccataaaggtacttttaaaacaatggttttcagagttctagttttattattgttggtacacttatttcaaacagctttacttagaatctcaatatataaaattgataaaacaaagctagtctggcagaagcaaagttggagtactggaactctatctgcctggccagcccattatatcttacttcatggtcatctaaggcactgcagagcacagtctaaaaatgactaatctaccactatttttttgatgtggctgtgttttattcgatgtgttaatttttgtctaacatgatataaatgtttctcaattcatagtttcccttccagttttgacagttattattgtcttggtacgttaaaatgtttaccttttatgtaatcttgttttctcaggctatcactgactgtcagtaagcatgataaataacccggagaagtgaagtttcaagattaatactctgttttagaaaagggactatcactccattcatatacaaatacatagctatttaaagagagaatagcttccagtctttagtagttttgcttccctgtgaccacttattcatttattaagtctattgcttgacttttcgtttttttttttttttttgagaccaagtcttgccctgtcactcaggctggagtgcagtggcactatctccgctcactacaatctctgcctcccgggttcaaacgattctcctgcctcagcctcccaagtagctgggattacaggcatgtgccatcacacccagctaatttttatatttttagtagggagggggtttcaccatgttggccagtctggtctcgaactcttgacctcaggtgatctgtctgcctcggcttcccgtggtgctgggattacaggtgtgagccaccttgcctggccagaacttttcaaaaagatgattttagaggtaaagtcagagaaattgaaaagaggatcaacaggcctggtgtggtggctgatgcctgtaatcttagcaccgcgggaggctgaagcgggtggatcacctgaggtcaggagtttgagaccagcctagccaacatggtgaaatgctgtctctactaaaaatacaaaaattagcccagtctggtgtgcatgcctgtatcccaactacttgggaggctgaggcagaagaattacttgaaccccagaggcagaggttggcagtgagccaagttcatgccattacactccagtctgggttatagggcgagactgggtctcaacaacaacaacaaaaagatcaacaggaacccattatttcaccaattatctctttgttaaagtatttgcttcatgttccagtgataatgatgacttgctccttttcttaaacatttgtgtctttaattagattgttttttaacttttaaaatagcattactactagaactttagctttcaatcagctttgcttagatgtcaatataggctgtgccttcctttttgttatggtggaaattattgttatgcctattattgttaatgaatgaaagtgtccagctgagtattctatgtatttgaaagtatctaactgtgtaaatgggattccacatggcatcctgctgtccaatctacttgaatgagctttgtagaaaatgtattttggtagaaaatgtctgtgaacccaagggcacagctgatgatgtgaaaaatgcatatccagacaaagtgaagaaacagtatttttatgctttcaaaggggagtagtgtttatttatttttcaagttgtgaaagccattgaatgtagaatgaatattattactttttcaaaaagtgttttaatttttctttcatcggaatttatttttttcttactatgtacatccctaaacattaaagaaaaatttctcaggcatgggaactattttgttttgtagagttaattataccatttaaataattgtttaagataaagatatgtggcttctgtctttctaagacacaaattggacataacatttacatagaattcaaatagtattaaactttgattattgtggattatgtttttaaaaaagatttttacatagtaaataagcaagagaattttcactgagttagtagttttatagaagcagatataagaacatgctattaacccccaaatagtattaaactttgattattaaattatggattgtgtttttaaaaaggatttttacatggtaaataagcaagagaattttcactgagttaatagttttatagaagcagatataagaacatgctattgaccctcagggattcaaatccatggtccatgtggtagatgaatgtatttcaaaggatggtgaataaggaggcatacttaatgtgaatctcctagtttctcataataccttacaagattaagagtcacctacaaggtctgggattattatggagatctgtgcatttctgctaggcattaggctcctcatatttggataacacatacaagggaagtattattacctagatgtaggtgtttgggcccagtgataaagctcaatgataaagctcttattgattgggtatacctgagacacaggtgtattataaaacattcaactattagttgatttctttcaaaggtattggatgtaactcaatagtatattcaatcgaccttaaattctacatctaaaatatgatggataaaatgcaaaatgccctcatatagccatgaatgcttactattaaacttagctgttatagcaatgataacaatgacttttttttacctaggagtgtttaaaaacatttccattatctaattccttatctgtgtcagcctcttcctagtcctctcaacagaagaaaacagtgacttgcctccttaaaattgctacttaattataaacaatccttgctctcttttagtctccccctcaaagaacatttttaatatctgccagcaaaggctacttttctgagctcttaattctttcttttcacaaatgcgatagctagaaggatctatatcctcacagtgattcatgcaaaggtacctgtgtatttccgttgtattttaagaagtcagtgccatggaatagaaagaatgggaggattcaagtttaaaatctggtatcctagtcccaactctgtcaatgactagctattttactttagttaaattacttgtaataataattaggttaatcgttacagagggatgccatctcgaatccatctttatttaggaagaaggttataatctatatgataatatgactgtaagtcaatcaaaattgactttttgcatggttcttggagaaaaattaggtcaatagaatcttctatattgtcttaccatgtacttgtaaggatgttacgttatatgtatatttttaatttttttaaatttttttattttagagacaggattctactttgtcggcaaggctagagcgtggtggcacaatcctagctcactacagcctccaaatcctggcctgaagtgatcctcccacctcagcctcccaagtagctggggccacaggtgtgtgccaccatacacacctgtgtaatttaaaaactacacagctaatttaaaaaaaatttttatagaggtcttgctacgttgtctaagctggtcttgaactcctggtctcaagcaatccactcacctgggccttccaaagtgctgggattacagtcatgagccaccacacccagccacattatatattttaaaacgatgtaaaatttggaaaatactgatcaaatgcaaaaaaaaaaaaaaaaagtaagcattctcagtccttttaattactgacctgttaataaagtaccacctggataatgctacttatcttagtctttgatctgttgcttatagcagaatacctgaaactggataatttagaaaaaaaaggaatttatttcttacagttctggaggttgagaagtgtacaaagtcaaggggctgtacttagtgagggccttcttagtggtgggaagtctctgcagagtctcaaggtagggcaggacatcacatggtgaggagactagcttagatctctctcctttttcttataaagccaccagtgctactcccatgataatccattaatctactaacccattcatctattaatctctgaataattaatccattcatgaagtcagagccctgatgactcaatcatctcttaaaggctccatctctcaatgctgccacattgagaattaagtttcaacatgtgtttcagagaggaacaaacattccaaccactgcattattgttcttgctttttccttcaggattacaggcttttccctcagaacacaaacaggaaaagcccactcctatatcacataaaacattctaaaacatatttaaactcaaacttttaattctttgttatggatctatttttactgggttaggcaaactttagagaaactgctcatagtgttagtgtagggagtctctgaatgctggaaggtttaaaagtacaaagtgagatcctcatgccctgacttttcttcagatcgaataaatagcttatgttttggggagaagaatagacctgagagtataattaagttgctgatgctttgtttccttgaatttccatgaagtatcaaggtcaatcttgctctgtgaatgttttctctctaaagaaagaaaactgtcaagctggcccaggttgaggcagaactatgcaaaggatgtagtatgacctctagttaggtagttccctggatctaaatttccctggcgacactaatgtgaccgtgtgtgctttccatagtatggaaatagcatgccccttagttcatctttttagtgcccatctatttcctaaagtaagaattaatgtaataagtcaatttatgcttactattgtctgaatgtttggtctccccccaaaattaggtgttgaaaccctaactcctaagttgatgatattatgaagtggaacctttggggaggtgattaaatcacaagggagcagccttcaagaatgggattagtgctcttatcaaataggcagagagcttattagaccctttcatcttgtgtggacacagcaagaaggcatgtttcatgaaccagaaagtggacactcaccagacaccagattgtctggcaccttgatcatggatgtctcagcctcctaaactgtgagaaataaatttctgttgtttataagctgcccaacttagagtatttggttatagcagctcacatggactaagacagtgctagtgtgtattaggaaggaagatggggagcacagctagtttcttgaattccttttaggtatccttgctttttaaacctaaccttttagagggtataccttaatccatagaatgaatcactgagggaaaaaagaatgctgagggaatttcaggaagcatgatagacagtgcaggaggtcatgaaatctggcctcactagagcaattttcacttattttacacttctctcttatacaaaactcccttgattcagggaatctgagaactttgttccaatgcttttgtgcatctatttgttagataggtatctgtccttaagctatctgtcctccttttcatttttctaataatcaaatcttctatgattcagtcttagtttatcttgccaaattaacctctcattgctgcttactacagtctctctgcattaacttaattattctgcctgtcctgtccagagttgaattcctagtgcttggcactgagcctggtacacaggaagtgtatatttaattaataaattaatatattacatttccatatctctgagtcttggcccataccattaacctcacctggaatgtactttccttcctgtctacctattttcaatctacctccatagtcaactgaagtaacactttggtgaagctctctttgcattcaaaggctgcctgtccatatcattcaagtctgttttgcccctaagtatgctgttgccttacatgatttttttttttttttttttttttttactttattagtcagctcaggcggccataaaaatatcacaggcaggctggcttaaaacacaggaattcatttttcacaattctggaggctgggaagtcccagatcaaggtgccacccagtttggctccccaatgagtacactcttcctggcttgcagatggtcacttgcttgctgtgccctcatgttgcagtcacaccaatgcaccacaatgtagcagtctctcgttgcccaagatatcattcaaagttctttgtctcatggccaaaaaaattaaggagctcagacaccaagggtgaggttacagcaaaagtttaataagtgaaaaaagaaagctccccactgcagagaggaggcccaaaagagggttgctgtttcacagttaaatacgacgcttttataaaaaagcagtgagggctgggcatctcatttgcataaggcacacatttctggtatctccaccctgtcctcctagtgcgcatgcaggcccttagcttgagttagttgctccatatagctttgttcttcttactgtgcatgttttaggggacagaattttccattgtgggcatgtctgggaaagtctcctgagtagcctttcttgtctatgtggctgttggcatatcttaggcaagacctgccccccaaccatgccccacaccatgcaagtttccctatctgtgcctgcagtttaatttttcaggctgttttttgtttgaaataattttactgaggacccacactaaccacctgcctgacaggtttcttcctcttctcctactcctatggggaagagagagaatggaagcaaactctctggggtctcttcctataagaacactgatcctatcatgagggcttcaccttcacaacctcatccaaacctacttacctagcaaagatcgcatctccaaatactatcacattgagggttggggctttaacatgtaaaactggggtggggtgcggggaggagttgagtgtggaaaaaattcagtccatagcaccacatagttttttactttgttcactcttttgtactttccaaatgttttgaggactgacaccctttctctgcctgctctgccggaagcctgcaacacaacagaagccaactccacaatagaagccacttaattttaagtagtgactgattgttgtgtttttctcatgttaaactgttacaccaactgtactgaagttttatatttatctgaaagtcctttttactgggagtaaataatccatagacttcctttaaatggttctcactaactgcaatgtaatcaaaatccttcaggaatttttcaaattacacagatctccccgttttctgcttccccataccacaagattctcatatgccaagattagaagataggcggagattggcgtaaatgcacatatactcactgaaatccaactctcccaccctctaccatggagagctatttgaaatgaattcccagaaagactaaatagtatgtagaatttactctctctctctctctctatataaatggtggaaaagtgacttgcagactgacaaacacaggaactgtttggtttgtaagaatttatagataaaggctatctgatgactggaaatttataaatacatttcagtagactttttagtctcttctctaatgattgctttctctaccttatgtacatatgctgggggaaaaggtttcaactctgaatcagaagacttgggtttcaggacagactgctgctcactagctttgtgacctcatccacattatgtaatttctctagcttttgaatttttttttttaacctatgaaatcaggctgttagaacagatgacctccaaagctcatgaaagcttcagcatatgaaaatatgaatagatgatctcacaaatcagtagttctgttttatcttccttcatcattttattagaggcaaagatgttaagaaactgatagctatagttttatttttttggtggcagcagtggtatgtttgcctgctattttgaagacattataaaccctccaggaaaattagccatggaggtgagagagtagagaaaataaaagacagataatcaactacttaataattgagaaatgcctgtattgcattctaggcttaagtccagaaatagattcatttctaggtaaaggcattttgctgttaattaaaaaaaaaataaataaataaaaaaacgttttaaaatgcactaaattattgctctagcaaaaatatcttcaaaattgaatccaggatttacataatttcacagagtataatataaatgtagttgttttcatgaaatgcagatttttgctgcttcaggggaaaaatatcagatttccaacatacacgcatggcattattacaaaatgcttgtttagataaaactggaggcagaattttttagttatttagttaggaagatttttatatcaggtttttcataagctaagagttgtgctggctatattttttgattacacatatctatggagttggccaaaatttcagcaaaatactttttagctctaagtagttctctttggctattttttcttaattttaaaatatatggctaaaatatatgttttatagagaccacacatagagacaaaaaacatatggaatggcaaaacaaatgttttgtccacattgcaagtacctaaattttataggacatgctgatggtctataaatttaaaacttttagctgagctgccatttgttcttttaatcagtaagtgctaggattgagcagtgataaaatttgtaaagaaaatcttgggatttttttacccccatatgttttacatatcctcgtcagataacccaggaaggtataatgtatttaaaagatgaaaaaggaatgggggctgaggacataaaagatggtatgagatttaacttttgagtacagaatagccctagtgaagttaactagcttaaacagtaaaatgccccttttttgtctatttttttgtaaaatgctttcaacagctaaaactattcaacaaagaaaaattattaagtctcataaataaaaaaatgatgtaacccaccctgactattaatatgttatgccatactttaaattaattttggacatctttgatgaacgtaagtgaagatatttgaacatcccagggataaaaacctaggacaaaggaccagatctggaaagttcctgtccttgaagagctttcacaaacaactgtttgttctgggtgatttcaatattcactagaacagtgcttctctctgtaatctggaaagcaaatacaaaaacctatgcaagggtagctgtgcaagatttgtttcttggtcccagattaaacgcactgaatcagaactctgaggggtaaggccttgaaatcggcgtcagagtggttctctgaatgattcttgttcacacttaaattttagaattactgcattagagacagatggcagaatcaattatcttttcaagtttcagctgtctagcctactacaaatgcatgaaatgaagtcattactgagtgtctacatggtagaaattaagccaaaattcaatatttatataaaattatactttttctttaaatcatttacagttattttcatggacatatctaatcttatattgagaggattcttgccactgtattacttgttttttcaaaggaatattccacatatgaaatattcttcagtatccatgtactgttgctttgacccagactttctaataaaacaaggtgttatgacatattaagcctatttggaaacagatatcttttgtgatgtcaatttttctactttagataatatttatgaatttcctatagcaaatgaaatatggcaagctggcttactaaatgatgacttggatggcttttattggggaaataaaaaagagattttatcaggtgtgtccaatcttttggcttccctggcccacattggaagaagaattgtcttgggccacacataaaatacacaacactaacaatagctgatgaggggaaaaaaaagtcaaaaaacaaaaacaaaaagcagaaaacttataatgttttaagaaagttaatgaatttatgtggagccacatttaaagtcatcctgggccgcatgtggcctatgggccgtgtgttgtacaaccttgttgaaatcctgttgtgccagtcttccctaggttaatgtatgtctgtacgacagtttcatctccttcaaatgcctcttaaaatatcacccctcaaactggatgtacaaatatactaacttcctgaaccaaaaaatctggcacattcaagagatattatgcgtcctctaaggaatctgactagtcaaaggaattctacaggactgggcattctaggctttgtgttttttggtttgtttaatttaaggagaccttcttcactttccccaataaaccactatctgaacagtaaaagagttatgcagcatagagggaaagtggttgtaactttactcactgtgaagaaacaggtatgttaattaaaaggacatggcatcagcaatcatctggaagggccatcagcagtatggtatttaaagttattaattgatctagatctgttgtttggaaagcttagcactaggttctcaacattttgtctgactgccaagctaagctgtaagacaggggtacccaacccctgggccacaggccaataccagcccgtagcctcttaggaaccggactgcacagaggaggtgagggggtgcggatgagtgagcattaccacctgagctctgcctcctgtcagatcagcggaagcattagattctcataggagtgcaaatcctattgtgaactgcgcatgtgagggatctaggttgtgcactctttaagagagtttaatgcctgatgatctgaggtggaacaatttcatcatgaaaccatcccctacagccccgtttgtggaaaaattgtcttccaggaaagtggtccccggtgaccaaaaggttgggaactactgctataagagacagttattcaaaaaatggctggttattaggcaataactagagtcatgtattgcttaacaagagggatatgttctgagaaatgtgtctttaggtgatttcatcagtgtgcaaacatcacagagtgtaattacacaaacctacatggtatagcctgctacacccctaggctttatggatacagctgatggcttctaagagacaaacctgtacagcatgttactgtactgaatactgtaggcaactgtagcacaatgtatttttgtatctgttagtttggtgcaaaagcagttgcgagtttagctgcaatgaaaagttatgtcaaaaaccacaattactgttgcaacaacctaatcaatgtatctaaagctagaaaaaaaaagtacagtaaaaattcagcattgtaatcttatgggaccaccattccgtatgcggtccattgttgactaaaagatcatatgcagtgcatgactgtacttctatgattacttagacttttctttttctccttcttcctcttaaaaaaagagttgtacctggaagcatttccggaatttgctttccgttctctgggtcttgggagatacatgtcagtgaaagtactgggatggacagagcactgcattttcatgttttactgactgatttagcattctgtttctccccaccttgttcattctaatttcctatctaattctttgtttttcccttttgagtgtcttttgctattattccacgcttggccttgaaatctcaatgattaaaatgtctgagtacaacccctactgatgttttatataacatcattaaataaataagctatgcaagtattgaatttcacacaagagtaaagaatgggtgtatagggcagtaagaggagatgaacaaactgttatcacataaattgctgaaacgtaggtccacccctagcacttcaggcaactccagacattaaatattggatgcaggattcatggcctggctttctatctgcccagcttgcagaaatgcctttaatctttcctggtactctaaatatacgtataacagtaatcattacccccacagttccaagcaactctctcaaagatgactttcctttcttgaaaaaaataaagcaattagaaattcagaattgattacattgttatggtatttttattttttttaactattactactaggaagccctcataatccaaaaaagtttcaaatattgattcgacttttgatatttcaagttattctcaagaataaaatatgtacaatattaaaaataattataacatcaagttttagagaagaaatgagaaaatgaacactcttgtagacctgctgctatgtaaattgactcaagctttctagaaggcaatttggaaatatgtgtcaaacattttaaaagtatgtgtacattttgatgtagtaactccatttggattaatttattctgaagaaataagtgtgcaaaggtatgtattcagggagattcattacagtttttattttttgtttaatagtggaacattggaaacaacaaaaataattagaaatagggtatttaattatggaacaaagaaattaaaaactggtgaattaaaaagaatgaattaaactcatattaggtgaaaaaataacattaaagcaggtgactgacatgattttgtaaatatatttatataaacgtgaatatattcatacagaatgaaagtctggtaaattatgcaaaaaaattagccatggttatttcctggtggtgagaatataaatcacacattttttttttgtctgagttttctgtttgtttggtttgcagagaatctgtattatgtttgcttctttagtttaaaatattttttcttaaaaacataattatggtcacagagattcaaataactaattgttttagtggaagcatctcatcaactcgggctagggggtattgtccattagaataataattattttgaaaagcaagttttgaaattaaataggcaaaatggagattgatggctaaaacttccttttctcagtaatgtaaagtgattgacaaagaaagtaaacatcataaaggtacttatctgattacttttgctctccagtctaattttctctgctttggggctcagatagcaatgttaattggcagaactagagtgcatcagttagtaaaaattatcttttcaatagaatggaccatacaaagtcattgtttatttaatacataactcagtggatttgactaaaataagtgttttagtcataaattacaattccagcttggcatagaaataaactattgctcagttttcctgtccaactgcccaattttagttgtgtttatttcttgtttaaccttgatttatgctatagttgactttctccaacattttttctcagtttaataaatcaatattgatttgtattataccaggtaaactgtttcttcgatttaatatctcacaaaatcaatatataatttataatgtaacttctctgcaaatacagatttccatagatccatggaatcttgattcatggaatgtgggggctattcagggtactcaaaagctttagttcctgtaactgcttaaaggtgcatcagggatgctctgggaggaagtttgtgactgtaattgtatctttctgcttttaaatgaaaattttctgtgtaccaggctcatgatgatgagctccatgaaaatgtcaaggtttaggacatactagggatcaaaaccagaacaaaccttaagctttttaaaaaatatgatttacctctttcctataaaatttagcctcttaaacttgtttcatgctatgatattttttaaagttctgataaaagctagtgtacatatacacaaatatgcatatgtaaatcacattatatgtataccatgtaccattattcatctcatttaattctcacattgaaatattattacactcctcttttacatttgatgctttaaggcttagaaagtctagattacttaagtattacacagctggtgtgatgcagagctagatctgattcagaagccttagttcccagcaactatgtcattttcaccctcaaactcatatgtaaacccagttaaagaatttctatattagtaagtggaatatgggagaaaaacaacaaagtacagtcaagtagaaggggagccaatatttgttcagctgttaatatgtgcaagacactttacttacattattgtctcagttgctctttctaaaaaccttgttggagaggtggagtctctgtttggctactttctggccctgtgattttgggtaagaaaattaagcacccatttactacctagagagcttaatttacttacccaagctaccagggccagtaagtagccaatttgtgatttaaactcaggcttctttagctctataacacatgtttttacactttgtgtatcactttgcctaatgagatacattgcattttgcttttttcttcttggagtatcaattagaaataaacatataaaaattaaatgggggaaatttctattttttccccttatactatattctcatcaaacattgtaatataagcttttgtgagcaattaaattcttagcctatccttacggttctttccttatttaaattcaaaggccaaaacatatattcaatttaaaattctcagtgaatttaaaccaaagtctcagaagtgtaatgggtttttttaagagtacagtatgcttactcttcacacaataatattttttaattgttattgcaagtaggaggtgtttatcatatgaaagaatatcaattaaatcagtggtaatagctcaatccttgaatttaaaaatattattcattcttattttaagcagttactttaaaaaaattgcaattggcacaaaactaagttctggaaactgtgtcccaaggattgtttaaagaagtactttcatgaagaaagaggtcagtttaaagtaatacataagacagagatgagatgcatttttcattatatacctaaaagctcataaattaatgtgcaaatggaagtatacaagcctgagataaaccttttaagacatttgtgtttggttggttgattttaggaatattgttagtaaccaagctttaaatttatttaacattctattttatcagtcttaaaatactcattttagtctttttaccttttctccagaggatatgttagtatatatttctgtatataatttttaaaaatttgtttcaaaagagtatggttttagctaaatgactgattggaactctattacttttgtattttgaaaagttgcctgtttatagagctacttgcaggggaggttattaagccctgtgatttatgacaatacaatttcaacttcatctttcaggcaaaatctattctggtagtgatgaatttatcttgtagtaactggttgttttagtgcacaaatactatagcggtctaaagtagttaatggtcttcaaagattgctttattttttaagaatacttcaagtcagaagaagatgctggcttaccttcctttagcttacttatattaatatttcaaatagatgctccccaaataactttctcctactttgaaagggcttatgacatggacattttgaatttaaaaatatggtagctaatatgttgtaagacttgcacaaatctgagtagatgattttgtgaagggaagcgccttctcctttcatattgttgaggaagcccagttctttaattattattattattattattatttgtttattttttgagacaaagccttgctttattacccaggctggagtgcagtggcatgatctcggctcactgtaaccaccacctcccaggttcaagcgattctcctgcctcagcctcctgagtagctatgtttacaagcacccaccaccacggccggctaatgtttgaatttaatagagacaggggtttcaccatgttgcccaggctggtgttgaactcctgaccttaagagatttgccagcctaggcctcccaaagtgctaggattacaggcgtgagccactgcgccagcctgatttttcaattttgataatttgctgtctttccttcatggttaccctttatattattttctcacgttctgtttccattgttattcctttctttattttagttcaaaccccaactacatcattatggtatgaccttcagcaagttagtcaacctttctcagtcggtttccccactgaaacaaaaagaaaatattaagagtacctatttcagtgggttgtgagcaaacaacctggtaatgctggggaaaatgtttatctacccaaagacccctgattaacattcaaaaaatgatgttattttctaagatatttctaaaaataaaagaaaataggtaaaacagtttagttgtctattatatttgttggtgagaactatagtgtatttgtcttctaattccacttagtggttgtgactgtctagaattagagtaaatgcaaaatgcacacctttttgttaagatgtctgtaccaaaaaatctaatagatagctacaaatacagggatagttattagaatcagaggttagtgagatagtaatgggacctgacgactatttttaatacattttaagacccagtataaattaatgaatcttttatattaaatgacaaagcaagttaatgatcacctcatcaatgaataactttctactaaaatataggccgggcatggtggttcatgcctgtaaacccagtactttgcaaagccaaggtgggcagatcacttgaggttaggtgttcaagaccggcctggccaacgtggtgaaaccccgtcactactataaatacaaaaattagtcaggtgtggtgggacacacctgttaatcccagtaactcaggaggctgaggcacgagaattgcttgaacccagaggtgcaggctgcagtgagctgaggtggccccactatactccagcctgggtgacagagcaagactctgtctcaaaaacaaaacaaaacaaaacaaacaaaatgcttaaactttagaagactatatgatgaggcaagagcaaacatggtcttagatgtttggaaatcctatgccacggaagacatttgaagtcttatagaagctctctgcttgataatttaacagaaagattgtaatcgttttaaaaacaagtattagagtgataatccaatgattcttgtgattagctcatttaatactcccagaatagcaaacagaacattatagtttactttttaattggctgatttgtacaactttgccatggactgataaaatagtagtctaatttgtactgtagtaagatagtgataagtacctgtttggtgtctactatttgacagacactattaggtgatttacagaaataatctttcatcttcacaataatgccaggtatgcattattatgtctattacaaagaagaagcatttgacattcagattggttataaaaagtaacacatctagaaagtactggaaatacccttcaccctccctcccgagaaagcttcttctcattcccacaaaataggatgcacatcttttgggttcacatagcattctgtgcatctatcattagtctattctgtttattttgaatagactttattttttagggtagttctattaattgtttcacagcaaaggaatgtgcagagatttcctgtatactcccttcccccacacatgcatagcctccctcactatcaaaatcctgccccactgtcgtacatttgttataattgacatacctacattgacacatcattattgccaagagtccatagtttacactagggttcactcttggtgttgtacattctatgggtgtggataaatgtaaaacatgtgttcacaattatagcaccatacagaatagttttgctggcctaaaaattctctgagccctgtcttttcatcactcccaacctcaacccttgatttttttactgtctctatagttttgccttttccagaatgtcgtatactgtagttggaattgtatagtacatagccttttcagattagcttccttctttttgaaatttgcatttaagcttcttttatgtcttttcatggcatgatagctcatttatttttagtgcagagtaatattccattgtttggttgtaccatagtttacatatccattgcctcctgaaagacattttgattgcttctgatgactgttctatcttaattctgattacttgtgcctttttcaacagtacattgtttcttcacagtgtaagctttacgattaaataacttgacatttccagttcctgtcgtggtagcctccccatggttctgcctcaacagatatataatctggaatgtgccacattttgccagactgtgaggatataggagttaacaccaggcatgaaagcctacattttggtgatgtttctcccattaggtctttataggggttctgagaacgtagaaatgttctcaggtcgttgtgatctcctgctcaatactgactaattggcaaattatttgaagatgccgcctgctgttgctaccagtgctactgaccagcagcagaaagctgtgttcctactttgggtgctgcccttgggtgcttctaaggcagcagaatgcagggggatgcaggatgctgtttaatgccttactttattttgctcaggttaatttagctttccatttggtagaagaaaaattaatttttaaaagaagagaacataattttaaagagtgaattattcttagttttaaattccacaaaaaatgtgtggtgagtgatataagactggatttccattttctgaaccttctgtggctggagacagaaacaaacataataatttataaatttccagaaataatcttgtagctgtaagagtagatatgatatttacctgtgggaaagtttttccttcttctgagagatgtcaggacaagcaggatatctgttccttgttcttgggatagtgatgactttaatgaagtaatccggatgtcagtacttcagagagaaatccctacatattttgattaataaagccaaaagctgttctactagaaataagctggtaatctttatatagtttttgtgttttttgaaaagaatatgaaaagatggttggtttttcttttgcactggaaaagaggtattcgggttttctcagaatgaagatggagaaacagaaggaacagaactttaagaaaaggttgggattgttaggtatccatgttttaaccagatagtccagtatttgccctatatttccataaaagaaccacccattaagtggtatgtttctgaataccgtttttcattcattaggcatgtacaatgtactcttgatcctgttaggtacttggttacaagaattccttatatggtttggtattttatttgaaactttatgacaaccctacttggagaatagatcttctgtctttcctgtcctttgtcttaggcagcaatacacgaatttttccttgtgggtcccctgtctaccaagcaaatcagctcatgcttatacgcctctgggagataccaaagacagccaaatccaaatcccaatgtaaagtctcctggacaacccactactattaagtgtgaatgattgagtcagcatatgaacccaagtatatctgactctaaagattattatttttttcataaaacagtatgtttcctttaatttgaaaatttgctattgagccaaaaatcatatgataaaattaactacaccacacaacctactgagtccttgaaaggccttctcccctgaatgaacagaaatggctgaagagaagaccctaactcctggaccacctagcccatttagctctgatggcacctggctaatgacttctcagctgtctcctgcagagcttatggctgtttgcagttgtgacctggctctgcattctgaatgtttttaaggagcgactggtgacatttttttcttttttaaattggggtttactgtggtttgcctaccatagtcatttcctggttattgattttgatgttttgctacttcattttatgttgctcaatgtccatgagctgaattgcctggggaaaaactactttggcttttaaaatagttttccatccaagattctgattggcagaaaaggttgagggctaaagtgagcctggttttgatgtctcctctgtttgatgacctagttgatttagcctgaatctcccattttgagtttggcataatctgttcttttagttacaaaggagtagaaaaacttaccgcgtaatctgattctataaaataggtagactttttctggtaacatagtctgctgttaggggtgggttttaaataagcagtagtttgtaccctgtcttacctttgggttgagtagtgtttgaactgagcatcatagtgggagatgaactttaagtgtagaattttcctcctttccctacatactttcttcataaggcacagtgatttttactgggttttatactagaatgaaaagaaccttcaacaaactggaatacaatttggatgctgaacaataaataaataaataaattttggaagactctgggtaaatcacatatttttctgtcttcagtattttatcaaaaagacttaaaaacattctaaagaactttaaaatgcatatttaaaatacatgctcatgtacatgatcaagcaaacattatgcagccaatagtcttaagctaccacataacttgtaattcttatttataaaatcgtaagtaacttttaatcatttctggaccctataattgagtctgtctctgtgttaccagttcctcaaattaatccatgattgacttggtttgttagacttgtttttacttagctaaataatttgatgctggatattgtacttgaccacagattgtatgatacagtagctgatgattggggaattttcttccaataaaactgcgaaggtcattaagtttgttcctggttatttatttgcaggaaatgttgcattccatttgtaaaccaagaagatggcctattttttcttattcatgtgaaacaggtgtcatcacataaaattttgacatagaataagagcaaacgttaagcctttgaaagaaatgtttatcatccttggaactgcagaacttaaaattctggaattttttgaagtcattttatatatcctaaagacaatggaaatggcgtattgggaaagaaatgtctcgttggatggggtggtgtttaagatattcataatgattactgtgttctatctagagaataattgttgctaaaacaaattttaaaatctccactttttgatataattttcttttatttttccccagggccaaatgccctttctgctttacaaatattaaaacaaaaacaaaagcaaaaacaaaaaacagacatctggatcatttcaatcatcaaatgtctttgggtctgcatgtgtatttatactcatgatcccaaatatgaatagtataggcgtaaacaagccattggttacaaagctttcgtgttatgttgtcattttaagaaaggctgtttccccaaaggcaagagggaaattatagcaagtgcagttttaggcctctacagttatcccagattacctttttataaaatgttgacagcctcacaaaaacagtctcactgtgccgacatttggaagcagacaagcattgcaaagtgtaccatcataacagcaatggtttgggtctctgaaaaatctttttatactgttcacagaaaattgtttttacccctttatagatattcagccaaagctttatattcccctttagaaaacaagagctagtacaagcactcttaagtagtcacagctggaattagcactacttctgtccactggagaggggcaggaaaagtaggctgtagcaagtatgtttctatgtctgtaataactattgtccttgagaaatccagagggagttagaagtccctgtaattcccttttacaaacaaatcaagtaaatagttatatgtgaacattcaccatcagttatgtctgcaatattgggcaaagtacttattaattttttctttctcctcatcatcacgttccccctcacttcagcccccaacacccattgtatttagttcagtattgccttagatgttaaaaaaaaaagtatcgaaatctgaaggggcaaggttgttctatatgcaagtcttaagtattgtaaaaaatgcaatagcaatagagagatgaagaattctattaaatcaagtattaatatttaatcttatacagacacttttctctcatcctaaacaaggactgcttaactttaagcacttttaaagaatatataaaaagcaaatacagatggtcctcaacttacaagggttcaacttatgattttttgactttacaatgggtttatcagggcgttaaatgcgtttttgacttacaatattttcaacttaccatgggttatcaggttgtagcctcgtgagccaaggagatctgtacacaattattatagcttgaatgcaagcacatcagacccctttctttgtgtatacaggtaatgtttatttaatacttacctgtgccaagcactgtatcttcatatcatacgaggcaggtacttctactagtctaatattacagatgaaactgaagcacagagaggttaagtaacttgccccaaatcacacagctagtaagtgacagagcttggacgttgatatggtttgactctgtgtcccaactcaaatctcatcttgaattgtgctcccataattcccatgtgttgtgggagggacctggtgggagataactgaatctgggggtggtttccctcatactgttctcatggtagtgaataagtctcacaggatcttatggttttatcaggggtttccacttttgcatattccccattctgtctttgcctgctgccatccatgtaagacgggactagctcctccttgccttctgccatgattgtgggccttccccagccatatggaactgtaagtccaattaaaccattttcttttgtaaattgcccagtcttgggtatgtctttatcagtagcgtgaaaatggactaatacagacctgtattcaggtagcctaactcttgagtcctgtcttttgacgcctgtgccgtattgcttctcactgtacagtagtaagattgccaggtgattcatatgtacatttaagtttgtgatacacttatcgaaaactcttagtattaaaaaaagtctcttttagaaaaaaacaaaataaaactattctaccccaattaattaaattgcctcctgattttccttcaggttttgaatatgttggaaaaagagtaaataagacattctctttgctcttgctcctcatggtccagttataagctttggcatgaaattatataagcttattcattttccttagaccaatggctctttttaaaaatatttatttattttttgagatggagtctcactctgtccctgaggctggagttcagtggcatgatctcaggtcactgcaacttccaccttctggatttaagcaattctcctacctcagcctcatgagtagctgggattacaagcgtcccccaccacgctcagcaaatttttgtgtttttagtagaggtggggtttcatcaccatgttggccaggctggtctcaaactcctaatttcaagtagtccacctgcctcggcctcccaaactgttgggattaaaagtgtgagccactgcacgcagccagaccaatggttcttaaatgtgaatcctggacaagcagcattcatcaacaccacctgggaatttaagtgtgtacgtgtttaagccccagccaagacctactagggggctggggcccagtaatctgtgttgtaagaaccctccaggggattttgattacctctcaagtttgagaaccgctgcctaagttttgaaacagcacaatatttgaatattattaattatacttcaccatagagccttcaataaaaacattgttttgcaactgagacagtttataaatgtataggaaagtgtgtgatgtgaacttgtttcattgaaaacaagccacagtcctaaaaataggaacgtagcagcttcttgcaaaagtggctaattctttggaaagggttggctctggggtttgccctcttgccatcttggttaactctttctccatcccttttgacatttcattatatttggttgctgcttttaacactccccttgtgaaaggccttcctttgcttggttgactgatatgttctttccctgctctggctgagtttgccctttgacaggcccctgacttccccatctccacagcaatcatttcctcagcggccctgcagagtctcttagttgtgttctaataaagattaaatacatgctgtgcatgcaggattgggcccttcagctcttctttatgccattgtgtctagcgtggagatgagtagccttcctgaaaattgcccatggaatgcctttttcctcatggtatttcaatgcagtacacatatgtagctgtcccactggattttaagcatcagctcgtgtgtgttctggtgttcttaaaccagaagcatacgttggtcatctctttcaaagttaaaaagcaaaacaaaacaacaacttctacctgccagaaaggatgaatagttttaccctgggacatttctaaggaaaccagaatagttttttacttgtttaagaaaaaaatcagttccagtgtgttttatatttggtgtaaatcctgaaatgattgtcactttgctagttattggagcaacccaattgaactgtgactgtatctacttctgataagctacccttagtctacatgctttattcaggcattcacctacaatatgattacagtattgaacttccttccctggaaataagaaacagttccctaaatctaaatatgactctatggtttcattagtgtcaataaatttagcttgaaaaataatcatagcttttggaataaaaaattacattcatttttgtttttgcctctcatctttcctttttaatattaaaaggccaagtgtattattaatggaaaaaggctaatttgtgacaggtgagcaattagtgtaaagactatgactaattaaaataaattttcttctcattttttttagaatccaagttgcttactagggttgttattctttcttccttctttaggccataaaattgcaatttgattgttattatattaagatatttgggaacataacaagtcctcgttagaaatagcttcttgatttcttcttcttttttttttttttaataaatatcctaaaaagactaagtttgttctcctgcctctacccattctcaagtttgagaattggtcagtgggaaccagtgcatgaaatgtgaagggaagatcaggagtgattttgagtataacctctagtgtttccaggtttccatgtttgtcttttgcataaacctctgtccactgttactgtggcataaccctgaccatggacgtttttcttgttctttgttactgtttcctggttggaataacaagaaaagaaaaacaaaatgtatggaaaacactgatcagggaagctgaagagctggtaaaaagaaaaacagaatgacaaaattggaatcctaaaacatattcctggctttctacttgaacgcaacttgtaacaacttaatgtctatctattatattattgattgacgttgaagattttacattcctttttcacaatactaagtggagacaagataccagtaacattaagaatcaaggcagattttgttgattatctgccaactctgcatagtagagtctacagtgaactaaggtgtacttcagctgatggctcctgtcaacatgatgccatgctcaatacatgtctgtatttgaataaacatgatggtctcacgccatgtttaaatacataaaaccaaattgataaggacatagtatgattaagaaagcactcattactacttttgtcggtgactgggagatatctcattcagccaatatagataaatagatcaatagttacttaagatcataacttgtattgtctatacaacataataacgcatctgtagctagtaatgacataggagttatagaacctgagctgtactgtctccacctttcagagtttgctgcatctttgaagcaggtggcattagttatgcccaagaaaatagatctgaaattcctgtaaatctgtagctaacattatttccagaatgtatagagtcaattgttagagatgtgaagtatcagaatggaataaacagtatcaatgaagtcagagaaggtggaaagtttgttgataacttattaatttttggctaagatctactaaattgctgactaggtgatagaacatttggcagtagagcaatctaggctggtggatctgttatttctcggctgagtggtgagacgccttggatatgttttaggagtgtgtggccttgagctcgataaagagtatcttgattttggggatgggactcaataaaaggaaataaggaaataggattttttatttctagagttataaagtaaggttttgctagctttgtttgcatcaggaatttgaccagccttcttttcttcacttgtgtagctcctcctcttccaggcctaactgtaagcactttttccatggggaactcttccctcaccactagggctaggtttgatgttcctgtgggaggctccccacacactctgaatacgtcagttgagcctggcactcaccacactatattgatattgctttctttattgatctctcttctactaaaccattgcaaacttttagaagaggaaatatatgtgtcttgctcactgtcatagctatattacttggcatttaatatttcctaaatatgtattgtggaacaaatatttcattactttcaagctttacttgtgacttagtattttccttcttgtatcaacacttactaatgtttctacttagtgtcttgagatccttaccacttagtcataactttcaagaaattcagtcagactgctttaagatttctagaaatatgtccatccttaagtaatttgcctttaaaataatttactgtgtataaggttatgcattccaggtttacgatttagaaaatataaatattaaatcagtaaaatattgatctgaacatttttggtcattgtggttaaaattatgtgatatgaattgggaatgtccttgaaggacttacagaagatgagctctatagctgaacctttggttggataatcttcataaaataagttaatccctctaagccttttgtctactgataaaattgaattgtaacctgtttttatctaagtattgtttcaaaaagttaaagccttttaagtaaagccctatgaaaattgtcaaattttgttcaaatggcttcaagctttcagagtttattatcctttctgtattatgcatatataaataagagccctgtgcttatgtcagaattagcaatatgtaaggtattgaggaccccttcatgggcttgagacagagaccagattcaatctagtctaagcaacaatgtaacttaatcaatcatacttaaaggaggaccagggatgggcagggactgggcactggaattacattacccagcatggtagttccccaaggaagagatgctgctggcagaacaacaacacatccatggaagcctcagtagtggccaggcttaagagtttagaagtaactctgctgtgtatatttatacctatcttcacctccatttagtaagtatacattctcaaatggtgcgagcaaatatttgactatccctggtctgccattccctgctgaaggagttggcgcaattatgttaaccaagggcagagtttattaaagtcagaatttgggaagttcttatcaaaacaattattaaatattatcttttgctcttattttaaaaaacaaaagttcacaaactacttattacaatcaaccttcagaataactcagttttgaggcttattacctatgaggtgaggcaggcatgaggagatgacacaaagagaaacatacttagttacaactggaatttgatggaaggactggaggagaaaggtgaataatgtgtcaaccgacctttgggtttatgtagttgagcaagtcattagggagactcgataacactctgagtatcattgtgttgtacactcacaattggtgctattgtgtggagagaatgctcaatgcatgaaaaaggagtatgtttagtgtgtttaaacagaatctttctagaagtcattcagatttttttcctatggaagataccagtgatccttttgtaaaatacagattccactgtgtctttcacctgtgtaaataaggatgatcagttttcatattgcataatcatacaatcaacctctgcattcgtgtcaattacagcttatttttctaatcattgttgaatgatcaattttctttgcaacactatgtgtcttccagactagaaaaatcacaagaaggaaaatggcattctcataatgtgccaaagcagacaattttgaaaatgtaaaacagctgagctcacttgacatttcttgatgtcatctgccagcagagaaggctgttagagagctccttttcctggtgatttttttcccagaattctgccaaacttagagaatgacatataatttactaaagagaaaatgggccaaaatgggacatttctatttcaaagtctactagcgcctagaaaataaacgccaaatagtattccatctgtttcttttaagcagccttgtcatatactttcttaacgggacctagatagaaacattgttttcatatttagtgagaacttgaaagggttcacaaattatggctgtggagtctagccttaaggtggcagcgaactgaggtgatgtagaggtatatgacaaaaatggaaacttctaaagcatgtcaacagtgagctctgcaggagagttacagcagggggctaatagacatataatcttgatgcttcattttcccttcaagaaatgagattaattaaggatatgtcaaatatatggcttctggcatatgtacactgtttgcagaaagagaagcattctaagaactgactaggaaaaggaaaatccctcctttgggagaatacattttaataatgtttctgagttaaagtcacatcgtttaacttgtaaggaatggttattagcatgactttttaaagatgtttgcttgaatttcagcaaatatgtaagcatatgttgtcagcatcttggtgtagtatttagggatacagcctatccaactgacaaaaggacttacagatgtaatactcattttcctaatgaggttcaagccaaaatctgttgttatgcacagatgtgcaatgacatttaccaaacatgtgcagatatttttgaagtaggcacactgttaaaaatggcccacctgcaggaaattgtgtcatcatgagagggttgccacaaactctatctcagtagcttgccagaggctgaagcttttgaccgaatctcaaaatgtgaggtgtttggagcttcactgatgtgagatggaccctcctacatgttgaagagcctattgcaaatggatctcattagtcaatggccactcagcctctgattccttttctaaaaaatcacagatcatctgtttaatattattgattctagaatgtttctgggttttgacatcaattgaattatatgaggcctgtttatgatggaattaagggctaccctaaaatgaagagttaggagacatttatgcctaagagcaccagacaggaatatgtatgagttattcattcagcaaacatttatagcctttattatgtgccaggaacagaaaagacaaagatgaacaagatgatacatttcttgccttcaaataattctgtgcttctgtatgccagttttcttgtctttgccaccttattaacacaatatcagtcattctctcttttttttttagatggagtcttgctttgttgcccaggctggagtgtagtggcaccacctcgagtcactgcaacctctgcctcctgggttcaagcaattcttctgcctcagcctcccaagtagatgggattacaggcacccactgccacgctcagctaatttttctatttttagtagagatgggagtttcaccgtgttggccaggctgatgtcgaactcctgaccccaagtaatctgcctgccttggcctgccaaagtgatgggattacaggcgtcagccaccacacccagcctcagtcattctttaattttccctcttaactttgcagcctgtctaaatctggatgcaatttaccagaatgcttcttttattcctcagagctagtgagccagttgcatgactactctaaacttttgttctttcttttttgactctcttagaattcattgtcactacccaatatgttagtgctaatttgttctctgtttcctatgtacttataagatggtaataccattaaaagacataaatgaatggattatattttaggtgtcaggtgccatgctgagtatccaccatgagttatttcactcatatctgagaatagtttcatgaggcatgcattatgatatctgtttcctaaaagagaataatggaagcttaaattaattgcccaaagccacatactcctgtatggtgaagtcaaaatgcttaaacaggacaaactccaaattattgacttttagtgtcctttatttcttttgaatcccctagagtctttaaatttgttcatagagcattgatcttatgagacaccatttcctttattaaagtcaacacgtggtatcaccttttttctagacatctgatcttttgatgtagagtctgtctctaaaccatcagtgttttagtataatgcctcatagttacttcaaaataactatcatgaatatactcaatcatatagctgtatgcctcactcctctctgcattgatccttttgcttctgtaaaatgttatggttcaattgctcctttgagatgatccaattcaatttaccatccaattcagtaatcctgtctctgttattttattagttggtctacttgaacacttcctataatggaaaacttcttagcacaagattcaaccattgctatactcattttgtctctaaattgaatcttaataggcaaccctataagttctaattactagtcttaattctgtactttacaagttagaaggaaatcactcttaatccatcagaaacactatctggtcgattcattcaaatttcatttgagatggaatagttaaggctgttagcttaagatggaaaaataaaataaagaaaaatatgagtgtataaataaagaggaaaagtaaagaaagttagcctgtagcaactaggagctatttgagagcaaggtctgtatcttgtttatcttcataccaccagttcctggtatagttcttggcacatagtaaggtctcaaaaatgcctataaaatgtttgcaataaatctcttaactcttgacttcagggtagcccttaattctgttataaacagctcctctgaatttacttgaagtctaataaacccatcaaatactttaggtcttttactgacttttccctttctcttatacaggatgactgtcctcaatttctaatctttttcacagattgtttcccctttttaacccagtcatttatttaatccgaaacatctgctgaacactttagaactatcatagatctcagagtagaatatggtaccgatataactcaggtatatgaataactatgaagccgatataactcaggtatatgaataactatgaagcaaggtatagtggcaaaagtcactaaggagacacaatcagaaggttgcagacatttagagggggaaaaattctagttgaagtgaatgggaaagtcttcatagacaaagtggcttttgaactgagcctttagggactactaagattgctgtaggtagaggaaaataactggagtaaagacctgatggcaggaaaaggatgggtggatttggaaactatgcattcagtccattgactgaaatatgttatgtttaagggattatgggagatgaagctaggaagatactcttaattagagacgtgaattaaatgtaaagatgaatagattttgttttatttatggcagtaggaagaagctattgaatgtttggtgggtataatgatgggattagcatagtgctttggaaagatcaatctagtaggactgcttggaatagcttatcactttcttaattgtgtttctttgtaaacagctcacaagtgattgtgtgatctttactattcttgataagagggaacttgtagcatttttatcttcataactctattattatctgtgggcttcttgactcctcctttcactcttgatcccgtgtttataaccgatttacacagaaatctacttatttcttagagaaaaaaaattcctttttttccctgttcttttgcctaatatacctgacctttgcctcatgccagggttgttttagatgacgtaagttttatttattctttccgcttcttccccacttcgtcagtcaattcacagcctccattaccagcttttcatagtgctgagtttccatagattttcaagtactttaattgtggcttaacaaatgtaagaatatagtgtattgttattaacaaggagtgcaaggagaaagactgggacacttggagcattccttgtttccatagccttattctgcatcttcaaaacatgttacttattagcacctattttttggtgcctatgggtgtccgccaaaatggaaaaaggcaagaattgattttttattggcacatgtgatccctcacatccatctatccctgttgccctcaatgcctgccatcacatgaactctggatggttcacacagctttgacttttaaagattacttcttcaacactgttgggagttactgtgcctaaaaattagagcttgtagaatgaattaaaatgcttattcagcttttttactgaagaccacctaaagacagagggtagttctgagctttctcagaaaaagtcagtctgtaaagagtaaaataagtaaatatttcttctaatgtccagacattgctgtataaccacagggataaacaaaaatcagagaatcatggcattattaagtgaaaaaaaaaggtgctagtgactatctccaaacaaatggagatgtaagaactgcccaacaaataattcaaaatctctattttaaagaaggtcagcacactgcaaaaaaaaaaaaaaaaaaaaccagaacaacaatttaacaaacagaaaaacaatatgaccagaatgagaaatataatggagagattgaatttttctaatcaaataaatcttagagctgaaaaatacaatgagtgaaatggaaaatgcaatggagagcatcagtgcagaacagaagaatctgtatgctcagacaggttattaaaaatatatatagtcaaaggagaaaaatgatggaaaaaagaacaaaaaacttgtgaaatttatgggatagcatcaaaagaatgaatgtacaagtcataggagttgaagaaaagaaagataaagaggaaatagcatatttacagaaataatagcagaaaacttttcaaacctaaagaaaaatataagtatccaagtacaggatggtcaaaggtctcccatcaaattcaagccaaataagactactgtaagacataatcaaactgacaaaaatcaaagacaaagagaggaaagcagaaaaagaatgaagtaaataacatatacaagaattccaatatgcctagcagcagacttctcagcagaaatctgtcaggagagagtgggatcatacattcaaagtgctgaaggaaacaatatattagataaaatacatttttgttttttgagacagagtcctactctgttgcccaggctggagtgcagtggcatgatctcagctcactgcaacctctgcctcctgggttcaagcaattctcctgcctcagcctcccaagcaggtgggattacaggcataagccaacacatccagctagtttttttgtatttttagtagagacaggatttcaccatattggccaggctggtctcaaacccctgacctcagttgatctgcccagctcagtctctcaaagtgctaggattacaggcatgagccaccgtgcctggccaataaaatacattttaagtcaaaaactttacaaagaaacaaagaagatcattgtataatgataatgggatcaacccagcaagaggatataacaattgtaaatatatatgcacccaacatcagaacacttaaatatataaacaaatgttaatagctctgaagagagagataaactgcaataggataatagtagaagacagaagacttcaacaccctacatgtagtaatggacagatcatacagacagaaaatcaataaagaaacccagatataaagtaaaacctagatcaaatggacctaacttaattgtacaaatgttccatctaacagctgtagaatacttctcaactacacgtggaactctctttagcatagattacatgttaggccacaaaattaattttaacaaattttagactattgaaataatatcaagtatttctgaccaccatgggataaaagtagaaatcatttttctactgtagttattaatatattgtatatatagtgacagtagttattaatacattgtattcttgaaaaatgccaagagaatggatgtaaagtgttctcaccacaaaaatgatgactatatgaggtattgcaattgttaattagttagatttagtcattctacaatgtatacatatgttaaaacattatgtggtacacagtaaatatgtataattttatctgccaatttaaaaaataaaaaaaaatagaaagtaaaacaaacaaaaaacacatattagtaaaacaagctaggctttggagtcagatggaaactaactcttttaattattatatatgtgacctgggcagtaacttagcttttctgagacttaatttgaatatttatagaaaggagataggactatttcataggattaacatatgttaagcaaacataacaaagtttcattatgcgtagtaaatgttcaataaagataccctaaataatgatcattattatgaacatatttgtactaaaatcattatccacttggtccttctagtatccttaacatttgaaagtcagtttacattttagaatcattatgttggtgaattggtttccaacaattattggaagtcaccattggcctttacaggttactttctacaaggtatgacgtcaaacagaagttagagaaacagctattttatttctatctccttcattaattacagggcagcccactcccttccaatgtatgaatatggtgacaacattgatggtaatttttcttactattaagtatataataatgattcttatctgcagtgtccaattttatgacccatcctctatatgtcattgaaaggataacttttccagttaagaaaggttaaaatatatcctccaaactaactgtgaggcaatttgtgcagtggagacattggcatgctccagatgcatagtaaacagcaaatggcctttctaattatgaagcatttgtctcagaacattccggcagttagaatttagctttaggctaacatatgccttaataatgttgggaagcagttatgcgcttgatggagcccctcaaggtctctcccaatcttcttattctgtcacactaagtatctgagtgatcacagacgagtcaagcatcagtaaagtgggggtagaatacagcttctgggattccttgagcatatattaaagtaccttatgatgtgagctgatattctttaatggtaaacatgaagtaggagaaaaagctaatcatacttttccatgtctttcttcctgtgccaagccctcaatttctggtctatttagaaaaagtatggatcagcaaacattttaaatgagacttacctactatctgagaatgttccctgaaaaacatggtccaacttgagaaaaataattcactcaggaattcttttaagaaatttcaactaatgttctactgcaggggaaacatgttcagacacaactaaaattgaaaaccagttctctcctaatagagattatgacggtctgtggtgatttgccaaagaattataagaatattttatttagttgaaatgtttgacacacaaaattcaattcagagtatatttgatgaattctcactttgttatattccaaggaacaaaagaaatgtgtaaagaaatgattatctgttatgagtgttgttattctagagcagcactaaccaacagaaatgttatataagcaatatatataattttatattttctggtgataacattaaaacgtaaagagaagcaagtataatgaattttactagtaaacttttattttacccaatataccaaaaatattattattttaacatgtaataaatgtaaaattattcctaagttattttacatacttttttcataccatcttctaaatcttgtgtgtaacttgtgcatctaatttcacattagcctcattccaagttctcaatagccatgtatggcaaatagctattatattggacagtgcagattaaaacatatcaagggctaagcttgataaaagtttagcacagaagggtctggaaagggaaaaaatatttaaaaggtactgtgctggttaattttgtgtcagtttgactgggctaagggatacccagatagctgataaaacataatttctgggtgtatctatcagagtgtttcagacaagatcagcatttgaatcagcagactgagtaaaatgatccactctcaccagtgtgagcaggcatcattccttctgctgaagacctagttaggacaaaaaagtacaggaaaggcaaatttgatttctcttcttgacctccataactgcatagccaacttctttcataaatacccgcttatgtgtctatatagcctgttggttctgtttctctggagaatcttgactaagattgactaatacaactatctttgcttggagtcttgcaagcatatgtgggagttttagaagacaaataggtggaaagtcattctaggttgaggacctattatgaacaaaggcatggagtaaaacaagcttttatctggaggggtagaggcaggcttgaagctggggaagacatggggaatgtcaccagtgcctgcttatggaatttgaattgtgccttaaaaactctaggtatctgagtattttttttttttttaaatactgatgtgagacttctgaaaagtaaaacaaagcatgaaacaccatttatttagttatctagccaagtaaatacatctgatcacttttgtttattgtagtaaaatatatattttttacttatatatataatggttaggatgataaattttgttatatatataagagaatatataataaaatatatattatatatctttattatattatttataatacatattatattttattttataatgtaatatatttatactatatttataatatacagattataatttattatatcattatacattatatataaatatagaatatatagataaatttgttgtatgtatttaatattaaatataatattttattatattattttatgttatatataaatatctaatatataaatatacaaataaaatacatatgtaataaacttttattttttatatatatctaaaatatatcatcctaaccattctgaagtgtacaatcaatcagtgcctttaaggacattcacattgtgcaaccatcactattcatcttcataactttttcatcatcctaaactgaaacactgaacttattaaagggtagctcttcatttccccgctccttcccagcccccagtaactactattctactttttatctctgtgaatttgactattctaggacctcatatcagtggaatcagacaatatttgtctttttgtatgtggcttatttcacttagcataatgttttccatgtttatctatgttatagcacatatgagaatttcattcttttcacaagcctgaatactatttaattgtatgtatacaccacattttgtttactcattcatcccttgaaggacttctgggttattttaaccttcagctattgtaaataatgctgttgtgaatattaacacacaaatatctgtttgtgttcctgctttcagttatttggggtgtatactcagaagtaaaatttctgaatcatatactgatcccatgtttaattttctcaggaaccaccatatcattttccacagtggctgcaccatcttatattcctaccagcaatgcacaagggttccaatttatccacatcgtcaccaacacttactattttatattttttaataaaataatagccatcctaattggtgtaaagtgctatctcatggtgattttgattggcattaccctaaggttagtggtgttgaacatcatttttatatccttattggtcatatacatttatcttcttggccaactttgataaaaggaaaaatttttcccaaaacataaaatttacttggctgatacttcataatatttgtgaagcttcatcttggccttctaatattcccaaagctatctgagtgttcaggtgtttgtcctgggactcagcctggtacatttatttctagactataaatatctgtaggaccatgtgatttcagaatgtttttaagataattatgcttttttgttatagcaaggaaaattttgaaagcattagaaaatactttgaagataatagttttatatttataatgtagaaagtaaaagagaattacaagctaattttgctcattgcaaatcacttaggttagtttataatgtgcacggttctcaccccttaaaatggggtaattttgctaatacagtgctgtctgcacttttgaataatatgaatgcagcattcattattccactattttattttcactcatatgtctaggctagaaagtcgaatattagggtcaaattccctctacctgacttttcctatctgtttaagatccttaatatctttcaaattcatctacctctctagcttctttgccattaccaaggtccacccacctgaataattccaagagctgctaactaatctctgtccctgtcttggtctctctctctgtctctatttctgactctgtctctatttctacatcggtctttcttccctgagtcctgtcctcctccagtgcaccattaggtactactagcaaaatctttctgaagggaatcatttgctttaaacccttccgtgcccccctcttcattggcctcagtatcaagttataattccgcatcaaggcacacaagaacctttgccatctaaccattgttgctttccttatcacttctgtctcacctctgactaccccctagcatctcagcatccctggaccacttgaagtttcctccaagggacacattttcttctttgtatatgcaacgagactcctcattttggaaaacacttgtggtggtagttgtggtggtggtaggataacctcaaaaatatctagcaatccccgtggcatacttgattctggagcaaggtctgtgaggacactgttgagctcagtattgacactttagttactgagctgtggggatcctaggagatactgggggaaaggctgggaagggctgtcagggaactcagggaaatggctgtttactaaatagtataaaagtattttgatgttttaacaagtggcatgaccctagggacacagaccagctaagtactagccctgccattgccactcccactacctctttctctgacctaatttttcctccaggacttgcttagagcaggggctcttaatcttgtgtgtgggtgtcatggacctatttgtcagtttggtgaagcatatggaatcctctaagagtaatctttttaaagacatgaaataaaatacataggataacaaagaaaatcatttatattgaaatactgtgatgacatttaatgatgaatagtgatataatttattaaaactaagatctagagtcagctctagtaactgccataattttgaagtagtgatgaatgtaaattatattaagatatctgcagcaaatataggagggtataaaaatagccgctgtttctattggtaacaaatcatactgtggtttgttgctcaaatttttataatcataggaagaaatgctaaatatcagttatagtaaaaataagggtgctcttttttctccctcatgttcaagaatctcttgagttccattgacagatgttttggagctccatagatgccagatttcttagtcagttcggactattgtaacaaatacagatgctcctggacttgcaatggggttatatcctaataaacccgcatgagttgaaaatattgtgtaactcgaaaatgcatttaaacactcaacctaccaaacatcatagctttggctagcctaccttaaacatgcacagaacacttacatcagcctacagttgggaaaaatcatgtagcacaaagcctattttataataaagtgttgaatatctcatgtgatatattgaatactttactgcagtacagtttctagtgaatacatatcactttcacaccattgcaaagttgaaattttttaagtgggaccactgtaaatcaagaaccatctgtaccatagactggatggcttaaaagacaaacatttatttctcatagttctggaggctagaagcccaagataagggtaccagagaggctggcttcttgctgatgcccctattccttgttaggtcctcatatggccttttcttggtgcttgcatgcagagagggagatcctctttttctaaggacactaatcccatcatgtgtgctttacccccatgatgttatctaaatctggtctcatcccaaggcaaccaccctctgatagcatcacattggggatagggcttcaacgtttgaattttgggaggacacaaacattcagtccctaaccctgggtgtagcatcctagcttagatgattcttttctgcaaagccttctttaatcatctcttctcagctcctccccatggaaagtatgtgttgccttttttgtgtattcacagccccagaagcttaccccatggtagcatttatcccttcatttgtttttctcttgtactagaccaggaatcagcaagtattttctgtaaagggctggataggaaatattttaggctttgcagtacatatggtctctgttgcaattactcagttcagccagagacaatatgtaaatgaatgggcatggccgtgttccagtaagacttttatggacacaaatttatttatggacacagaaaattgtttcatacaattctcatgtgtcacgaaatatgctttttaaatttttcaacgatttaaaaatacaaaacccattcttagccagtagactgtacaaaaacagaccatgggccagatttggcatggataatagtttgtctacctctgtactagatcacaagtttcttgagggcagggactgtgaatttgttttctatcccgtagatctagcaccagtgtttgccatattggtataaaataaatatgagctgaataaatatttgagtctataagtgcattatacttacatatgcttcccaatattcttccagaatttgagttgaacaacagatgaattcctcagtagaagaacttaagccaaatccagatttgtggtctcttagtctagcacaattttatggctccttcctctgtaatcttggtgtcccctaaatgaaggccaactgtttcatgcattgaagttgttctcaatgtacttgtgtgtttagaggtctcagagtaatgggagtttattttccactgagtgggatgtatgtgatcttaacctgagaaaatgatatacgtttcagcaaagaattttagatacatacttgaacaaaaaggaaaatcacttcccagcactgtctcagctttataccctttagacttaaatgttcaacagtaatcatcatgaaaatcacaggaattttatttgtgaaatgcttattccctatggagattaacacatcacttaagatcaaaggtgaatgaagagatatatttttgaatggtctctgtaagttaaggaagcaatagatttacactccagcaggctagttaaaaagcaagatgttaatcacaactctaatataaccatatttttgataataagtcaaggtgattattagtcatgcttgtccatctgtaaaaagctgacttgactaatatgtatgttggccaaagctaaatataaaaatggttttggtatcatgcccaaggtcatggacaaatttgcaatctcatcaagctatgtttattatcatgcaaaatatctgaactacagttttacctagagacatttaaatagcccatgtaaacaggaaccaaaaagtaaaatgaaattattgaattctgtcaatttattttttaaagtcatttttcaacacatagataatgaaatctgatacattcagtttagatattttgatgggcatcagatgctacacaggcttaaattattttgtgggtttttgcaggtgaacttcatgtacataaagttcattaacaaatttgcctaatgcctaccaaatgaaatgctaatttctagtggaggagcagagattataagagatgagacagggacttttctctgaaggcatatacaaatttatataaggaaacatgatacagacctgggagagagataacaatattaacacatgctaagcaccaaggagagaaacagatagaaaaaagcagcaattcataggacaggaagggaccagggtcaatgcctgggcttgaggtgcgaactcagacttaaaatgctgcagatagcttggccacaataaatacgtgtgcatgtgcatgcactacccccaaaccgtgcagcaacactacggaaagctcagccatttcagtctcttttcctggtagactcctgagctcatttccaactgtgctcttgtttatgtactttccccacccagttactctttgcccacctcttttgtagctcagctcccaccactttttaaggtcccacttcctgttccaactcttaggaatcctctcctgatttcccaagttctttgtggctatatcatccagtcttactgtttgtctcaagtaaaagggtattgtagaaaagagtctggaggcagcagatgtattagaatctggctgaaggatacctgcactacctttgtttttgatgaagtgtcatttgtaaaaaaacatttagaatggagccaggcacacacaagttccggctgctttgttctatttctacttcagtgagcatgttttgttttttctttaatatagagttggccaaaggaggagtcatattctagttttgcagcttaaatgttgcaagaaaaaaatagatacaattcaaagatgggtttactctggagtacaatattcattcctcttatcttccttctcccctgttcgtttgtgtgtaacttctagctcctccccacaaggcacacacatgtcctaattcctctgataacttttcttctcctccttcactcccaaatcatgatccatcacattcactgggcttagtcttgagaactgtgaagcagagaaaattgcgctcttctgtctttctatgtttggctcaattaactatatcctggccctattcaaagctcttcctcagactacattccccatgactatgatatttgaattgtttttttttagttcatttgctagcttaaaatattttatgtcatgaaaatttgaaaacatatataaaagtaaagagaataagaaatctctcatatgccatcacaccaatgtaataaccaagatttttaatgtgctcattttaaaagtgttacaaactataacatttgtcttttaaacttctcttagtcatgtgcttaatagatcaaatggtgaagttgtggggtattcagcttcaacatttaattatgcattgtcaaagatagtggtgcataagagaataaattaaaattcaacaaacatgtctactgaaactaccacgtggcaactttgggcacagatttcaatttgtaaaacgagctttgtgtggaaatcattgtgtaactattatttctattatataaattctcccctaagcctgaaaattgaaattttacttctactttttataattaaaatattgtcatatgagtcattaacaccatgctgggtaattactagggtttattattacttgtgaacctcttttttcttcacgctattttcttcatatatagccttgatttacaaaatactttctatgtgggcttagacaatcaacccccaagggtcatagagcaagggcaacaggaatcttcctagtagataataatgcgagtatggaaaattatgaactacattttgcctgtaaacatataggacttttttaatgaaataggatagcattgtgatattagctttaaatgtttgtaaaaagtcaatcattttcatgattctcatgaatagctcatctcctttgcaggatgttgttcacagttgaaattctctgattaatttttccctgtttgtttctcttttatttttctccagctcttgtaaatgtaaaactctgggccattgatcgacaatgttttcaaacaataatgatgaggacaggactcatcaagcataccgagtatatggaatttttaaaaaggtaggatgctttcttttctcttgtgagagtgtttactttccttttagccctattatctgaaatgcagcaccctgaatttcagggtgctttttgcctttctctcagtcataatagtctacaaatgtgtagagatgtaagacttcgaacatgcttctttatatttctggtgataaatctgtagagatgtaagacttcaaacaagcttctttatatttctggtgccagtttccatgacgtatggttaagtcagaacttcagagtttcatgacatgtattaagccattctctcatagaagtgagcaactcagagaaacaaataaaagtgtgcttgaacaaaaaaggatattgaatacatcttcaactatttattggttaatatatttatgacacatcttctaaacagactcacactgtaaggccgagtcatctcttgtgtgagtttccatatgaaaggtcagatgactaagatgaaaaagttccaagaaatagcttattatcctttaatcctgagcttaatttcccaaataaaattcattttatgctacaggtttgaaatatcaaaagcttttctttcgtttatattatatattatcataataactcaatataggatggaaattagaataaaaaccagctttttatttcttaggaatacattgatactcactgaaatgaatttctttgtctgcaagtttattttattttaaagaaaatatattatcttataactgaaaagaatattgacaattctcatgactttttaaaaagcacttatttttaaaattacttttcttttgaaaacagagccattatgaaatagtaatacacaagttatatgagcatataatgagtgtactgctaattaaggtttcatttttgatcggtagaatgtttaacttttttattttgctttttatttttggtgaataaattgttaaaatgaagctaaaaagtcaaattcacattttgctttagtgatacatcttaataggtaactactgaattttcttaagatgcaatttttgatattccttacttggatatttcttgtagttaatttattttcttactgcttcatcttttatacatttttatttccatgtaagaccttttatattcatgctaaaggggtaatacaattctaatgtgatatcaagtaataatatcagcattaattactgtcagcagggtgttgatttttttcctcaatgtgattggatgaagaaacacttagaagaggtagaaatgtaaattcctatttgaaatttaatatggttttcaagggaattaaattattcaggtgccttctatattgggtgagatatatatatgtatgtgttgatatatatgtgtctatacgtatgttgtgtgtatgtgtgtgtatgatgaaagatagagacagagagaatgaatattcactttaagccttaacttacagtttaagagctattgatttcttctagtgcagctctgataaagattacaactggtaatcaatgaaatggtaacctatggaatgcagtccattattcatctcacatacctaagcgttggacacttacgatgttgattttagcttccataagtttgtttttccaagaaaatggactgagtgccaatgctatctcaaatgactctaacaagaactctttctggtagcactatttcaggagatgaagatgtctcaatctgtgcatacgcacgtgtgtatgtgtgtgtgtgttttcaaattcaaatcttaaacaataaaattggctctccaaagtaagtgaacattttttgttggtcagaatagagctggcagagtttaactggctgaataaaaaaagaggtggttgctgacttggatgtcactttccatctggctactccataaaacatcaagttcacattgtttgtgaacataggactgggccgggagtccagagaggtgacaggatgaccatcattgcctgaggccagctttaatcttcctaaattacaactgtgaccaactggttctctctctataactttttcagtggagcacagttcctgttgcattatttacagcctcattagttggacattcaaggccctcctatagccaaaaacagtgaggtttttcagcctggattcttctctcttcctgcaaaccaaacaattccatgtacccatgccttccctgtgctttttcacagcacattccctctctgcctgcccctctcctccgtcactgtcaatgttcaaattcttctctgctttttggacccaactaaaagctgcctttccatgtatacttacctcattacactgagaagtcacgtctttcctcctctggagcttcatctctgccatgtgttttattgtctgctttggtttattgtaatttgaccttaagcttatttctacttctagactataagctgtttagaactagggttatttcttaaatatctttgtatgcttctttggcacaaaacttactgctttgtagataggcactttatagaacagtgagtacagagccagtacataattttcagcactcattgaagaatgaaaatgcaggacctctttcaaaaattgataaaaaattaaagaccttgacagcacagcattaaatcaaatgtaggaaccttgtaagtgcaggtcctattcttcggtacaagtcacacatccatgaagccatgtaggggtggaaagggtaccatccctttcctctccattgtaagggtcatggatgacacacttatataaaaagacgggttaacaagagaaaagcattacagatttatttaattaaagattaagatgacacaggagcctttctgaatgaagtcctgacaatacaggggaaaactgcatttttatgcttaggtttaatgagaatgggcagtgatagaattgtgcttgaatgaaaagagagtgctctaatgatagtggcctaagtgaggaaaaccagcaaggcttgtctgttgagattcttcttggcctctctgttgtagcatttcttccttccaggtatgaggtaggactcctttggaatgagaatcttaatttctgcatgacagctgtcaaacagaaaagcaggggaaggttaaaataatatttttaggctttatggatggctttcggggggaaaaaggagtctgtctctatgacttgctttggggaaaaggaattctagtttctatggcttgcctcaggggagaatgagaagccagagacaggaggcaggagaaggtcagaaagaaaggtgttctgaggccttcccttcagggtgtgtttttctgagctccgaaagccagaagagtgaataatattaattccttcttcacatccccaggttagctatacttggtaccatttatttttcaaggctattaagagatggcataatagcctcaatgatagatactatcaaaaactcagaagacaaaattaattgctttcctgtaacttcagaattacttttatctccctgtttgttgttgctttttaaaaaattgcctgtctttcttttacatcatataaaactttaaagtttttttgtatagtcaagcacttttttctttatgacttacaaaaagtgacttatcacttttttctttatgactttatcacttttttctttatgacttcggctgggtgtagtggctcaggcctgtaatctcagcactttgagatgccaaagtgggcggattgtttgagctcaggagtttgaaaccagcttggtcaacatgtgcaaccctgtctctgcaaaaaatagaaaaatagaaaaattaccaggtgcagtggcatgtgcctgtggtaccagctactcaggaggctgacgggggaggatcacttgggcctggtaggttgaggctgcagtgacctgaaatcctgccactgccctccagtctgggcaacagagagagaccctgtctcaaaaaacaaaaacagaaacaccactgcatatataggaaggcttacttaatattataaaaatattgactttaagtgctttaaagcagtctgtgaagagggggatgtttttctctatgtgtttgctaaataaaacttgcatctacatttttctgttatagatatcttatactttatactttgtaaatgacttgaaggggtaaagcaatggcaatgctattaaaaaaatgaaaactctagcaaaggatcatgcaaattatcagagttcttttcggtaggggtctctgttgtacatcccaatgccttcccaaccgaggaatttcaggagctgccacaggctaaaaaatgagtggctctctataatttcttatcttatggtgccactgtttcttctcatttttctgaataaacacgtaagtttggaggaggagaaaagtggacacaccaggcatataaatgcactgctaacaggcaagagtttttctttattgtcaaagttgggttttatttttattccattgtatttacccattttgtaactcccagtcatgtggtttggccccctctttgctattagatgccacatcaaactgtgattctgtctctttaatcctatttagtcatttctcttttgtgcctgtatttcagattccctgatgtaaacacagatgtttctatccagatcatagaaaaaaaaaaaggtattcaaagggcagtgctactaagcatggcataattgctataagtcaaacgatgattttgccagttgccagcattttctgtcatctttggctactaaaaaatactgttgtttttaagacagattctgaaaaatgagccaaataactgccagagttaatttgtgttactttcttctgagcatattctctgttactgctattaaaactggtatctatacccagaggagcattagtatgtagctgtgtgaccattggggtttacttgtagaaactaggttttcttttgttcccaaattatgaagctgatgaggacaatgatagtggtggaccctgatttatattacttgtttcactgacaaatcagagagatggcaggggctttttggaatttaagctacacagtagatcctgttcaccctcagaaaatattttctttatccacttggtaagacagatatgctcacgtcatccctcttgcattaaacctttccatatcttcccatcactcctaggagaaagcctacctagttcttaccattgtcttccaagcactgcctgccccgacactcttccagactcatctcactctccatcttctccttctttattctctcatcctcccttgtcccagtcacaggtactgtttcatctccttagatgctccacagcccctcttaataaagattatctcaagagactcccctccctttgaatggatgcattaccagagtgatctaagatgtgacaacacatcaagtatgcctgccatagtggaaaatagaacctgatatctctcaaaactcttataaatgtctgatttcccttccttgagttgaatgggggcaataatagtattcaccactgagctttacattatattttcaatacaaataattgtaaagttcacagactttgaagatttttggtgataatttgattcccacctgactttccaactgttaaagaacttgaagatgttgttcaattttaaaagtactgatcatatggtttggccccttttaaccagaagggtaaatctttgccaggaagccctcattactgggaggtgatttgtaaccaaaatccaaaactgatgtccctctatgggggccttgtagcatctgtatacaaaggatcaagatgatgggtgagcccttggcaagtcatagagctgctttgatgatccctccttattccataatttccattctaaaaatcctgccagattttagtgctgtgtaaagcttccttattctttatctccattactaggtagtgagccccaagtccacatgtgcttttcccttattctctaaaacaataatgcttgtatatatatccaacatattgttaaataaatgtgctacctatttatatatatgtattatgaatgtaagtgattttcccttaaaaaaatatgactttgttattgaaactttatactttcatttgatatcagaatggccttgactaggaagtcaattttatgttgagatcaccccttgacttctgcctatgggccatacttcaaccaaacttttctgaaacttctgtttaattgctttacatttttatcattttgtggtttctgcctcacctgtcactggatgggatctacataatgatgcatcatcacctctgtggtctgataaatcaacaaggattaaatgattttagatttagaaaaatctaagatgtgatgtcatttaatttctctgcacattttatagctgaagcaactaagtctcaaagagatcaaaataagctcatacccagtaaaaaacagagcttagactaaaactcaggtttctgaatctctagcctgagtattacaccttacctggactccagttcatagtttgttttctgatggcagctccctactacagtaaactaaagtgagggtagtttagtaatattttcattgttcctttccacaaaggcaacttatttagattattaattcaatattatataaacttttgtctatattctaactatatacctttattttcaatcttttagaaataaaatttctaaagcccttacaagcttttccttctttgatccaatttaaaaatctggtttcatttttttaataactcaatccaacaggcactttattttgatattttaattgtattttatcatatttctaaaagtgtagtcgggagagaattagagtttgttgagtagaatataaagttgtgaggagtgtgaaagtttcttcattctactgatgagagaactgggcctagatcagtgaggagagctgcctcacatcacccagaaaattgctaataaaatgatccctgtgcctgggcaagtctgaaattttactatcccagaatatcatctttgttttgttcaaaatcttcaaggtaaaattccccacaatcttgactaaacatatgtcctagtgtttttgcctttcctataggatattctgtgaagatcttgcctaagttgtcatatcctctaaggaaagagaaagtaactgcacagagatgcccttgtaatatccatttttagtgatagatttggaatggggccagaaaatgtgcattttttaagttctcacctgatgctcatgcagctagtctggggatcattcttggagaaccacttatctaggacataagatgaaagtacaaaatatatttcaaatattttgagtatttgtatgacttattaatatgaagagtgcctgggtttaaatcctggtttcaccatttataggtatatgataggttggtgcaagagtaattgcagttttgactgtgaattttaaatcattataactaggctcaaacacatctttatttatcaaaataggaaccattacaatcaacacatttttgccaatgagaaataagcttgtttattcctgtagcataaaaatccatgcttagggatttgacaaactcttgggaaagcattttctgcatcctgctggttgtggaagtgttttttctgcaaaaagttgtcgagatgcttaaagaagtggtagtcagttgacaagaggtcaggtgaatacgacaaacgtggcaaaacttcttagcccaattcattcaacttttgaaacactggttgtgcgatgcgtgggcaggcattgcatggggaagaatcgggccctttttgttgaccaatgccagctgcaggcattgcagttttcagtgcatctcatcgatttgctaagtgtacttctcagatacagtggttatgccaggattcagaaagctgcagtggatcagactggcagcagaccaccaacgagtgaccatgactttttttggtgcaagtttgctttggaaagtgctttggagctttttcttagtccagccactgagctggtcatcactgatcgctggataaaatccacttttcatttcatgtcacgaaccaattcgagaaatgcttcgttgttgttgcacagaataagagaagacgacacttcaaaatgatgatttttttttctctcagttcatgaggtacccatttattgatctttttcacctttccaatttgcttcaaatgacaaatgactgttgagttttttggcaagttcttgtgtagttgtaagaggatcagcttagatgattgctgtcaactggtcgttgtcaacttccgatggccagccactgtgttctccatcttcaaggttctcctctcctttgcaaaacttcttgaaacaccactgcactgtacattcattagcagttcctgggccaaatgtgttgttgatgtttcaagttgtctctgctgctttaggacccacttcaaactcaaataagaaaaatcttttgaatttgctttttgtctaacatcatttccatagtctaaaataagcataaaataaacagcaagtaataagccattagcacaaaagcataaagtaataagccattagcaaaaaagcataaagtaataagtcattggcaaaaaagcataaaatgatgtatgacataaccacatttatttaagaatgcattccaatatcaaatggcaaatttcaacaatgccaaaacttcagttacatttgcaccaacctaatataatcgtaggcaagattctttacatttaggtgcaataaaaaatgtagtaaaccctcccactatcaaggaccataattagaaataaacaaaataatatgttagtaaaaatttattgagtgtgtgccaagcagtgttcaaaatgctgcagatgtattaacttattctcaacaaaaattcgtaaagtactattataacatcatttccattttacaggtaagaatactaaggccaaacagataaagaaaactacacaggtattcagggtagagccagtgtctatagaactgatactcttaaactccaccctatactgcctcaataaattctggatacccaaatattagtccctgcacattgctgtcctgctcattaaattggcatttacttagcctggagatttcagccttaggttgattttgttcttggagtacctgggtttcctattcaccatatttttctctctcagtgccctcctcccaaacctcagtagtattttcccttcctctcacccctctagaatatgttctcaaaaaaatgctcagtaatagcttaagagctatcactttaaacaagtgacaatgtcttagaattacataggctcagtgaaggggctttcagttgtttggaaacccaccacctgtacataagcagacaccatgatttctaaaacaaatattaaatgacttacaactcaggatcagtgtcttctgcagacattcagacactgcatttctggttcttttttaacctcctgcctttgagttcctcaagcacaggttgtagtctgtaagtgggacctgttcttgcttaggctatgctctgtgatcttttaaggaattgaactgtttggacacatacaaagtatcttttgtacactttaacctgaacaaatgaagatgccactttttgggcacaaattctataaaatacaacaatattgtctaatcagtttgtagagatcacaattctgggaaattaaaataatgatttccctttccccatatttttcttctatcatttacaaaaagagatgggaaagagaaggtgcatattaaaacaatttgggggctgttagaacttaatttttttttgtttgtttcttaagactcaatgacagacctattgagctcttaagctttgagctttaatagagcttttctagaagtttgtgaaacctgcattagaattaagcttgacaaagctggtatagttttaatttgaagggaaatattgggaagaataaataaagaggcactttctcaccccattttcaagttggtttgctcacagaccattttgtggtagcagattcattctcattaaagatgacacaaggagcaggtaaatctaaaagtggccattaattttatgttgtcatctagcatttgcacaaatgtctccatattgatccattttttattaaaaaaagaaagacaatgtaatctcagatatttgcataattataggctaatttttaaaaaattattcatctgcacatttcatattgttactttcacctccatacatgtaagttttttctacttcttgcaactaattaataagatagttgattatatttgtggtaaaatcttccacttgagtcagtaatgaatctcacacagataagtcctatttagtccaagaaaagactaagtcctcagctaagggacttaataaattgattcattgtgctggcctctccctgagcctgggttaccagggatcagtctctttaaggactgtaggcaacttttcctcactatctccataagaatactttctcaaaactctggggttccaaaaatctaaaacagtgtgacaaagcagtttaatattcctctagcctgttgtagctttgaaccttataaatctttcctgtagtaaggcttattttatttctgtatcatccagattgagcctaataacagttccatgcttgtaaaatgttttgtacacagaggattagtgcatctgggagtgagttcttttccataaggaaaaccattctgtaacaaacaaattcagagagaatccatgagttactgggaaaaattaagaagggtggtcttctgggatcccagcaacatagatttctctgcttgatatagaaacccacttcctcatggttggagagaaatctgatagagaatcggaagtgggaatgaaaaaatcctgctgaggtgcaaaataaatactagggcaatttagacaaagaaagcgtcttagtgtgtacatttcatctgtcctgagaagaggccaatacatcagtttgtcagtttaaaaaaagcatgagaaagtcagaattagcatcataggtccttttttgtttgtttgtttttggttttggcttggaataaagttaatcataatttatttatcaatatgattttaccaaggcgaactcttaacggacagcttagaatctggctgttgggcagcatgggtgtctatgaatctgagaatcctgattttctgactctttctagggtgcagggaaagcagcccctggaaagggaagcccttagaggcagcatgagcacagtgcttcacagcacaactaggggctttgttgtgaacactccctttaccaaacccagtgtgagtgttttcaaggcagtgagggagagcaagggaaatccaaaactcaaaacagaataagctggcacctgcctccttacacacattattatctcacttaattttgacagctcctttaagaaagttaatcataatttatttaccaatatgattttactaaggcatttccattttactgaggcagtaaccagaatcgtgaaaattagcggtttcccagcatcagtaatgaatctcacacagataagccctgtttagtccaagaaaagactaagtccttggctaagagacttaatacattgattcattatgctggcctccccctgagcctgggtttggatttaaaaccaggtccaatccaaaaatcctcattctgttaatttatcaggccaatttcctataaatgggtaatgtcagaggaagaataatagaacaaatacttgtaaactttttatagaataaaaaaagtaatgtcaattggtgaatatgtgcaaaaatcattacaaatatattgaaaatattccttggaagtgcattgctataaacatttcaattcatggaaaagttcctaacatataattttggcatgtgtgtgtgtgtgtgtgtgtgtgtgtgtgtgtgtaatcatccatccatagttaaatctgaggtttttaaaagtaatttcaaaacagaggagagaggattttttctttgagttctaataatgatgtaattttattatttactttgtgtgtgtataataagtgatagaatatttatgctaaagcccagaagaactccaattaagcagcacaattttagttattttataaatacatatagagtgcttaaaattattcagtacttttcaagcaattgaataaatactgttttccctgttggctggagggggtccaatgggtaaacattgtattccaggtttggaaaaaactatgtaagtgctctggtttgttgtgcaaatgaagataaatcaaagttgccttgcaggatggatttacttgttttattttttaaagaaattaaatacattagtaaatctaacaggaacacagccaagaaagcaagaaaagaaatattaaaatttaagaattttaattacacagaattctaaattgttacaaattttgacttcaggttggttttatgtgcgttgaactctgtacacttagcattgcttcttgaaattaggtcttggtgtttggggcagcggggcccaaaggaatggcagattttgtacttatttttattttttttaaattatactttaagttctgggatacatgtgcagaacgtgcaggtttgtgacaatggtatacatgtgcaatggtggtttgctgcacccatcaacccatcatctaacattaggtatttctcctagtgctatccctccccaaccccccccctcccctgacaggccctggtgtgtgaagttcccctccctgtgtccatgtgttctcattgttcaactcccgcttatgagtgagaatatgcagcgtttggttttctgttcctatgttagtttgctgagaatgatggtttccagcttcatccatgtccctgcataggacatgaactcatcctttttttatggctgcatagtgttccatggtgtgtatatgccacattttctttatccagtctatcactgatgagcatttgggttggttccaagtctttgctattgtgaacagtgctgcaataaacatatgtgttgttgttatttttaatttatgtttctatcttgtctggataaaaatatgacaaaataatctaggaccaaccaataaatgagtatgaaaagtagttaaatactgaacagcaagaagttattgacttgttttcagttaatgaatattattctaaatgacattaacttcattttttccttcctcttcttctcttttctttccttctctcattcacaataaatcaatacattcatatgtataagtgtagtcaattgcttcttaaaggtaagacttatgtataaacaacaagtaatcactttttttcatttaaactggtatattctgctatgttaaatgtgtccaattcatattttaagtccttttggacacctatctcaacagatggaagacagtgtgccagaatgtagtagcaaggattgggccatctgaaaatatgcagaattctatatgggacatatagaattaacctaaatcagattttgttatcatatagaaacacatcaaaattagcttttgtattagataagaagtcaaaccagtgcaaggagattggagtctcttctagaatattattttagaatttatttagcctacattaaggatacattgtctcactgataacagttcatccagagagtcttcactgtttctgactctcagaattctaacatctagttagtctttctagcactaaacagtttctacttaacttcgaagccccataatatagacaagagatactctgtttgattacaaaaaaaaatcaaacatgtcagaaaagagatattttctttcttttacaagtagtgtttcttctttatagcctttgttagatagctctgacatctcaaaatacatggctgactactttaaatagatattttttgtataaatttcacaacaatctgattatactacactatacaatgtgtttgatctctcctatttaatccccagatgtttgctttctgagaatcacagcacacgcatacatattctctcttcagtactggctttgtcactgccttagtctgtttaatattgttgtaaaagaataccagagggccgggcgcggtggctcacgcctgtaatcccagcactttgggaggccgaggcgggcggatcacgaggtcaggagatcgagaccatcctggctaaaacagtgaaaccccgtctctactaaaaatacaaaaaattagccgggcgtagtggtgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaagaataccagaggctggataaattataaagaaaagaggtttatttgactcatggttctccaggctgtacaagaagcatgatacctgcatctgtatctgaggagggcttcaggatgcttcccctcgtggtggaaggtgaaggggagaaggtatgtatagagatcacatggtgagagaggaagcaagaaagagaggggaggtgtcaggctttttttttcttttttagcaaccagctttcacaggaactaatagaaaactcactcacccttttcccatcctgcccagggcattaatctattcataagggattcactcccataacccaaatacctcccattaggccccacctccaacactggggatcaaatttcaacacaagtcttagaggggacaaacatccaaactatagcagtcagcaaacttcattatgtccatgtttctgcatacctcactattttggtccaagaacctgtctatatgtcttatcctgatctcacctggctcatcgtgtcctgctgccatccatgccaattagtttgatctctacagagttagttgaagctgggtttgataaaataaatggagatagtgtttgcaggagtcaggaaaaggaaatagagtctaggggagtaagtgaccctctagaaggaatagaatgttggtgaaagagccagaatacaaaccagggaaacaagccacacagtcccaggggcacatagggacagatctggaattttcatgaagctgagggtctatgctgaagacagtgaattagagagtgaatcacactagagtaacattgtagctaaagaccttgatatacccagaaaaagtcataacttgaggagagctgaagtcaatgataaattcataatcattgagaatgaaaagcttcatcatcatgacaattgaggcacagatgacatctttatgtgggtttcaaatagcttttttaaaaaagattttaaaaattattcaatgttcaacttataaattaataaagaatatattttataaaacttatagaaaccgaaaagacaaatcattgcagtcaccttccaaaaatacctaatgtcagatacctactgatagctatttaaggattttactatttatgtacaactgttatatgcaactattttcctgtttatgtgcaacttttaacctaattattttagtgacaactatgcagctttagtgttgctgataatttaatattatatccttccatgttatttaatattaaaattttccaaactcttctttgttttcttatgccgccaccatctacttctttttctcagttttaaggattcttagttctgtgagaccaggggatagggtaggtgtaataataaaaaagcattagaatgaaagacaacataacctcaatctacagtgtgcatcttgagcacctgttgtgtggtaggacctctgtccccaaaatgtccaacctacagaagcagaggcacacctcctgctaatctgattctgtgccttttttttcctgctgtttcctatgagcctaggaccacaccccacaccttcacacatacccttgctatggcttcagagcaggagctaatctggttattcttaggcagtggaaaatggcaatgtctgggaatgatcctggaggaaagcgagactgatttttggctttgtaatggaaaacttgtggtttgcttttaagcctactgtacgcactgggttttcatgtggataaagaagattctcatagatcttttctagttttgatggggagaaaattaagttgggtacttcctaatttggttataactcttacagtattttttatttcagtatatcagagtactgtaaaatacacaaatcttgaaagtacagatcaatgaatgtttacatatttatatactcatgtaaaaaataccagctcacaatacaggacatttccacttctttggaaggccctcccaaatctccttgtagttaatctcctctgccaaaggtaaccactattctgagttctaccattacagattagtattgccctttttcaacttcagatgaatggaatcaggtagtatgtactcttctgtgtctggtttcttttgctaaacattatgtctagaagagtcataccttttgctgtgtgtatcaaaagtttattcttgctttgtaacattctcttgcataaatatgccaccatttgtttattcatttttactgacaaagggcatttggattattgccattttgaggctagtataaataaagctgctggaaacattcttgagcatgtttttcgtgagcgtctgccttcatttctcttaagtatatacctgagaataaaatttctgggttatataggaagcatatatataacttttatagatagtgctatataattttgcacagtggttgaactaatttatgctcctaaaaaatataaaaaaagaggtttgttccagatcctaacagtatttagtattgtcaatcttaatttatttggttaaaatattttaatcaaataaaataccacatagtctgcaaatattttgagtgtacaccccattaacaatatttttagcacgttgacctatatatttatatttagcacattgacctatatatattttagcacattgacctgtattgacctatatatattgaccttatatatttaagacattaaatacttaaatgtctgaactaatacatatacaaaataagatttatgaaaagataagatattaaatagaattgagagcccagaaataaactcatgcatatggtcagttgatcttcagggaatctttatgcactgttgatgggaatgtaaattgttacagtcattatggaaaacagtatggagcttcctcaaaaaattaaaaatagaactaccatatgttcaagtaatcccatttctgaatacatagccagaggaaatcaaatcagtatggtgaagagatatctgcactccatatttactacagtgtattcacaatagacagggcatggaattaatctgtgtccatctacaagatgaatgaataaagaatatgtatatatatacacacatatatatatacacacatatatataacatatgtatgtatgtcatatgtatatatgtatatatacatatgtcatttatgtgtgtgtatatggtgtgtgtatttatatgtgtgtatacacacacaatgaaatattattgagccttaaaaagagaaaatactgccattcgcaacatggatgagcattgaggacattgtgctaagtgagataaagccaggcacagaaagataaatactgcataatcctacttaagtgtagaaactaaaaaaagtagaactcctaaaaacaagagcgtgaactgggggtttatagggctaggaattggggaaatagggagctattgaacaaatggcgctaaatgaagaaaaaaaaggtaagagaaacgtagatagaattagcaatatttttttctgtcagccacatagattgtcttgtgcaatttttgtaaatacccctctactttaaggcatacacacgtaccatgggtcataatgaaatcagtgattaccacatggattgataatgttctgtgtcccaccagtttctcctgttcagttctggagataatctaagctagatgagagtgcctagctctgtaaaatttagaaaaggcttagggggctaataattgtgagtcagtccaatgtggtcatccccctgtgtttcccttgtgtggtgcatcagggcagtgcaccctgcccaggggacaactttaagatgtatgtgcatgcctggagtgtagccctttttcttctgtttgttttgcatacagctgatttttcctttgttggtggttcttctaaactggtggttctcaaaatatgatatggagattcatgggcattcctgacactatttagtgggaattcatgaggtcaaaactattctcataatgctaaggtattattttccttttctttttcattgtctcacaaggttacagtggagttttttagaggctaagacagctaataatatgtatgcttggatacttatatgttttaaaactttccagtcactatttaacatggtaaatgtagatagatacaacacatataaacaactgttaggaatgtataagggtcctgggaccaaaaagcttgagaaccacccttttaaattaaaacaagataaaatgagggcagataaacaatatgctagactttaataaaaagtctaacataataggaagcatggatagatccatgcttttggggaaaaattttaatggaactcattaaccaataaattatatccattgcttctgtatggcatatagggtgaaactaataacagtggaattactttgaaatgcaaagggataaccctggactagccatttcaaactcaggagccaattgtaacatgaaccacggggcttccaagttttctcagtggaagggcatttcttctgtcttcatatctagtatataacatttgactgtacctctcttctcagcatcatcaagtcctgacacttatgacacatgtcagagaattcatccatgaatttatctataaatttttgaaaatttcttgaaacatttcgatgtttgagagagacaggttaaagcccagtgttagctatgcattttttaggtttcctaattctgtcttgaaagagggcatcaatgtctaaaatacctaaactatggtagtattccatagaaatgttgaaatgatttaaaatatccatccctaattggtataagaattatcttcagataaattgttggtaatattatccagaatttttttttctctctcctttttttttttttttttttttttttaagacaagatcttgctctgtcacctgggctagagtgcagtggtgcaatcttagctcactgaagcctcgaactactgggctcaagcaaatcttctgcctcagcctaacgagtagctaggactacatgtgtgcaccaccatgcccagccaatttttgtacattttgtagagatgagcttttgccatgttgcctaggctggtcttgaattcctgggctcaagtgattctcccgctttggcctcccaaagttctaggactataggcgagggccaccactcctggcctattatcaaggatttgtatatccatatgataaattccttataggtcttggtgcttggacagcatttatcctgcctcttgatgaatgtgaatactttagttagtcagacattgcaaaccacatttccattattgcctgagatgaatttagccttagatataatgttcaactagagtaacttagtgttggaaatacagtatgcattttcttttggaaattttgttattttaacttttttcatctggctttatttaagtttttatattgttgattgtttcttatcttttgtggatataggcatagcataagaattagtggattaatgtctaacacacttgtaaaagtcaaggtgtttgtgttagtccattttgcattactataaaggaatatttgagactgggtaatttatgaagaaaagaggtttatttggttcatggttctacaggctgtatgagcatactgccagcatcttcttggcttctggtgaggcctcagaaagcttttactcatggcagaaggtgaagggggagcaggtgtgtgacatggcaagagaggcagcaagagagagaggaggaggtgccaggctcctttgaacaaccagctgtcacgtgagttaacagggcaagaactcactcattaccatggggagatcaccaagctattcatgagggattcacccccatgactcaaacacctcccatcaggccccacctccactaatgaggatcacatttcaacatgagatttggagggacaatacccaaatcatatcagtgttcaatgtttggaattataatttgagtaccagttataatttggataaaaaatagtttttctcaaattactggggcctttatctgtataatcaacataattttcccccatgttagtggttttcagctttttatttgtactccaaactaccagaaatactgacttactctggtttgtaagaataggtcactgtagccataatgttagttattgaagttggaaatagttaaaactaattgtgagtggagtatacatgtacattttctgtatgggctagaaattaattaggcaaattaatagagaccaactaagtatttttagattttagaaatcactgagtcacatctgcatgatttttgctgttttcagattctaccaagctctttcccctttctcctgttatctgatctttgtaatgatgcaagagcaaaaagatcataatataagaataaaaatcagtcctctcaggaaaaagtacagtaggtgttccaaatggacagaaaaatcaagaaaaaatttaacattacacgttcacagacagggacaagagcactgtaggcaaagacacaccctgagcaacagtacagagatgggaaaatttagtcgatgatgcctttagagagtccgtggtctgttcctgccagtctcctgtgcctacaacagctgcctgacacctcaccctgagctccccaaattctagctcccatatttcccctggaaatacaataaggagtaatctaaacttaatttggtagatgacagaaagctattaaaggtatttgagcaggtgtcagaatttagctgcacatttttaaaattaatctagcaggaatgcatgagatggtttggggtgtggagggaactggagacaagggcagagagggtcagtcatcaaggctcaaaaccgtctcatccctaaaatctccagattgaagttcccaagtctggcctttgtctatgatttctcagcagttgatgctgtggggaagtaaagatgagaaatcagagaagaaaggagaagcaggtgggtttacaagacagtgaacttgatgcccattcatgggtacaatactagaatagtatggcaaggagttgatttgtaaaagctattagggtaaggggccatcatgaattctctatcttatcatctctttctcagatggctttactagattattagctggagaaaatgtgatagccactgtggattagactgtggtagtacatttaacagtgtcactgtggataagatagaacaatttaggctgaatatgaggagagtcccacagcacactactctaaatgcagctcttaaaaactccaacaaaagaagctaatagtttcctactataaaccaatataactgccccagatcccatgctgtgcatacatttttaagaatatgttctagtaaaatatatggcaatagagaaaatttgtttagctactccctctgggaaccaagaatctttcacttaaatgtagctagtcctccagaggattgaggaagtgctggaggactaagttgataataaaaactctcaatttgagtagagttttcttaagtactgtgtttattccttcacaaatggataaaagctattaataaggcccattaaatgtttatatctgctggataaactcctaggacttatcatttgggaaacagggattgcctcttaggaggaatggaccctgtccacaagtgtctactatgtctggggaaagggtttctttacagagagctggaaccatgagagccagagttctcattcccaggtaaagaacaaaggagaaaggaggagggctcttctcttcatgtgtttgtcacctgttaatcatcaagaaaggagagattgaattatttgggaagtagcttgtatcttattaaaatatagcacaatagacaagatgtgaaataattttactcttgttattgcctgtaagaagacattaattgaacaaactttcagcaacaagtttagtttagtttcccctgaggaaaaaataaaccaccacaacagtggtgctgagagacagcctatattgtacagtccattaacactaaaagaaacaattagttttcccagtgatgactgatgaattattttaacttgcttataaacattaagggtacatcaacaaagcaaagtttcccaaagtattcaagacaaagaaaaacaacacaattgtatgtttgtttattatctcagtattcggatgattgccctaaatattcaatttcttgattgcatacagccattttcgtatatacccaccaactgacaagattatcatacaaataaataaaaattatgaaaaaggtttgaaagagtattatttatttatgcagtatttttggctaatttttattcatgaagataattaaactgaaaataatatctagatttcataaacataaatcatagctaaatatcagtaagaacttggttatgcacaaggacttttggacactgaaatggttctatgaaatgtataattgtcttctttgaggatccttcaatgtagaaaagataatattatatttttgatactcttaatttctacacataatgatttactaaattccaaactgggtttattaactcatgagtgtggatgcattttatcattgaattccagtaactactatttctagggaactaaaattgaagacctcattttaacataaaaagatacatcatgatgattctgaaaatgagttaattgtgtaaaaagaaaaaacatattgctatgtctttcactgccctttactttctaactggaaaaatgccatcttatagaacaaggaactggatctgtcacagataaattctatttctttgaaggttgaatttctttctaattcctggaacaattcagaaagtttaggattatattatcacttaaccagacaactagattgcatctattctgacaactggatacctgaagaagtacaggttttctctggtacctgagaaactttttatttatgataattagaacttttaaaatgatggtaatgtcaggctttgagactgtggacaactacttttcatcacttggaagatatatctctgaattattggaaaagtcagtaatgactaattttactcttatactgaaaaattttaatatgtgaatgtttaacatctatatatattaggttggagcaaaagtaattggtgcaacctttggatcaacctaatagaataaatggcagcaagttgtcaaaggagctcaaattctcaaaatagtttagaattttagattgccaaagctttactcttatttaccttcacgtattataggagaacttattattcttcaacaggaaagtatatttcataatcctcacgtgaaaaaaaaatcagagacattttaacatattgataagggctttttgacaaagaagccatttgactgcctcattggtgctcagacttgtcattcttcctgtgttactgagcaaagactgttcacagcatttaaagttgtgttaggaaattacttgttaattgcaaagggggagagaagggcttttacattagagaagtggtagtcaccactttaaacaaagcattaaaatcagtatcacttatactggaacaacctgatattctgtggctcttggtgtaaaacaatgtgaattacacagcatcgtctttgatgtgttcttgccaacaatgttaaattttgttctaatgaaggctttgatataacttttagtttctagaaaacacaagaatataggaaagagttactgctagcaacaactggataaatagacagatgataaggcaggcatttaataaggaaactagcttggttacttcaaaacatttattttgtttcaagacaaagcagaataaaaatgttcaagaaactgttcaagtttaaaagaagctaaagagacataatatccacatcaaatctgtattagttatctattgcagtatgacaaattacaccaaaacgtactggtttaaaacaacaaacatttatcatcacgcagttttcatgggtgagaaatctgagtgtagcttaactggatgcctctgactaaaggtctctcatgaagttgcaatcagctattgcccaggttgcagtctcatctgaagcctcaactggagaaggagggtgtgagaatctgcttcaagctcattcatgtggctgttgataagtctgtttctggccgtgtgaacatttccacagggatgcattacaatatggcagttggcttctctaaggataaatgatgcaagacagatctgagaatgaccaagatggaattccatgtcttcttatgctttcattttaaaagtgacattttgtcacttctgtattttattcctcaaaagtgatttgataagtcaagctcacactcaaagtgggaaggtggcaggtttacacaatgacatgaagaccttgggatcagtcagggattactggtggctaccttagaggctacctaccacagaagacataaagcctaactcttttctagttgcagaagataaaatctatgaaatatattttaacagcaataaggaaaatttgaatatgaatttgatactaagtaatattaggaaattattgttagtgtttgtgtcaatgatgctgtggtcatgtaagagaatgcatgtacttattcataaaagatacagggttgaatgtataggtctaaaggactatgacatcttattttctaaatacacgtgaacacacacacacatacatgtgtatgcatgcacacatacatagataaagcaacaactatttttgaatctaggttgtgggtacttggatgttcattttcctgctcttccaactttttagtctgtttggaatttttatatttaataaagtattaagtaatttggtgtcttaggtgaaccctaccactgtcttgttccaacaaggccaggggaagcaggttgcactgatctatgccaacttttcaaattggtaagagctgttcaaaatgttatggtaaaaacaaaaacaaaaacaaaactcatgatgttgatgaaaccagctttctccaggtctatttctatagttatggtacctatcatattccttaatacctatatttacatggtgaccacttcgggaaagggtgaaaagatttcctgggagagtagggtgtctgtggatttgatatgttctatactcagttaatctagttttatactctttatgcttttcttcaggatttttattagcttttgttttggaactttccaccatataacagctcttctacttaaatctgccattaccctctcaatatttaacactattttcacacactcttgaataatgagtcttcagtatgatttgcatctactgctaattttaacagggctactttttgagccatctaacagttatccagagtacataattttccaagttgttagcgatactgtgattctttaattatatatggtgttctgtttggaaattttgttccaggtcatacatacacattcactaataataggacagtttggcttatttgttctttctagtcctattgcaatataattgtgatctctatagtataattacttattgaacttctcttaaagtgtttttttttttgtttttttttttttttttttgagtcacagtctcactctgtcggccaggctggagagcagtggcacaatctcggctcactgcaacctctttctccagggctcaagtaattctcctacctcagcctcctgagtagctgggattacaggtgtgtgccgccacaccaggctaatttttgtatttttagtagagacagggtttcttcatgttggccaggctggtctcgaactgctgacctcaagtaatccaccctcctgggccccccaaagtgctggtattacaggcgttagccaccgcaccctgcctaaagtgatttataaaaagctgtttatcataacatttaatgttttcaactgtgagatcatacgctcaggaataaatactaaatctgtgctacctttcttttttttttgcctttttccttaccagttccactagttaacctctactcatctaaaaccattatcgactgaggtttttatgagactaatgtatgttttcccagtagtacattcattgtcaaaatgaacatcattgatagatcttagtgacaactttgatatgtggcaattccctgttcttaggtatatttaagagacacaaggccttatttttatttatatatttattctactgaaatccagagtacttttacaatttaacccttagcccaaggtatttcaaacaatgtgtcacttatttatgtatttatttttttctgatagcagaatcattatatgttcatggtagaaaatgtagaaactacaggaaagcatgaaggctaaaataaaattaaaaaccacttcaatgctaaccccagaaaaaaaaaatcactggtaacattctggtctattttaaacttttctccctctaccagccaagaaaatgtaaatgagacaaggtgggaatttcttcatgtaagaggaaaacaataaaacagaacaaaacaaaagcaagaaagaataaaagtagcctgtgggtagaaagacaacccagaccttttatggctgctccgtaaatttttccaagacccaagttactcatagttcactactattccatcctttgagttcactatattcctagggtacctcattttcatggcccaagatggctaatccagcttatctcttatctctgcattctggccagtaggatggaggaagggaattgaatgagggcccatcctcggcccttaaaagaggctttctgagaactccatgcttcttccatatacattgaattgtccagaatttagtcaccttgttgcaaaggtaggtgggcaagaagtaggagtcttagaaagaaaggaagaataggagaataaatgaaagaaactatcaattttttggtaggaattctctctagttggtgggattatggatgacttatttttccgtatatgtatatattacatatacttgtattttctaaatttgatataataagtgtacaaagaggtttaagaaaactggaaagagttaatttctgtaagacaggtgaaaatatcaggcatttttcagttgtttaaaaataatcaactgttttctttttaaaaaaacttacataaaagtagtgctgatatttcagcttgaagaaagtaaaccaatgctctatagaggctaagaaattttccaatatcacaaagcttatgcataatggaaactgtcaagcagttaaaaagatctcattttaaattcatgcttattacacaaagcaacagttattccctcaaaggagggaaactgatgtttattaagcaccttcatgtgccaggtgcatatagcatgtatataagattcctggtctacttaattatctaaatcaaggtttggcaaaaattatctgtaaaaagtaagacagcaaatattttaggctttgtagactaagatgctgaatcaagaatatcatttgggtatttacatcacaaaaaataaaataaatgtctttttcttattttttcaagcatttaaaaatctactctaagggtgaggggaaatttttttccaccctctgtaggtatgataattttagtttctgataattttagtctctagaataaactgacagtaagtgaattaacaggagaaaaagcatgtacattttttatgtgcatgtgcttgagaacatcacaaaatatagcttaaagaagggtcccatgattgaatcttagacagcaatttgcattacagaaagaaatagaagattggggcttctctgaaggaggtggcaacacaagctatggaatggtgaggggaggaaatgcatgatgatcaaatattgtcttatcgcacagataaagtctctctggtacggccctcagaggaataggtgaaaagtctatctgggtttaatgctctagttatggaaacttttagtcccttctcctgtgatatgaataaatcttgcctggttaatgtcgattacagggagggggttcacaattgaaaatagaaatctagggaggttttaagcagtgtttctaggcccttttctacttaaatgatgttgtgattgtctccttaaagaaaaggctcattgaatgcggtgtattagtcatgaatggcaacaaatctgcccacacaggagggacctgacttgctgagtcatgcactcaaaagcaagaaatgacagactgcaactggagttgacaagaaagggccttgtataaaggtgtcctgtgaattgagcaggacgagtgaggttgctgagtgacgtaaaatttcattggttctcagtagctaggcgtttgaagaacctcagtagggatagtcattgagcatatagtaatcatcactcctctctgttgaactctcagtgcttgccaagcttattgcatagctagttgtaaacttctaatttttcacaacaatgctgataggtatgtattattccaaatttataaatgatgcaactgaggctcagcaaaattaaatcatttccaaggtgacacatttataggtagtagagctgcatggaaacgtgaatctttatttatttttatttttaattgacaaataataattgtatatgtttatgtggcacaatgtgatattttgatacatgtatacattgtggaatgaccaaatcaggacaattagcctatccatcacctcaaatatttatcatttatttgtggtgagaacattaaaaattaactcttttaggtattctgtaacatataatacattattattaattacaatcaccttgctttgccacagaagccagaactgattcctcctatctaactgaaacttttacttgttgaccaatgtctgccctttctctgtctaccttcttttcctccactccagcctctggtaaacaccattctactctatgcttttatgaaattgggtgttttagattttacatataagtgagatcatatggtctttgtctttccatgcctagcctgtttcacttaatataatgtcctctaggttcattcaggtcatcacaaatgacagaatttcctgttttctttttagggctaaatagtattccattgtgtatagggctaaatagtattccattgtgtatacagaccacagttttcccccttggattacttattttcttgtactttagtcagacgcttccccaaatgtgtttcaatctccataatggcctcttttccaaagagctgaaactgtgccctgcctcttatcatctttatgatacctcctgccctctaacataaaatattttaaaaataaatactgaaacaagaacttagatgagttttgcaaaacagaactgtgttctaggcctaaatttattgaaagtaagggaggggggcaggtgccatggctcacacctgtaatcccaacaactttgggaggccgaggcaagaggatctcttgagcctaggagtttgagaccagcctgggcaacacggagaaaccccatctctacaatatatacaaaaattagctggatgtggtggtgcatgcctgtagtcccagctacttggaaggctgaggtgggaggattgtttgagccccagagattgaggctgcagtgattcatgagtgtgacactgtgatactacactctagcctgggtgacacagtgacaccctgtcaaaaagaaagaaagaaggaaagaaagaaagacagaaagaaagaaagaaagagagagagagaaagagaaagagaaagaaaagagaaaagaaaagaaaaaagaaaagaaaggaaaagaaaagaaaaaagaaaagaaaagaaagtgagggtatgaaagagcaatgagtctatgggggtacgtccacacccaaggtcatcacattgcatggggcaagtgagatggaaaagggtcactgagtcttggggcctccagaaacatcagaaattaattgatttatcaattgggaaagtcttagaaaaatgtataaagacatattgtctgtacataggaggcattcacttcccctcaatgtagactaaaaaaagatgaaagaaagcccataagcccacattaaccaaacgcacacacatgagaaactccaagtgtccagattaacaccctcagataggcacttggtgttttcagctctggggctggagagaagattatggggctttggcttacagagacagaagcttctgtccccagagaggggacaatagcttccgaagtctctggcaagtgatctggcaggtggtacttgacaagctggatgggaaggaagtgctgttttgaagaagattctcccctccttccatttcaccaagacagtgacttgcagaaagtttgtgtcctatgcatttcttgaatatagaggactggcatttctaaagagcacatctctgaagggacagatgctggccatttaaatgtgggctttgcatgttgtgaactgactggttctgtgcagtaggactaggtccagtttgctattaacagttgtatttgcagagcccaatactctctctggcacttagtacgcacacaacaaatgtttgctgaatggttgaataaagtaatccagaatgaaaatatcatttccccatgaacataaattataactttttttcattggttatcaattatatcacattttaaaatcctttcttctgttgacagacacttgtttccatatcttggttattgcgaataatgctgcaatgaacatgggagtgcagacatacatctatttgtcatatgaatttcaattcctttggatatatacccattagtgggattgctggatcatatggtagttctatttcaaattttttgaggaacctccatactgttttctatgatggatatagtaattcacattcctgccaacagtatacaagggttttcttcacatcctcactgatacttgttatgtttcatgtttttaataataacaaatttaacagatgtgaggtgacatctcattgcggttttaattttcatttctctgtgattagagatgttgagcattttttttatgtaactgttgccacttgtatattttcttttaaggaatgtctataaatactctcctgaatagcaaaaacaatccttatcaaaaagaattaatctggaagcctcacactacaatatttcaaaatatattacaaagctacagtaatcaaaatagcatggcactggcatcaaagcagacacatcaaccaatggaataggatagaaaacccagaaatagatccacacatctatggtcagttgatttttgacaaatgtgccaagaacacacaatagggaaagggcagtctctttaataaatggtattgggaaaaccattaatagatatccagtgtatgatttgcaagtattttctccaaatccatggattttctcttcactttattgttttcttggctggcagaaggctttttagtttgttgcaatcccatttgtctatatttgcatttgttgcccgtgttttggggtcatatccaagaaatctctacccaaagcaatgtcatggagcatttcccatatgttttcttcaaatagtattccagtttaaggttttacgtttaagtctattgtttatattgagtgtatttttgcataaggagtgagacaaaggtctattttcattcttttgtatgtggataaggggtatacactatccaaaatatacatacactatccaaaatatacaaggaactcaaaatatccactaaccaaaaaaccctcaaataatcctattaaaaataaacagaagatgtgaatagatatttatcaaaagaagaaaaacataagtctttaactcaaatctcatgacccttttaatatatcatactgctgcttatgctactgaacaatgacccagagggttgtgttgaaagggtgcacggagcattttaaaaaaattgctttagcattgttttgcttgtgagatagagatagtgtcactagttggaatgaatgcacaattacaggtatttgattcgtggtccctgcattcattgagtatacttgggaaatgacatggatttttgaatttaaaggctagatgttaagctactggaaaagtattgagaaaatgcaattcttctcactcttctgctattgaggcttggggcctaactgcattgaaaaggaagaagtaagttgatttttcagttaacgtgattgaacagttcaattcaaatatagagattgtcaaagcacagcctacagaaattatttgctccgagggtagaacttgctttgatatggtagttagtaagttttataaagttttttctaaataaaacatttagagtaaagttctcaagtcttttgaatatggcacttaaaaaaattaaatagcatactttattgggcattgagaaatacagtttggaatatgagcagaattttactagtttcagatactttatgttctgaaactgtttacctttctggtttcatctcttgctgtttgctaccacacatttttttaaattcctgccataaaccttatttcctcaaatgcatacagatttttcctctcctgtgtggctttgccctgctcttcctgttgcctactagaactttattccctctccattggggtaaggcccattgattcttcatctactctggaaatccttcgtggctagggtagggggctctccttcatgatctcataacctacatgcatttgtctctccagtagcatttaccacactgtccggatgtttgctttctgcttttcccactaggatgtaaatagtttgaaggcaaagactgtatcttttgtctccataacccaatgcttgggccctagtatactcagagcaaatactgattagatggtttaggatactaaggtttatttgatttgcctagtgatatattttctcttctaattcacccaactttttgcttttctgcaaacttttaaatattgggctatcatagtagagagaaagttgctgcatccattgttcgtcaaggatgagtctcactgcatcagtgagacttttgacactttagtcctgactcttatctgggaaagtctaaagccaatttacttaacttgcaactctctttgtgatccatatcaatacaattcattaaaaaatagtaatagtttaaaacacttatcaataaaaaacagatttaaaagtgatttacatacagctaataattaggcatttttaggaaaatatttaaaatataacattcaagggtgtatagctaagttttaataatatatgtgctcatgtatagtgatctaaagattttctctggttttcaatccaagagttatttgtggttgttttgtttttgttttgttttatctagagccactcaatgtagctaaatagatccagttatatatgttctttcacatttgtgctaataagcgaaaacaacatttaaaagccatagagaaaagggcagaaaatctaaacatgaataatgaagccctataaaacctctgggcagttttagcagagtttccgaaaggaagtgtcctctgggactcaatcaaatctcctgtacttatttttaaagggagcttccttttttaagtcaaagatagaaatagttttacttggaaagtgtcctgcaggtgtaaattagcagactaactccctggggctgaaatgtcttccttatcttctttgttctttttgtctttagtaatgaaagcagagattgttttgggaatcctttttttctgcctaaattcttggaaagcttaagtttgaaagctagtaggtctaggaattttctaggctaatgagaaaaaaaaaatcacgctacccctagggctattgttagcctaatgggaagtgatgggaaataaaaacaaccaagttcgttctgaggcaaataaatttgttaagtgctgagatagaccaatttttccagccaaaactgggacttattactgtataatggcccataaatttagctgtataatggctgtataatggcacatacattttaagtttaatattttgaaggcagattcaagaaactgactgtaataagagcattctggtcacattgatacagcctgccagagtgtaaataggctctgcagcagaaatgtgtcagaaatgtagaaactgacatttcaggactgcccccttagaccattaccataaggaagagctactttattattatttttttaacagttggttgagcagaggttttcagaattaaaatgattttgaaataaagatgaaatgtgcatggttattttattaagtgcatatttgttactgacctcccagctcatttctgcactcagtttcctgttgctgtacttttcagagtttcatattcaaagtgacagtgggaacatttagcgtagaagccaacaaataaatatgtcttctacttcccccatgcccaccccacctctaccatgttgagttggaaacatttaattcagtgatttgcacaggggacaatttcaaagcttgtatttagaataagaaagtggctgaaaaggaaatgttatgctcaatagaaaattatgactcactgattttgcatatgggtaatatttttgaaagaccacttatcttttgggaagtgtgtgaaactgacaggaattatattgaaaaccagccagatagccatgataagcaggaacctgactttgttttggatatgcagggttctcgataatcgtagtggtttactaaccaatattctacagggaagaattattctttaccttatggcagaagcatgccttcctatggaggtcgttctttaggtgaagtaacaggaaccatctactataacttctcactgacccagtcccatgagggctgccccaaggtaggtgaggaattgctccccagtattagttacccatttgaatacaattcatttctaccaacagcagttttctcctatttttcctagagcatgcaatatctaagtttagtttttaattcttgaggatgccattttaactaatggagttcagtaagtgacagccctgttttcctcccaggcatttcaaatctagttttaatttagatcagcagttcaggagcaaattatttgccaaatgcaggtggcagaccgttgcctttctccctaatgtccatctgtggagcactttgagacttttctaaaatgatgaattgatatgtctgttgggaaacagcttgttacccagaacagtggtgtacataaatgagaagcctgcacactgcaacagagaccacaggtggtattcataataaggcatctgtggatgatgttaaggatttttgaagctatttgattttttttttctcttttcaactaagggttttcttgcttagctaacatttcattttttaaaagatttgttgtgttcttagaggtaatgcctttacaatttaaatatgtccaagaatcctttttattctgatactttttacagtcacgaataggcttaacaactgatatggatcatgcaggttctcaggagactcagaatacaacttttgttttgtaatgccacctatgtctttattgaaccctctattttatttatttatttatttatttatttatttatttatttatttattgagacaaagtctcccttttgtcacctaggctggagtgcagtggcgcgacctcagctcactggaacctctgcctcctaggttcaagcaattcttctgcctcagtctcccaagtagttgggattacaggtgtgcaccgccatgcctggctaattttttattcttagcagagacggggttttgccatgttggccaggctggtctcggactccagccctcaggtgacctgcccgccttggcctcccaaagtgctgggattacaggtatgacccacaacacccgtccctgaaccctctattttaaagagaaacaaatacaatgaagagtctataacacttataaaaaacaaacactaaatttcagtcaataagcagaataattaaaatatagggttttatttttatggaatacaggttatgaatcccaggatttcagagttggaggcatctgaatcagatcaccaatagatgaatgatttcgttttcttgtcatatagccattttgtacctacttaaattcttccagtgatagaaaacttatctcttctaaaataagctcattacatttttaaaatgcctcctggcctctttgtaactttatctccagtaagtcaatctctctctctctgtctcaatctctctctcacttaagagtgattcctgtgtgatttagtttattcattcatcatttattgaacatggactctgtgctgggcactgaaccaggtttcaggacttcatggatgaagaagacatggtctattttttcaaacagttcatagtcaaatgggagcaacaaaaaaggagaaacgaaaaattatagtacagtgtgataaatgccttgttaggactaagcatgaagtgatacaagaacatattaagaaagcacatagcctggacttgtggaatatgggtaggctttcaggaggaggtgaaatttcaggtcagtcttgaggaatgaacaatgaactagaaatattaaaaatgcataagatttttaaagagagatttttagaaattctgttttcttgtgcagttgaattttctaatttattcagaaatgtcatgaattcatgctgtgactgaatttgttaaaaaaaaaagaccaaaatatggtttttatgtgttttttttcatttttgatacagagtctcgctctgtcacccagactggagtgcagtggcgcgatttcagctccctgccacctctgcctcccaggttcaagcgattctcctgcctcggcctcctgagtagctgggattatagatgtgcacctccaggcctggctaatttttgtatttttagtcaagatggggttttaccacgctggccaggctgatctctaactcctgacctcaagtgatctgcccgcctcagcctcccaaagtgttggaattataggcatgggccatcgtgtctggctggctttcatattttgcaatgaagtatagagtcttggatttcaaggcagatacttctagaggctttgaaactgtccagattctcagctaacacagatgggatgttggtcagttggattccctcgctggctaagtgggtctgacttgactgtctgattcatacttgtcctatgggctttgaatgtggtattttatttgatcctcataggagtgctttggggtaggcactacagtcagcattgcatatcattattctgggatcaccagttacaaataagtgaaaactgtcaatctgggattgctaaggtaaaacagtatgatactaattgtatgaaggtaatactctcagctgatgactgagtgttatgaggacacattctctgagatatcatccaacttgcatgtagcttaaactaatggaagcagaccatttgttacactacacgatgactgaatggtggcaaagaagaccctcctattcaggctttcagctacttttttccttctgatccttatgtgtggttcctgtggtcttggtcagtatcagcaaacatgtttagtgacaatgtgttacctgttacttctctatgctataagaaacaaaggaccatgcttttcatgtgagtggaatttagcactcattttgatattgccactagaattttatgttagataacaaaattatgtgtgtatgtatgtgcatactatatgtgtatatgtatattcatatatatgaagccctttaaagtgttcatttgcttttctcaatctgtatctatttatctaactagtgtatgtcatatagtatatattatgcaatattataaaagaaattatgcctgtcaattataagaaattatatatttgtaagaaattttgcctgcaattaaaaatatttcttacctagtgttatatttaatgcttactctaagaaatgtgaaacaattttctattttcataaaaaaatagaatatgaacagaactttgtttaaagctttggcacattttgaggtcagatggtcattatgaatatagtacagatcatcactaaataacctatagatgtaaatttttcactaaatttatttttatttaaatttaggaaaattattctttttttttttttttttttttttgagacggagtcttctgtttcaccagggtggagtgcagtgacgcaatcttggctcactgcaacctccacctcctgggttcaagtgagaaaattattcatttttaatgtaaagtggaatattagtgttataagaataatttgttttatatattagaaacatttatttgatgtgcttttctttctcagagaaaacaaagaaagttcatgtgatcaacacaagtgtgtcaagatggtcacctcatttgcgttggggtataccaagtcaggcagtagcaattttgttgccttagtgaccatttagaatctagtttaatagcctatgtaggcagcttaatatagaaggcttgttttcaacattatgtcctcaagccagtcttgtgactgattgaaataaatttttggaggaaaaaggcaggtcaagtcttaaagaacagcaaccacgttcttcgtttagcgttcagctttaatgtcacctgtttctctgccacactgaagtaacagctatgctcactgctgcacaggcatagaagagcatggtattgcctggctttcaacagggaattccaactctaattcttcatgccaccatcatctcttaacttgtgatcctacttggatttttatgtatactgaattatttccttttacagagaaatattaaatttgaaacaaaattatagtgtatttgctaaataggtccatggaagtcccatacccccacacacacattttagtttctgccttttttattgttccacttaaaacgagcttctttttccatttgagagaagtgactgagtcaagaaaagaaggcatgaataaagaattcagggaagaaaatgatgtcttcatgttcaattattatcaggagtatacatagtactatattcatagaatttgcttgtggcaagcaaatagatctaagtgagttttttccttattattctcagaaatgagtttttcttgttgtctagtgttttttatttttatttttgtcaatgcatcatttgacagaggggaagaagaatgaaaagaatgacatattttcaagattttctgtcaatgctgatggcaatcatgagccataattctaatgataggtttctgaggagtgaataagagactattaaacgtacttgatgactttaaggtaacttctaattacagaaatgtcaaaatgtgaataacgtgttcatcttacaagtgaaaaaatatggaaattaagaataaaaattatactagtaagagggttgaaagattaagaggagaatgaaaatataattcatagaacagttgctattattataattttgacctaatgataaaatttgtggttttaaaagtgtctcacagaccttatttgcctattactaactttaatagattatacttatagtggtaattaggttaattaattttaaatcacattggttattgcctctaggacaaaatgggtgtttaaaccttaagtttgtataaaaaatgatttgacactgaaatcaatctacttttattagcttctggcagcaagaatagatgtggtttactaacagcaataatgaaagagcatcaaactttgataaaaattctgaaggaatgtcaggggcttaaaactgggcaggtcaataaatagccaaaaagttaaattcaagatcaagactacactgggagacagagggaggtgatgttgtatcaaagacaagaacaggaattcacacagtccgacaaaaatgaagtatgctgagaaagttgccttgccagtggattattggtccacagtaaaatatctgacagtgctttttgaggactccaaattcttttgatgagactgggttaaatttcagttatatcattgtattttattttattgattattctgtttttatctgattcttctgtgttaatgtagatgtgaaaaaatttctaaattggctttatgtagaaatgtaaatgtctggttggccagctacctcacctgacctcaaaatatccttgagggctctcagtatatcctttttgtgggtacattcctcattcaagtctggcaaaggactgctttccccaagataacgtatgctttccaactttcatatttttttatgttctgcatgtctgggatggcctttccctcttcttgctgtctttccagattttatctttccagatgttatcctcctccaagactttccttaagcaccacctcttgtgtaatgcctttcccgattactctattgaaaagtctctaaggaattaattatcaatattatattttgtgcttcaaagtgttgacattcttcattaaaagcaacaccaccaacaactgtcaatttgaatcttgactttaccacttcttagtttccataggttttagaaagtccttaacccatggttttctcatatgtaaaatgtggacattaaattgatagccttgtagaaaattggtatgaagatgaaataaacttggcatacaaataagtaccaaaaataagaaattttattatcaccaatatggcacttaacatctccagactttttttatgtgttaaaactacagcattgtcatcttatggacatgttatgtggtttacggtataatctcccttcttataataagattaattctctaccacatgtgtaaactagctttttttggcaaagggttgtcatacttgctaattttagttttatactaccttcaatatacataatactttatagttgatgaactattcctcagtgttacatgtttgaggtccccacattgtcctttactgaaagttatttacatatattaattgaatgatacagttctgtctgattgagtgtttcttagaaaagcttttaaaagtgtggatttactattgtttttcacctttatgtcttattactgcaaatgcaaagtcatatacccttaattttgaacaacatataagaaccagctcccccaaaatgggcagccaaatgcccccacatctacccaaacagatgtttagatgttaaagatgtctaggaataaattctgcctgggattattgctaataaagttcatagaaacaaccataccttctcatgtaggttgtggttctccatcccttcgtagaccaaaacctttacctgatgagcaaaatagaaaactgttgttttgcttctgtttttgctctactgatgaagaactaacaaacagtaaaacaaccaaagaaaggaaaactaataatttgaaccaatccttgattatatgtttaactctggtggagtttcatgatataaattgatgttaacataacctcataactcaactgctatattgatcatgaccttcgccatcatcaaagaaataaaagaaaatggtaataggacagtggcagaggttctactaaatctataatgcaaccatttgtttaccttaactccagtccttcaaaaggatcagaggcttctaattgcctttttctgccactatattaatatgtatagacagtgtattgatcttctttctgtattcattggtattcaaggaacatgatagcttgttctgaatacctatgaatgttagaaaatgtcaatgccggtgcccactctcagcagagatatccattcacttttgctgggatttaattctgttgcctcttaattgcttgaagatgttttgaggatacaagtttaaactgaatcattttttttcagcaggttaattggacaacagtattcactttgtaagtgaatggatttgatcctcgaatgggaatatctatcttgaaattgggttataaattaatttgcaataatattatttcagatagcataaaaatatatacatcaagtgctgctaaaatcagtgatatgaattctgagttcagagagcatctttaaaaaaataaagtagatcaagtaggaggctggatggggaaggtaggtgagacagtcatgagagctttattctaatagcagctcagctgctcactgtcatttaatggcatcacattccttggcctccctgaatctcaggttttaatatttaaaatgaaggcaggtgctgatgatctatgatgctactcctaactctaacattttgtgtttctaatttccaaaagaatttagtcaatatagaaatactttgttacaatttacctgccattatgaactaaacaatgctacttgtcactcaaaaccacaaatgcaaaacgagtgatgattgaaactgaaagcaaatatgcgtataatctctcaaaaaataataagttttcttgttacagaataagggagtgattggcagggaagctgattattataagcctatttcatgatttttgaagtagaaaatgaacctttttttatatctaaatgtgatgacttactaaaatctaaaatgagaaaaccaatatatgtaattactcattgcaaatgattctccagatgatttaaataaaattttattatatataaagcatattaattaattaatgatctattgacagcatttaacaatgattttttttttctgtagattggctaaatttagtgattctaattctgtaatttaacatcataatgacagtttttttctcctctctcaccatacacatggaaacagtgagttaaaagactaaactctaagttgagtgtggtagtgcatgcctgtagtcccagtggccagggaggctgaggtgcttgaacccaggagtttgaggccagcctgggcaacatagagagactcaagactctgttaaaaaaaaaaaaaaaaaaaaaaaaaaaaaaaaaaaaagaccgagaatctgaactctattctcttgtctaaagcactttttttcaagttgtacatatacattaaatatactgttctatgcatgacgtttcatggtttttaaaagtatttactacttgcctacctctgcgtccctctaaatttccttaggctttcagcagtgttgctttggcaagtgataaccggggaccaaatgctaggaaactccctaacataacaataggaagcattccaaaatacagcccagcaaacagtggatacaccacatgcctcctgctagatttcaaagatgtatgtgttaattacaacaggtattgcaagttggatatttttattcttttttgctaaatcccctgattagtgagactcaaattgaaattaagatatatatgaatttggggttggtataaacatatttttagatgtaacatggagaaaaaaataactagtgaaataaaaacaaactccacctccaaaccttagtttcaaaagcagcctattttatggttcccgcacccgtcttttttgtttcttttcaatatcatgattaaagagaagtaaataaatgaacactaacacttggacagttttcttataagcttgttcatatgttgacatatagcatttcagtctttactggttctcagatgccatctaaacttctgtaaaatatgttttcatatgaatgtagaattatttcctagagacagaagatcatcagggagtagagttccattaattctgtgtgtctgtatctgtgtgtgtgtgtgtgtgtgtgtgtgtgtgtgtgttttatatttttataatttagtagaaataagatctcacgatattgcccaggctggtcttgaacttgtggcctcaagtgatcttcctgactcagtctttcaaagtgctgggattacaggtacaagccacttctcagcctatgtgtgcattttccttaagcaaagagtctatggtttgcgtttctattttttttttttttttaacactttctgtttctctgatttcaccttgttctggttctctctattccagtaagactaccagttcttaaatgttgatgtcatgatatcattttattgctagaaaccttgcaatatatttaaactacaaaatcatagtttaggtcctgtattttgtagtatttatagcactaagcaactttgtcctcaaactagctaatgcttctttttatttctaaaaatatctattttctgctttatccaattatgtctacttaatgctctttgccttctaatcctaccaaaacccattccatatatcatcttcccattctttaacccacctctgcttttattctatttagttagtacatagggaaaagaacatcgttcttggagccaaacaggcatgagtttgaattttatttctgccacacagtaaagaaaataatctggggggttacctaaccatttgaaaaagccttagaatggtcagccataaaacgagtattaagtgattaaacgaatatcaaggtactcaatgaatatggatttttcctcctcctttctgcacattttttatttctggtcttatcttgattcgctgcaaagttatgtttccttatctctctctggatatgattcttacctgattactcagatttgttttccttgaatccatttgcactttttttctggagttatccagagatctcttctatccaatggcctattaattttacaccaaagtccctttccagccttgttttgcactctacctcaatgcaaccatctttttctccaaacaattgaatttaataatcaccaaattctcttcttacctgatatttcatgattattgtcatacttttaaaattcttcagatttatatttaaatgaaataataatattatcacttattttatatacaaatattcctttagaaacctaactttcaaacttatcacattcaaacaggggcagactcaggtttgatggggccttaagcatacagaattttagtagtttttttaaaaaagatcaaggacacaaactagaaagtccagacatagctccatcagtggaatcaaggtagatgttttaataaaatgagttagaaaaacagtctagtcatttggaaagagaaaaagttgaacaatacctcacagtgtacgccagaatgaatttcaaatagataaggatttgaaagtgtaagaatgaaataaaaattaatagaagaaaacattgttcacttgttttataatcttgaagccaagaagatctttctacttgtaccccaaagtttattggcataaatttgaccactttccaatatatatatttttttgagatgaagttttgctcttgtcacccaggtgggagtgcaatagcacgatctcagctcactgcaaactctgcatcccgggttcaagcgattctcctgcctcagcctcccaagtagctgggattacgggcacccaccatcacacccagctaatttttgtatttttagtagagatggggtttcaccatattggccaggttggtcgcaaattcctgacctcagatgatccacctgccttggcctcccaaaatgctggtattacaggcataagccacagtgtccagcccatgttgcaattttatatatatatatatgtatatgtatatgtatatatttgcatagaaaaaggataccatcagcaaaaccagaaggccaataataaactgagggaaaacatttgcattacatatcataaagagcaatctccttaatatgtaaagagtttcttgaaataaagaaaacatacctacagcctaacagaaaaatgggcaaaggtcatgaaccaacagaaagcagatagtttttaaacgtataaaagataaataacctcattcatgataagaaaaatgcaaatttaacactatagtgttacactatttctcaccttttagattggtaaacattccaactatgacaacatactctttgacaatgttgagaggaaacaggtattctcatgcgttttagatgtaagtaaaaatgaaaaaaagactctactggaggggaatctgataagatcccaaatgctttataggtatctttacctttgatctagcaatcctacttctgacaatttatcctaaagatatggtcatgcccctacaaaatgacaaacgtgctgggatgtttatttcagtatttcagtgcttttgggacaacccagaaatacatcattaggagattaaataaattatggaatactatgcagctgttaatagataatcaggaaaaggtagcaaaaggtaatatgctaccttttgaataagaggagaaattaacagcatgtattcatccttatttgcttaaatttgcataaaaaaggactggaaagataaatagtaaaaatagttacctttatttaggtcagagattctcaactgggagacatttagcaatgtcttgagatatttttcgttattacaagtggagtttgtgggtggggttgttgctactggcttctagtggatatagactcattgtgctagtaagcatccttaaatgcacaggacaacctcacacaccccacaaaaaagaatcatccagccaaaaccatcaacagtgttgagactgacaaacgcttccctatggggaagtagggcaataaggcctatggaggtgatgggccagggtcaagacttctctgtgtatatactttttacattatttctttgattcatttaaatgtattacctattccaaaattaattttaaagaactattaaaatgtcaagatttagaacagcagtttttcttcattctcgctataaattttagtaagaatgaatagcaggtatgcttaaaatgctttgacatttttctctaatgcaatgctcttctggatatgaaggaactcagttgagatgctgataatgttctggacactcacgtacattttgctacacagataccaaggttggcgaataaattaaaagctagtccattagattagtaggacctgccatgagtgctgtcgtgggaaggattctgcaggcttttgtggccttagcagtaaagactgccatgataaattagtgatgctcgccatggtcaagggatggaaagacatagacacatgtttcaggcacctgccatctttgatttatgcaaccatatcggcaggctctttattattttaacatgttggagaaaaaaacaatgtttaggcaaatctaagttatatagataaaacttagacttatatatatatttacatatgatatatatataagtttaggcaaatctaagttatatataacatatatgttatatatataagtttaggcaaacctaagttttatatgtgtatatatatatatatacacacacacacacgtcatatataaagtatatatatgtaataacttagatttgcctaatactgttttttctccaacaggttgtgtgtgtgtgtatatatatacatatacacacacacacatacatagatatacacacacacacacatagagagagagagagagagaggaaacagaggtagaggtgaataacagaatgctgttgcagctgcaggtcctgtattgctaacatataaccaagcaattgagctctaaaacatagcagctccatgtggtagctggtgacatgtacatcttagagatgaaagaactggagttcacatagttggtgagtacctgagccaaaagtgaaactccagtctgtctgatccaaagcctgtccttgttattattccttgtagttcaacctatacacatgagcatatataagaatactgcatatataccatataaattaaaaatccaccagttttctaaattctgagggaattaagaacaaatactttgatccatgagtttcatcagataacttcttgtcatctggcaccacaaaattatgtatttcagatgtttgtgaacttgagtaactttgcttttatatgtccctagatattttaatttaaatgcatttaagcataaaaagagaagtgttttttctagatgagtttttataaaatagtttacgattttatcagttccttcaagactggcatattatttttaaactgttaagtattttgaagcctaaggaaaatatataatctagacttccctccctccattaaactccctcaaactggtgtacacatatacaaaacatggtgatatatttatgttttatagatgattgaagaaagtaagggctagtgatatctggtatcttgtttcaaatcatactgcctctctagatcagagaaagaactagtcaaatgttctttctaatacatcacctgtgtaccccaccacagtactgacgtgatgttttagtatttatttagtatttattacttgggcatctattatgtgccagaaactattctaagttgtgtacaatggatagtaaataaatattctttgtgtgcctaaacctcaaaatggaaacaaaattacaaagacatatccaaatcccaaatgaaaaatcagtgtttggcatctgctatgtgtggttagactgcaggaatatgtttgcataaacgaaaacacctgcagaataagggaatgtcaaggaaaaataaaacacccattataatcatagcacacgtggaggagtatattttataacattttcaattgtctattagtacagtgtgtactttaacatccttgaaagacttttccttaggctgataattctttagcagacagcagtgtcttcctgaattttagcagtagtagcttaagtatgtttgcaaagaaaacaataacctttcaaaatactaaataactatatgctatttcatgggatttggcattttatatctgtgctctgcaggcaggcatcatatatatttattaccaaatgtgtggtctgggcattgttaaagtctcaaggaaaaggctgatttgggagagaagcagcctctactgtactaaacacttttccacagctggttatctaatcacacactggaattttattgccattttgtgggtgtttgtaagtttcctgttttaagcatttattccttttttccaagtgtttttttttaattgttcaaccagcaagtggtaaaatgcagacttgcaaaattgttttcacttcaaaaaacagcaattgtttctactaaatgttcccatgtatggtattttggaagtcagatgttaatacttcctggcccctctatatagaaatttggggattcattaatggggagcaaaattgatgagtaaatttaagtttaaaatttgatacacgagtcatagtcactcagtcatttggtcaacaggcattattaacctccctctgtgtggcaggcatttttattaaggtagaatactttaatcttccctttttgatttgacctactgggattttctaaaatgaaaagaaagacaaaaaaatagctttgatagaaccagctcactgagaagacaaatcagataagaacatctgattacatcgatatctctgtgcagtgtttggggacagggcaatatttgtctgtcacccagtagtaaagaaggcataattcacatgataatgtcaccctggagaatttactgagttagcaataaattggaaataaccggtattttagtcaatggaggaatggtaacataaattatgtactgtgaaatataacacaaccattataaaaatcacaaggcagatctctatgtactaaaatgaaaagacaacctcgttataaagttaagtgagaaaaaaagaagaaacaagttgccaaaaatatgtaagaaaaaacctcacacctacataagcatgaattagtttatataggcttagagaaaagtctaggaggatgtacaccaaactaaagttagcgtaatctggggtggtagaggagaaacaaaatgtttccccattaaattctcactgttttaaaaaatcattttggtacaacgagtttataaattaagaaaataaatataaatgtgcaaaaaatgtgcaaaaaatatatatactgagtgaaggacttgcgcccaccagcagctaaacagagtgcatatatgtggtttaaatagatgagagaactgggaagggtggaggaaaatagcactgtgcctgataaatttagattactgcaaagtggatgagtgttaaaaccattttaaagcaactatagcaaataataaattggtttcttaaatagtgcaattcggtgatttgaattaatcattcagcataatgtcgtaaaaggttattattcctaaaacttttagtagcacattgtttgtcagagtaagaaaaatggtaatagcttagacttatttcaaaggatcctgctgtactctctatctttcagcctaaattaaagtatcaggcaaggcttgattgagtcatgacttgtcccctgtcactcatctggtctgtttctgagatagtgtgttttatatcagacaatctgattttctattctagagtaactggagatcttcttgctggtgaagggttggaaagagggagacacatttcctcagcagccatcttaacattgagtttaacaattacatagtagtcctcatggttttaccagtacagtttagttgaactgctgctccactctatgtgaactgtggctactgtgttctggtgtgaggaatgcaattacttctatgtccagcacaatcattctctcagtccaagcaagtcatttggcaagcatgaaattgaatttgcttctaaatcccaggcaacaaattattttctcctatttaagggacctcatttttctttccatttatgatgttttcacttaaaaataaggtgaccaattgtctctggactaagggatttcctgagggaattttagtgctactacttggaaaatactaaaacatagaccatcaacaaagtaaattcctgtcagttttgtatccaagaaaaaagcgtttattggaaacaaaacaaaacagagaaatccaaagtgtattcacttcctactgctgctgtaacaaattaccacaaacttgacggcttaagaaaacaaattattattttatagttctggagggaagaaatccaaagtatgtcataaagtgctaaaaataaaggttccagctgggatggttccttccagagactccagggaagatctgttccttttctctcccagcttttagatgctgtcagcatcccttagcttctggtcacatcccttcaatctctgctcccattgttacatcaccaccttctgccccattgacccataaggacaattatggggtcattgcttctctcccataaggacccttgcagttacatttagagcccacccatataatccaggataatccccctatctcaaaagtcttaatcacatccacaaagtccctttgttccatataaggtaacatatttacaggttccgggattatgacatggacatctttgggaggccattattcagccaactaccccaggttagaattctgctctgccattttctagttaggcaaagatgtaagtatccttgaagtcacataacaaatatttgttgctattcactgcaaagccgtttgctaattttgcatgggaagccatagagttagcagttcattgggctgcaggagttcaaattcttactccagcagctgttagttgtgagaattttgcttatgttaacttaaaccttttttttgccccagtttcttcttctgtaaggtggccattataagagaacccacttcataaggctattgtaatgatataacgaagtattaatattgtaagtgaagagcttagagcaatgtttgccacaaagaaaaggcttagacatggccaggcatggtggcttacgcctgtaatcccagcactttgggaggctgagtcaggtggatcacgaggtcaggagatcgggaccatcctggctaacacggtgaaaccccgtctctactacaaatacaaaaaattagccaggcatggtggcgggtgccttagtcccagctgctcgggaggctgaggcaggagaatggagtgaacctgggaggcggaggttgcagtgagctgagattgcgccactgcactccagtctgggcgacagagcgagactccgtcttactaaaaaaaagaaaaaaaaaaaaagaaagaaagtaaaaagaaagggcttggacagcctttactgctgctgcaactttgcaacttcaattgtgactgggtgttcttctgatggtcatactcacaattatgatacagtttagccttttcacatgtcatctttaattaattttcacatttcatttgattattttgggggtgaagttgatttgtttctttacagatttctctttccagtgaaactgaagagctagatagattaagaatgccttgagccagagtagtctttcttctaatggatcgccttattcagaaaagactaacattgtataataatagtagttaatatctttaacacgtggacaactaattctaatactaatgttcatttgagtatgtgttactattttcaaagccttttttaaatctgttatatcttgtgatgccagcatagacacctgctcgaggacttcagaatctccccctctcagatttcagcaaacactgatggagggggctgtggagaaagtagaccatccaccaggaagggccacacatgctaatgaataagattctgagtcccatactgtgattttctttttcctgctgagtgaacagcagttgggaatgggggaggagaagaactaatcaatcctggctttgtttgcgtgttattttattttatttttttccagggcaatcagcggaagggaaataaactgcttattaaaatgtttaaagctgtacttaaaggctttttctttagagccagccagatttctttttcttctcaatgttttttttcttctcttcaaaggtagcaaaatgtaatcacattcagggcacatagtggttagggtgtttgtgaagccaatggagagaacgtcattgtaagcactgttcccccaccctgaaggacggtgaaaacatgctaagcagaaaagtaactttatttttagtgctgaggaaaaataaaatgtatggatgctattacctagattctctatgttgtttttaacactggtccgcattagtgagaagcctgtgtgtctttaaaggcaggaaaatccagatttaatggcataaaaggaaatatatatgcatattatacatatatataatatatattatatatatacatattatacatatatataatatatattatatatatacatattatacatatatataatatatattatatatatacatattatacatatatataatatatattatatatatacatattatacatatatataatatatattatatataatacatattatacatatatataatattatacatatgtataattatacatatgtataatatatatatgtataatatgtattatatataatatatatattatataaaatatatatattatatataatatatataaaatatatatataatatatataatatatataaaatatatatataatatatatatatagtcttagttatcattacctgaataaagttcaggattttcttacaatctcagcaaaatataaatgtgctttgatttgagcattcttgaattcctagccattcaggcatgaacatattgcagattctaaaaaaaaaaccctattaaaacattttgcacctatagtgtcatgttgtaactggtaccatagggtcctttcacatgcctgtacatttttgtacctgtgcgtttattagcaaacaagcatttactgggtgcctgccatattccaggtgtggtgccacagatggtgaaggaggtaccttcaaaaggccttcttactctcaaaatgcttaaagttttaattcaataaaggcactttcaaacctgctctgggctacaggcttttcccattatgccttaaacactttttccctgaatcgctaattctaatggattagagggtctttatctcaataggcaaacagtttttctcctggacccacctctgcctttaatattcctttgatttttctccttgcttcccaaggagctgatatcaatgggtatctctaacacaatgcacttgtctcaacccccaaagtggcctgctcgatagaacaaaagctcctgcttatttgagaaagtgatgaggcccagaggaaaggaatatttctgatgttagatgttgaattggggatttggctaatgacctagggttggtttaaatccataaatttgattccctttaaattggcgttcaaatgtgtatttacacagatgttcggaagccctgaagtgggctcccttcaaagactcagattctgcatagaattatagacattatatacacccacacctgtgcaaacatggccgggtgctaaggtattaaactcaggtaaatagttaaaacttccagtggcaccttaagcctttttctttctttttttttttttcttcatgtgaagagagtaagagatctttatgtttttagtctgcaacagagcctattaaatgccccctttatgtgtttcactacattaggggaagacatacttaaaaaaaaatagatgcagcccttgatctgatcctgaccacatcaaaaaaaggaaaaaagaaagaaaataaaagaaaaaaagaaactctgacacatgaacaaataattgaatattacatgccaaattaacactctaccacagatattcttacaaaaatgcacatggcaattacagcatgctacttttatcatctgaaatgttcttaccaccctactccccaatcccttttatctttaccttccaaaccttcatttctcaaggtccattaaaaatcccatactgcccaccatgtattctatttcccatacaaaaaaattctctttaacattccacactagtttgcttgaatcgctgttccaatacttttcattgtgaggtgtggtaattttcatatatgctttatttctcctaccacgttttaagctccttagatcagggatattttctttgtgggccctattagccactggcatatagcaaatactaatcatatatagttctacgtatgttacatgtgacacctttttattcctcattccagatgaattaggtactcgtgtcatccctgtattactgggatgtaaaagttgcggcagacataggggaagtacatttcttcaagtcatccaaaaatagggtaaataagtaccctaaaggcatacatatactaggcagtagagctggggtttgaataggtgtgctcttaatcatgagacttttatttcagtcaagaaaggtaagtttgtactttcgaaaaaacaaccctcaaagtttgtggcttaaagtaaaaacacctatttgtcgctcatacctatgtgtcaattgtgtttctttgcttcatgttgtcttcaagctaggatccagcctgaaagaacagctatttatctggaatatcatcagaggctagctgtgtcagcagaaaagagagcgtggtgaatcacttactggttctcaaaacttctgcccagaaggaagtgacacaagttatttttgtccacatattcttggccaaaacaagtcacatggccatacccagtttccaaacagggtgggggagtactgtgctcccgtttgcctagaacatgaaaagtctgcactacttggtgagcatctctaatggttacaccagcagtactgctcctacctctacccatcacatcgtgctctaaggtcccattcagttgcaactctcttggggatgaaggtttgctgagggatgatgtatttgtggatgtttttaaaaaaatagaaataaggactttgttgaacttggcaaaaatacccagttcagagattagaattggaagcaaggataggcagatctgataacttggaccaaagcaagaggaggcagaataatggaaagcatataagaaaaggctttggagcagggagggtctaagtaatggttcagctcagtagctgaatagaaagctggagtaaatttcaaagaaccaaagtgatggctgaaaagaaaatatgaaaagtgaaagaaatctcttcagagcaggaattcattcatgtatcacacatgtgttgggtactcactacatgcctagcaaatgagctaagcccttttaccaatatttttatggcattttatgagataaaaaaaaagtatacccattttacaggtgagggagctttggtactcattgaacatcacacagctgcaaagttaagtggcaaacattcaaaccctgtcagtctggtgtctgagttcaaatatgcttaaacaaagaccgctgtctaagctcaaattcactgtcttatggaaaaagtcagtaagggtagaaaaatagaatttatgtaataacaacatttgtcaacttggatagagttttgcttctagttggatcacagatgttataaaatttaattgcttgctacttctctactccaacagtgtctttctcagcactgtaacacagcaggtagttataaaaaatcattgaagttgttactatttttatatttattagaactattatttttttcatcagaaatacccgggtctattacattagttttttctagtgctttctttggcttgcagtcttaagtaaatcattctgttttgtaattttgtaataatgacaactagtcagatccatgccttacagcagctcctatatctttttcataaatttctccaatatagaaaattagctatagaattacaagtaacagaacatatacttcttactttaaaaatagaaatctttacgagttgtttatgaaaactatagtgattttgaataacaaatcatgaaagtttttactcaattataaatttacacaaaagtgtttctgttgtcatcctgacacaggatcctctcagtgcccttttgccagccggaaaccttcatggcaggtggtgcctctgcctgggttttgctcaagcctgctggactcgttcaacccacttggcccaacaggctgcacttggctcacactaccagtcctgatctgggcatctgagccaggcatgtggcaagtggtttccatgttgggtgcttgcatctagatgaagggaacgtggtggcacccacaaactaccagcaaccacggagtcccaaagggtgttacagcccttgtctagggagtcccaaggtttgagcccccaagaaatgttacagttctgtctcattcctgctgcccacagtgtggcaaacaatgggggagaggggcatgttatagctcattgatgttatagctcattcatgttacagctcatttgttcccactgcccatagcatggcaaacaggtgcatgtcacagctcatttagtcctggtgcccacagctcagtaaacgggagcttgtggtgcccagcagctttttctcccctgttgtttggcaagtgggagggagggttacagtgttacagcacttttcacacccaccatttggtgggttccgggttcttgtcctatgatcaagaagaatgaccacagagtgagccagtcagggaagaattttgttgagcaacagaaaacctctttacaacaagaggggacctgaagtgggtagccctctgtgtgagaaggggcccgaaaacaggtagccccatgtgtggctgagtctgggatttttatgagctcagaatgggggagtgcatgatgattggtccatggatgggcctggaaaaaagcaccattcaattggctaaaaggcatcgagaaaggtccctggtcatactctactcagaactggcagctcagttttcaggctttatgctgtctttggcttcaaggttgggtttctctggggacctacctctgtctgcctaggaatttgtctgcctcctgccactgtcaatcttcaacatgtgtatttttatagcaatatgggtagctgtattctgactacagcaataaatgagatgtatataaatcctatgttacagtgcctggcctatgtaagtgctcaaatatcaccaaaattatcaatataatatcactgacattttcattatattactgatagcacataaattttagccctatattgaagatcaggtgtcttggtgatttggagggatccgagaatataaatctcatatcctcttttctctttctcttactctctcccatttctctaatgcatgccactcccatatttttcatcattccttgctgtgcccatataaatcagtaggaccccagagtatctcatgctaatccagatcatgaccctgatatgatatcctggttccctagggaattaaccagttaattagttaactttctagaaagcagtatagggaagttaagggctataatggtccactggtgcatctcatattgcccagcaagaatggaccacagtgagattcttaagcaatctctatcttgacagtgttcacctggctccatttcaaaagtacttgtcacttgttgatggtctttgtttccatttcttatactgcctgactatgcttaaaatttattttaacccacttttcattttcttattcctttgtgccaccaatctcaacctcctctttaattttcttgcctttattctttaagtcattgctgtggtttggtatgaatgtgtccccccaaaagcagatgctagaaatttaatacccaatgcaacagagttgagaggtggggcctaatgggagatgtttagttcatgagaatgtgaggctataaattccatctcctgctctctctcaccctttctttgcccttccaccatgagatggtagagcaagaaggccctcactaaatttggcccctcaaccttgtaattctcaacctccagaattgtaagaaagaaatctctgttccttataaattacccaggctcagatgtcctgctataggagcacaaaatggactaagatggtctctttatatttctttcatgtttagcttcaactctgtccttcagctctgtttgcatctctgcttatcaacaatttcctgtatatctaattcacatggaaaggatttagctggcacacaaggaggagactcacttgtccactctatccttaaaccaatgtcatttctttccaactggtcctggatgcaatgtcagcatccttcccagcatcccattggattaggggaccaactgccccagttttcctgggattgaacatgattccttggacacaggacttccagttttaaggtggaaatgtcttctgcaaacaaggataagatggtcactctacactaaagacatctctactaactggttgagttggcatgaggcatgaaactatttcctactactataatcaaaccttcccatagagtgtgctataataggctgcacatgtgaggtatactgagttattggttcctctgcccatcagagtagctggagctctgggccagtggcctttctctagaagcagatttgtacatttactctatgtgttgataaatattttcatattctacatgtgtgatgataattttaaaaagtttggaatgtattgagttagatagtacccaacacagcatatcacatttaagctaatctgttgactctcacgtagtaattgcaaggtaatgtattttgtctcaaatccctttcagaacatttcatgttaaaacattttttatgctccattaagcagatacatattttaccaaagcatactcatttaaaatatggcatttccctagaacttgaagtgaaactagaagattgggtatatttacagtaggttgggtattatgacatgttggtgtctgaacagaaagtttatatttctagcaacaatatgtttcagaccaatcacttatctctgcatcatttatttaagatgagtgaaataaagattttggaataaattgttgtttgtacattcacatctgcctggaaaataattgtcttgacttcaacttgatatttattttctgtaaatcccaatattaaatatttatttatcaacaggagaatttttgtatgtcacctcattctttcttgcagattatgaagctgtaaatcaattaaggtgtgctcttgataattgtcttgggccaggataattatggaatataaatgaaagttgaattttgttaaaggcagaacatttatattgtacgccagctacattaatgaattataggaggatttcacattctcagagaaatttataaataactcttagtgttgctgaatatcagagaatacttgtatttcttcaaaatctaatcattaaagatgcgtatagtgaaaatattgctttcaaaatgctattgtgctgtatgtatacccttagtaaaataacctcatgatgaaattagttcaattacataaatgcttaattatgactttgttaccattacatagtcttatctaattaaactcaacatcagagagtgtttattgccaattttataattttacaacataggtataatttacaacaaggcattaataaacttttctaatagtgaagaatatttttctttctatgcgtactattcttttgaaggcattaagcattattttcattgtgatgagtatgaaaaattataaaattaagaaactaataagcacataggacttcatttctcttttcctgattctgacctttccattcctgaatctgccttatattagaaaaaaatgtaattatgtaatttcatttagagtattgctgaaagatcttttcaattaagtctatacatatatttttaatggcattaaaactacaattaaagtaatgtacatgcttggatacaccctctcactacctctggactggcactcaggtcagagtactcaggaatggtttggtataacttgtgctaagggaaaatatctgatttccagtgattgaatgtttgactaaaatttatttgtaagcatttcttctgttctttctgtattactttatttgaatttcttaaaatatataataagcattattttttaaataaaggcatttttataagaatatggaacataaatatatagattaaataagatcagtattgtattggaatttttcaatattgaaatgtgtatattatttcattctcagtcgtatgtatcattatcccagggatttttcttgagtcacatgatcattcaagtgtgagtttatgttctgttaatctttgtagagaacctacaggatttaagtaaaataattgttgactgatatgttgtattcatatgaaaacatcatcgcttatttttgcttatgagatatattaatttaaacattctaaatataaaaatttgtgtaataaatttcattattcatttaaatatgaagtaattttctgagatataatttacgtaatattagaaagttaaaataagcattctcatttaaataatcaaatcacagaatggtatatagatcatatgggactgcatttgaaaccatagatatatatgtcaatctgtaatttaaagaggcattagcatttgccatccctggaaagaatgaaagaaatattgccaaacataattattttgaaggccagcataattataacatcagataggaatgatgaatattttaaagtatctactattagcttaaagctttctgtaatagaaagcttaaaagaaacaaatgaaatacctcagataatttctggattttctaattgatggtgagatttctactttatcaatttaccaatggagaagttgctggtaaattgatgtatttatttctgcccatgaggtacactaatttaaaacatcttcacttttgtaatggagtgaatcttaatgtttttcttcttagacatataaaataccacaaattctgtttattcttcaaagaacttggtgtcagttcaggcaagaagtgtttgaatacttagtctgtgcattcattcagtgttcctgaaaactttctttatactaccaggaaatgtgctttgatacaggtttacaaagatggagtaaaacatggcatttttccttaaggaactctctatccccaaaacctcagtctaatggggaagacagacaattactttagagtttcatgatggaggtatataaaatggtgtcattaaagcgtacttaaccaactctagagattttattgagggatgaagaataggatgagctcagaggagacttcctgtagaaaaccatacaccatacacttgtgttcaatgtttaattcattaagtagcctaaaaggtacagagcagaggaaaaatcattctaggcagagaagtagaatgcacagaggtttaaggacatgtaatgttccttgagagtttcaagaatttcaacatttctgaatattgagactataaaggcaggtggaagtaccttggagagggaagtagcggaatagtgcatgaaggaccttatgttccatgctaaataattgggttttatttaaaaggcatatctgtagccatcagaaaatttaagcaggcaaaggatgtggttggatgtgtatttaataaaaatcactctgaaacagtgtagagaagagatggaaggaggggagaggaataaaggtggtgtgattgatcaggagagaaatgacaaaggcatgatcctaggccagggcagtggaaaatggaaatacacagatggattggagaaagacttaggaatttaaatcaactggccatggtgaatgagttaaatgtgggggaagcaagggaaaaaggaaggagtctaggaaactgcccagcttgggtaactgtcggaggtgatatagactgtgaattggaaaatcagagaattagcaaaattggggatggagctgaacagagacaagagggggaattctagatgagtaccctcttctgataatgttatgaaaatgatatgcagagtgaatactgaattgtaagaattctaatatttgaattgaaaagacgtaaagtaatcaagatctaagatctctgtcctctaagaacttgagagggtaacaaaaagttaacaaacatacacaaaaatttagttacattttatttaaaaaagaaaatttaaagtatggtttcatttgtatcttacccttgacttcacgtataaattccttgggttttgggttttgtctgtcatcacttacgcatggcctgtatataccagtgactagtaaatgactcactggtgcttaggtaatgttgtggaaggaaaatggaatggagaatgtctatcagctgaattgtgttgtatggttctgcagtgtaggtggtcagaatttagaaaaacttggcaatattggaataagcaaggacgacttatacaaagatgggatttgattactgagtaggaggcaggcagctttccaagagaagagaacaaaagtgaaagtagcaaccagcatggttgcccatgggacagtaaggatgaagcgccaactagagcagagggcatgatggagcactgagatggctggaggtgggggaaaataaggccttcttacaaaatggcttaaaaaccagaagaatttagctttgatgtgagaacaataagaagcatggtagcattgtttgtggcaaagagaaatagtttaatagataatatattaagaataaatattactattttcttaaatttatccaattttttttcatctgtaggatactgaaaatattcagccttggcattttgggaggcatatcttcccctgttctgtctatcattacctctctaagaggaagatcttcatagctttacagtgccctgcccaacccacagtttccccctaaagattcttctttgtgccaacatacttagagaacaccctacttcaagaaaagctatctatttcccttgatgtgtcaaacatgtactagctacctgcataaataatatggacttccttgaagatccagaaagcccaaaggcctgtattaatatatttattaagttcctaggacatgaaccttaaggtgtgaattctgctgaggatatcaaggataaactagactttttctgttataatgagtgcatataaagagggattttgttgaataagtgaagctagaacactggataaatttgttttctaatttaaatgtgcttagggcattttcccaggtttggtttttccaatgaataattttattgctctatttgtatttataatatttattgggtctttttcttttacggactgattgttttcaaattctttcaaactaaatcttgcaatatgactttcaatctatgaatattcagctttagtgtaaacattttgatattgacacattgcgattgcacctttcttagtttagttttttctttgcttgagaaaattgataccaaccgtacttctcagtctctgagttgtttccagccataactagtaatcccatcattgccttaaatgcatttacccatgtgtttgatgtgctccaggtcaacataactttaaatgcattgtttatcatagacaagaattttggttatcaattgtggtccattatggccattctgtataactgctgttttttttttaataaagtatgttttactttgtgactgctttgtagctagaaaacaatcagcattctaaataaaacttccataagggaaaatggaaagtaccaaaatcaaagaaacaaacctatgcaggggagataaaaggacagatccagcccttgaactcaaagatcttatcatctagctcatctggcttaccatcattttttcaccctgaactatgttctaagagataatagaaaatggaatgagaaatttctatatgaaacaaacaacattatgtgcatacttatatagtctgacttacgcataattatgaagagagaaaggagaaaaatattttatagattcaataaagatatatcattatatttaaattccacagaaatcacattacaattgaattttaattttgaaacaaagatgtgtttaatttacagactgttaactagaaaggtagagaatgaaaatatgtttgtgaattataatgttaagtattactactctggaaagcaacctagatgtatttagaagcattttcaatactaagggattgaagaaaaaaatgtttttttatttctcagttaccttacaaagaaaatcacagcaacgtgaaagacttcttccctgaacaactcaagataattagtgtttcattgcattctctttcatacttcccccaacaaactattttccaagtttaaaaaaaagtcaatgaacaaatgtctgtgatggctttttcttaaggcaatgcaattctgaccttaaacgctttagctttactccttacaggggcttttgtaaatagcaatgtttacattgtgcattgttaggaaataaggtgttataggtgcccaaatcaagtgacccaatgtgaattggttgatttttactagattttcaatgatgatcaggaattaaaatttctttataaaagacgtcttgttcctccagtgttgtcagagttaagtcatttagtaatgtgataaatatcctctgttttctcttctgatttctcctcttcctttcaccgtccatctgcttggccattttgtccctaatgtactgaagtttaaacctaggagatactttttagggccccaccatctccatccctaactgcaattaatcttatcagtttcctcatggattaatgtgttcttttggggtgtcttacatctttcttgttctattatttctgcctttgtctatagcagtgacctactgattttcattctgtcagtttcccctccaatacaatctataatgctgtcagattcattttaatgaagaatcgcataggtcagatgaaaggttccccactgcctacaaataaaatactactaacttggctttcaggctcttccatgctcccatgccataaacttttgcaaccttcaatgtagtgatttctgtggtataaatatctacactgtaattgatttcaagcaatcagtgactgaagatccaactcagaaaatttctggatttgtaacagttgctcatggggctgctccagtctccagcacacacatcagcctgagttactctacactcttcaaccactttaccccaccccctaggcaagctgaactcttttctattcttggagaaaatgatttctaatcatttctgtcttctctgaaggtaattgtttactatacaacaactggtcttctaatccttgatttttctctgttggaagtacttcttaattaacaccaatacgttacagcttctgattttttgtgggtcatttaattgattttgctacagtctctcagacttcctcagtcctgatattgcatttcatgtaaatatccattgtctcctttcagaacatggctatggtagaatggtagtaaccatgagtttaatgctgtatggtcactgttagtagagttttaataatttcacttgtgattttttataactggagtcatatggaacaatgaagctactctaagcctggttcatgtgtgatcccacgtcttcttgcttcccccatctctaggactggttctgaatcacccatagccctgttccagcctggcctccccatcctgatcctacctgctgcccactgcacacagcaagagcctgggcatgggcatgcaaattctgtggtatctccagtcagataatagtggctactgtcccagccccaagctgtcagtgctgtgacacatttggtgggagaatcatcaggaaagatcctcttgcccaccatttcatttcatacaaatacatagtccatcccagcaaaaaggttgcaatatacgcttccaccatggattgctacagttcagtgggcctgtgggaagaggagttacctgacttgacttcccccaactctggctggagtgcacagcatgtaggtccaacacctggagggagggggaaacaccgcaggcacatgtggcttatacatgtgcagagtcttgctgcagggggtggatggtgcaggtgcctatagggcttggcagttgcctcggagcatccctgtgcttgaaagagtaaaacattacatagcaaatacaaaatatcacaacaagtagagggaggaagaaaggataaaagttgtatttgttagtacccttaatggactttttcttttccattttaaacaaagagccctgcattttcattttgcactaagctctgctaattacgtagctaatcaatcctggcccattcttcatttgttttgcgtacttcatctccgcctctcctctgcacctgaagtctagattcatttcacaaatgcagtactttgcacagaacattaggaaactttacctaaaggcaatcaggactatcagattcacatcccagttctgcaatttcttagctgtcgtatgacttgtggcaacttactgtatttttttgccttagtttccccatctatagcatcagaattttttattgcttcatagattttttgtggaattaagtgagacaacttatgtaaagtgcttagtccagtatctggcatataggaaatattaaaatggtagcagttctttaattcttattaacgtgatgactattagtttttggtggagtgagagacttttggctctgtgcattcagttcaataaactgaatttggttaaattcaataaggcattcttcccttgtggcaaagataaattaactacaagacttataattttttcaatttttcttaaaacctttaaaaaatttcttttagcatcattaaataactatatagttttttcctccatattgttatgatgcttaccacgtgcttactggtaaatccttatatgctgtaaattatttataagcaagtagcatttttatttgtctcattaatcattgtattcctcacagcaactcttgcacagcagatactcaatgtatgtatataaaattaataagtgtcctttttgtactaggtaaaccatatgaaattattgagtttgggatggctgaatattagcaatttcatagggtacctattttcttaggttcagagcctagttctatgattattcattgattttaggaaattaaaataaattgaaaaataaaattttatataaaattttctttaccgtaatgtttgtatgacctctacttctcaagcctatatagttatatctgcaccatttgttttaggaagatgcagtaaaacactggctaactggaattcacatgtaataatatcaaatacctaattattttaattcttcagtattaaggattttgacttgaagagatccagtccttctttctgtcttattaaacatgataaatatcattcaaacttaacttgatgatttgtgatgttacaggatttcaaaataataatttttgttttcattatataatgccatatagtttaagaaaactataattatgggattcatgggattaattttaatctttatttaccaaaggatatatttcagggactgcttttcttgttgatattaaacttggactcagcctctaccctaaaaactgtagtacagtcaaaatttagttatgtgagagttgtaactggtaatttttcaggttaattgaagttaattttttatttatccacctgtctatctaatcatctatgtctctacattcttagcttgaataatttctaaattaataaaataaataatctttttttttttttttttgagacggagtcttgctctgtcgcccaggctagagtgcagtgtcatgatctcagctcactgcaacctctgcctcccgggtttaagcaattctctcacctcagcctcccaagtagttgggattacaggtacgtgccaccgtgccccagctaatttctgtacttttagtagagaacgggtttcgccatgttggccaggctggtcttgaactcctggcctcaagtgatccactcgcctcggcctcccaaagtgctgggattacaggcgtgagccaccatgcccggccaagaaacagaatttttatagccaaaacattagaaatgttttccgtaagtattgaccaatttatgatcttcatactctcatttatttgcattttttttaaaacaagtcctctatcttgtttatactttattgtactaaatttaccaccattttgaagtaaaagtctactttcattgtaccttaatttatctgttttagctacttgatggaaaattaaggcccatagccagtgtatggaaaattatttgagccaaatttaacagcaacctcaaatggcaggcaggcatattcactaaatcttgattactgggcatagagtgtagtttagtgctgctgagaccattcccaatcttgctgagcttctctgagggaatttttctgaatatgatttgttctccttttgccatcaatctgtgtgcttatgaaataacataaaactgttgccttgtgcatcttcagcagactgctctgtttcattaaaaatacatggatgttcaaatttttttgaagatgcctttgcagaaaacgtaaaagttagataatttatacaagagagcatgaaagccgagaagtagtagtacagataacatcaaaatatcatgcaactgtgaagtgattttaatattttcaccatttttttgtaaattcattatctgcaaatccaatatgttgttgatgcatactgtacgttcacttgaatttgaaatgttcgtgctttttttaaagcacgaatatgccaaagcttaagagcatctaaataaagctttgctggtaccttagcccatttcctaaaagaaaaagaagaagacatctgagttaagataatcacaagctatagcaagttgtggtaaaatatatgtaccttaaatggtagaatatgtagtgaaatagagttgtttatgtttgtttgtttttctccctagaaaatgtaaatacagacttctatcacttaccagctgtttgggaataattatgtaatttctctgagctttaattttcccactgtaaaatgaggttaataatatttacttcacattcctattgggaagattgtgtgaaattagttaggtaattaaataattaatttgagcccctactgtgttccagacacttcctggattctggggagagggcagggccagaatctctgctctcataagccactagaccttacaaatgagatatttcaaaagtggtaattatcataataatcatccttttcctcttacttaacacttccactctgtggaagcctgcttgattagaagaaaacaacataaagtagtagtacctttttccattaaattcaactctatctttcaaatgtagctttaggaatactagaaataccaaacacacctgaattaggtaagtgttgaatgcatttgtgagatagagaaactgcttcatagtggacaaatgcgctttattagaccatacagctggtaactggtgaatgtgagaaatgctttaagctttaatgaaaaaaaaaaaatactgcacatgagaatcttaatagaccaaacagataaatttgtattttcaaataattgttttaaaaaaaaaaccaccccagattcccttcatattaattaattgattgattggttggttggttggctgattttagagacagggtctcgctatgctgcctgggctggtcttgaactcctgagctcaggagattctccagcttcagcctcccaagtagctgagatacagacacttgacaccatccctggctcagattctctttaaatagaaagctcacctaatgaaatttttaaaaaatgttttgattgacaaagtatctttcgactttccatggacatttaaatatgtttatttaaaaaataatgtgatcaaatttagttaattctgaagtaatacttaaagcaaaaagggaaaataacccaaccatatgtgcaaggatatcatgtttcacaactctggggggaaacatcgttttgtattttgtaagaatggtgccacctggagttcttcaagtcgttgtggccaagcatacgtatccagtacaaatttttggaataggtaagtgttatctagagagttattctgtctttctttttctcctcctcctttattcctttcttttctttctttcttttttttttttctttttcagagcacatgccgtcaatgacacagcaccctttacctttggtttgggcttagaacatgggatttgtaaacttttctgttttccctttaaggaaggggaaaggaactaccttttccctttaaaaacagcactttctctgtctcttttcctaaagagagctaattaataaataaacttgccacaagttgttaatacatttgccctccccacatccatgaacacatttatgtgcatagatatgtatatttgtgttacacacacacacacacacacagagtgtaatatagctcacacaaagtgacaaatctcaaagggaagcattttaaatagtggaaagggggaagtagaggaaatattttggtttatggacctttctgtttctcaaatcagactacagaggtagctgcttaatctacctgtttataaaagaaaaacccttgctgtcatagtctgtaggatggaaatgtgtagtgtagtatcttacacacatatctcaattttcctagggtaggtcttttggtatttgtggggtttatatttgtttttgtttgtttgcttgctttttaatatctatataaggccttaggcaaatcatgcttactttcatttcattcagaatagccagccagttacgttgttcagcaaacgttgtcagtgttccagcaatatttctttttcttaccatttgagactcccagctgccagcacctgcaagtgtttgcttgagggcctcttgccaccagagcatggtttgtgcctccatgtggcaagctggaagtgccaagaaattaatgaatctgggagcaccactcacccagagaccagcgagaacttgtgtatgatatacccagttcccttgcaccggggtgggataactctagggcctgggttttacctgggttcctaatattacccagcagaatcaagctccagttccccacaatggaaatttgcctagtaatgaaaactccattgactacctttccttccctaccaatggttattgagatcagctcacagataaactgttcacactcaaatccttggctcagatctgcttctgggagaaccccacataaaacaaaacactctggcagagtgtccctttttgtgtgtgaatttaggtcctttcttaggattgtctttctccccccatgcaccctcccatgttgcgcaaactggtgttgaattcctgagctcaagcaatcctcctgtgtatctgtgactacaggtggtgcactaccacctgtacccagctttccagattatctttcttttcaggaggttcagcctgccatgaatactaacatcatctgattaactgttttatgatccaagctagattctcacctaaacaactttaaacaacccgataagctttattttcagattttttttggtaggatttctatactttcccatcaagtaagtgcatgatggtatctaaagaactcttattgccttgcttatcagtgcaaacaggtacaatttgttgagcagcatttttctgacaagaatttgtatttgattacatattttatattttaaagcagtttagttttcaaaagctcatgcttccaagtaaaatatgcatttttaaaaacctcaaaattcacttctttattaccccagcactcaatctctgtaatcactggcctataaccaccgaacatctttccataatagcatttgcaacagaaatgtaaagaagattgaaccaatttcaaaaagattacaccaagaggatttttcttctgaaagatttttgccctattctttaagacatgctgtttcctcaggttatactcaactaactttcccataaagataatttgaagtatattctcttttttcccaacttcccacctcatggtggcagcatccagattagaattacttttttaaatgaatgtgtctcacaattaggccaacttagcacactcagaaagtaagatgaaatttcagaaagataccactactacaatagttgaggaatcagttaacactggaaataaacttattgcccatgtgtatggataaattgtcctagaaatatgtattttttacttctcaggatagcatatgactaagttaacataattcaatttttaaaaaatatttttaacatgctaccaagtatatattagacatcattaaccagaaatgcataaataatgtttaacagtgtaataaataacatatataatttaaacatgtatatataaatataaagcaatatatatgtgtgtgtgtgcatgtatgtatatatgtgtgaatatatgtgtgtgtgtgtgtatccagcactgctcaccattaaagtatgaacactttattatttcacaactattttgattggctcaatatactatgttgaacagggggaagtttgctttgatgtgtcagtaagaaacctcctctcaatatgtaagtggcaaatctataccaaatggataacatcagtctagaaagtggatgtaaaaatattcagagcaaattagctgtccctataccagataaaactactcatacaaccattctaaatgattttccttggtggatcactaagaaaaaaagttttataagaaaggaccctatccttataccataggtctatgtaatcatctttctaagagatgcctaattgcttgaggtcctccttttctgaaactactcaccatctaattttgttactccccagagtctcaccagaaggagaataccaacagtttctattgaaggatttattcctgtcacaagccattttcctttcttcccatactgactagagctggctatttggtgaattccaaatgagcttccacctaagtagctgtctctcataatgagtttctgtcaaagagaaatcaacatacagagagaacagacacacacatattgactttaatgcagtgacaaaacaaagcatttgagtcacttatttaagaaccagacctctgcaaatggaactggcatgtctaatcccattattgccagctttcccacacagaggcagcattactgacctatctataactgtccaataagtccagggcctttggtttctgtccttgtcaacctctaaatatttcaagctgacatcaaaacagaataggcaggagatagaaagaaaccagcatcaacatgtatttgcttgtaaatatcaatttgtttttggctgtaatcatccttaagtggacttctgtgacatgatctgggcttttaaaaaatagcagaaacctggactataatatatttgtaaacattttatcctttgattagttttgttttgctttcactttgctatgtaactgtgctgttagtcttaagatgaactggggtgagttcagggctgactcaaggaggcccatttcatttgagtcaccctgggatgaacgagaaaagttgctggcctcaagtctcttactatcccttgggaaccaaacacatacagaactatgattcatgtccatctgtgagaagttgtagacagaagtataaagtgctgtaagagcctgaggcacagaagagggaattgtctgcagacaaggaaactaccatgagtcactttctctgaggttttcttttttactcaagttctgtaagtctacatctctctcagtgtgagcaacccaactgagctgttagagctatgtgtccatgactttaaacctgcctcccttggtaggaaacaaaaatcctatgtgtagatttagtatataggtcttctgatgccaccatccagagcttatctttcctcctgctggcttgagtgtaggtctctgaagttagggaagtcaactgcagtttttcctagataacagtggaattgaatgccacctgtgggcatctgggttctgaaatccgattgatgttactcagtggaaggaatttcacaaatatactacctgaatcccacagcgggccactatggcaagcaaggaaattgtagccactatgtaaagaacctcaggctgtggcctgtgcaattctagcaagcatcctttacatggagcagaatgtaagtgagatttctgcattgcacagtaccagcctgcacatccattggatatttgcttctggacgtattttctcagcctccaccttttacatcagaaagagatacctcgtttgcacaagaaaattttattgtatttgattaaaaaatattttgtgtgatactatatgtttaaattatggtttacattttacaaagtattttagtcattataattatcttaggaattaaatagaaagtaattagcccattgtccatatgtagaactgagctaaaaaaaaaaaagattaaataatgtgagttagttgaaacttacattatgtaattgagttagagctcaattattatgaagcttgatgacattttgtcagcaaggtctggggtggaaatcagcccttgtgtctgggactaagtctactggctctgctctgtcttacctcctgagtacacttcattgaataatggtctgctccactggaattgccaggtccccatttttccatttaagagttactatctttctggtttcctgtggggaataaagctttgtaaataagaattatggaataatctgagaatcttagagaaggagaagctggtaactaatataaaagtcctgtattggttttggctgtgttaatcttttaaaaacgtcctcctctaaaaaattgtatccactcatatcctggatttaaaatgcaaaagatattccccagtaaaacctcacactgatttcccacaaatggagaggaggatggtaaattccaaggacaagaacactaatgtatgaggcaagagacacagttttgcttttggctctattgcaatcaacctatcggttcatcaattcaagaattaagtattgagtatctttagatgccagaaattgtgctgggtgccttcagtaaatttttaggttagaaggaaggcagacattaaacaaataactacccaagtaattataattatagaaagtgctctaaagaaaaaataaaaggcttgtataagagtaaatgacaagtaggagttacttagagaaaaggggggcagatagtatgtgggatgggtgggggaggggcctctggaagcatagttcaggtaaagagggcagcatatgtgaagatcctgtgccccaggttatatttgagaattgaaaagatcagagtgactagagtagtgcgcatgaaggggagagggctgaaagttaagattagagacatcaacgggaagatcatacatggcctcaaatagtgtttcacttatctactgaggtataacaagctaacccaaaccttagactgttaaaacaacaatttgttatttctcatgattatatattaaataattgtgcattggctgtgctcagctgagtggttcttgtgctccacatgtcagctgggtcactaagctgcattcagctgtgagctcagctggggttctacttatgtctgtggtttcatctgggtggctgaaatagcaggaaactggcttcttccacatgatctttcataattcagtagtctagctgagcttcttgaaatttgaatggattcaaaaatgattggagctgatggtaccaggcctcttatcacctagccttagaactggcatagccattctatttattagttaaggcaaaccacaaggccagcccaggtttaagggggaaatagacaccatctatttttaggagttgtgctaagcctttagacagcggaaggaaaagatttgttttgaggcagtataccatatagataattttaaacattttggacttgagatttttattatttgttataaatatagcatatttgaaatgccttatttattgtagtcttcacaacaatataatgaaataagcaacatcatgatactcttcttaagttagatgcatcacagaactcttaagtggcaagaccaggcaccaactgagccctaactcaaagcagtctgtttttgaccaccatgctgctgcatgaccattttgctgattctcagtcatagttctttcatcttttcaatgatgaaatccatgaggatgactaaaatgtgtgaggactgtaataggcaaagctatcatatgtaagtttaaagcataaaaaaagtccacctttggaaaatctcattgttaatccactccttgatacagttcagaaaatgaattaattaataacttaggaacaaaaggagctcattagccctaactccctaaacccatctgctattattgttagaagctgagattcccaaagtccccccagacaaatggagaaacattatcagtgacattaggggctctttctccaaccaggtacccttgccagttgctcatttatttctagaaatctcagacatgtctcatgtgacttcataaataaatcttcttgctaccacctggtgttcacaactttccttctctcctacgctagaattttttagtgagatttccttccagatcatctactgcttctaaagcctcattgtatgttaggtgctgaaatgggaagattgcttctttatcctttgtgtttaactctattagagttactgcctccttacaaacatcctgatagtttgtaagacttaaaatggaaatatgcaagtcacatagaggagggaatttgtattcttcgcccctctatccctaggatgaatctgaatggcagttaccaggcagtcttcagagctttttcttttcccctgttgactgaggcttggatattgatttgaacttttctgattccatctctacttaagatgaattttctctcagaagagtcatcaatccttcatgccaatagacttctggtagctacactaccagtctgccagacatggtcagatatgtatgagtactgggatctacaatttaatttaagcttgagccgttgttctcagtgtactatcatgttatgtgatgtttactttcatgtgtcaacttgattgggctaagggatgcccagaaaactggtaatacattatgtctgggtgcatctgtgagggtgtttccagaagagattagcatttgaactggtagtaagtaaagaagtccatcttcaccaatgtgggcagacatcatccaacctgttgaggacctgaatagaacaaaaaggtggaaaaagggcaaactgtctcttcctgagggacattcatcttctgtcttcaaacatcagcactcctggttctcttgcttgaggatttgaactacaacttataccattagctcccctggatctcaagtacttggactctagctgaattacaccaccatctttctggcttctgcaacttgcagatggcagattgtggggctctcagtctccataattgtatgagctgcatagtataataaatctctctctctgtctttgtctctcagtctgtatagacaaatatagatagatgatatagatatagatcctattagttctgtttatcttgagaaccctagctaatacataacaataatattttctgtaaattaagcaagttttgtatttcaatctcatgtgacttcattgcagtattgaggtaatcatgatttacccataggttaagaaagacatttttgcttatggtaagaaataaattgctggggctgtgtctatgctattaagcaaccaatagttgttaaccaaacaactgtttaatggattaacatatttactgatctctgagttgttttggagttttaaaggatgcaagtgttttctctgaaagaaaattggcagcatgtttctgctggcagggctgtgtgtcaaaatggaattggttgagataataaatgtactttaaaaataatctgttgtgtttatgtaagtttttgtgtgtggctgcctccacctttatcgtcttcctattattatcccatgtgtccttccaggaggtagaatgctttaagactgtcagtagaaataagagacaaaaaattgtgttcttcaattattaggaaacttttcagatgaaaatccattttaaaacagaaagtggttttctatgaaaatgaatttcctgaaactcaagttagtcttttatttttcaaaaaaaaaaaaaaaaaaaagaagcttttgccacttccaaataccactcaagtaaataataagaatgagatacagaaagcaggctgatggaagtgatacttttgtttgaatgagtcacagattaattataagaaaagttggccgggcgcggtggctcacgcctgtaatcccagcactttgggaggccgagacgggcagatcacgaggtcaggagatcgagaccatcctggctaacacggtgaaaccccgtctctactaaaaatacaaaaattagccaggcgtggtggcgcgcgcctgtagtcccagctacacgggaggctgaggcaggagaatggcgtgaacccgggaggcggagcttgcagtgagtcgagatcgcgccactgcactccagcctgggcgacagagtgaaactccgtctcaaaaaaaaaaaaaaaaaaaaaaaaaagaaaagtttagctttagagcagacaagtaaatatactgccacagaggttgttttgtgtcctaaattaccccaaaatgtaatggcttaaaacatgatttattgtttctcatgattccctaggttgactggactcagtgtgccaatgttctactccatacattgtagctgaggccatgcgtacactgaaatgtccaaggtggactcacatcattcagggtctgtctccacattgcctgtcatcatacagtagtttaggatgagattcttttcagcttggtggttggcttttaaggatgaaaaatgtaagctacaggcctttttatgtcttataccttattttgaccttattttttgggtctaagcaagtcaccagcctaggtcacattcaaagggaggggagttagcctccacctcttcgtaggagaagtggcaaagtgtttggaagcatctttaactcaccatggagatatcagtttactcatccattgaggttttgagagtctactgtattcctgacactattctcagtgctataaggaatagacccttgaaagaatccttcactttctttcagcttcattactgacataccgtgcaatcttagccaagtttcttttcatttttataacttactcttctcatctttaaaatggagataataattgttgctttacatgtaattaagtcatttaattttcacagttgtgatgttaacctaggtaaaacacttagaatgtgttaatgcatgtacagagatagagcagtaccaggcacataaccactcacaagttagttgttattgttgttattgcttgctaatgagaaaagtggagccaaggggattgtgacttgcccactgatctatttaatggcagattctgttttagcaatataagataaaattaccttataatgtattttctcatgtaattggccaaaggtttctgcaaaatgcaattgacttgctttttaataaattatctgggaacattttgcaagcctgttacatagactgacagaatgtacttcccattctctgttctagctccaatccaattactctcatggctctttaccgttagacacctcctcaccttctctagtcttcttttacttctcccatatcaaatcctatattccagccatatcagatcacttgcagttcccacctttaatacgctgtttcacacctccgtgtctttattatactctgttcccagttctggaatgctgatatcctattactttatgccccagctattatctgctcttttttcttccttgccttagatgtttcctattcctttcctgacttctccttccaatttgaatctgcttgggcctttcccccgctactcccaaagcacatgattacctctttcatgagacgttattatattataaattatctattacttatgcattcccataatctttctaagctggaaggtatgaaatacatcttttttcttctgagttctcaaaaccgcatggtgccataaaagctgtgtcatcacaagtatagttacctaagtaaggtttcttttcttttcttttaaaaaatatgtttttagaaatggagtcttactctgtcacccaggctggactgcaatgacacaatcatagctcactgcaaccttgaactcctgggttcaaatgatcctccagcttcagcttccagaatagctgggattaaaggcatggccaccatgcctggctcccgagtaaggatacttaatatgtattttacagccacaatttcttacaaaaggaaccagaaccaaaaatttattttcaatatcatatttatatgtattatatattttctagaatttctattacaagctgtagttttgggtttttttttaaacatcatcattggcacttaatgtaagccatttaaagatatggcaaaaggactattagaatttatgcatgcacattttattttccctagaattagaacaacccagatatttagggccagcaaattcccagtacttttcatgtaatatagcttggagtttcttttcgacctgctaatgttggataaacatttcagtcattgaagatacaagctaaagtttaaatcacgggcaacttggaggatatttgtctgcttctatttgggtgactagatgactcatataagtggaatcatgaagtatttatccttctgcatctggctcgttttgcagatgataatgtctcataggtttaaccatgctgtaacaaatggcagcatttatttcttttttagggctgaaataatgttctattgtatgaagacatttgtccttgggtatccaagggtaattggttctaggaccctccactgaaccaaaatccacatccactcaagtcactcagttggtcctgcagtgctcacctatacaaaaagttagccatccttatctgcaagctcacatctctcagtactgtattttccatctgtattttgttgaatctgcagatgagagacttgcagatacacagagccaaatgtatgccaattattatgattggtattttttgagacagagtctcactcagtcacccaggtcggagtgcagtggtgcatctccactcactgcaacctctgcctcctgggctcacgtgattctcatgcctcatcctcctgagtagctggcgctacaggcatgcacaccatgcccagttaatttttgtgtttttcgtagagacagggtttcgccatattgaccaggctggcctcgaacgcctggcctcaagtgatctccctgtctcagcctcccaaagtgctgaaattacaggtgtgagccacagcacctggcccacgtttttctttttttaaattatttcatctataagtgacatttagattgtttccatatcttggctgtagtcaataaggctgcagtgaacaggaaggtgcagatatcttttcaagatctgaactttgattcttttgaatatatttccagaagtgggactgctgtatcatacagtagttctattttaaattttttgaggaaactcaatactgtttcccacagtggctacaccaccctatattcccatcaacagtgtataagagttctaattcctccacaagctcgccaacacttaccttttgtttctgtttacttgtttcttttttgataacagacattttagcaggtaagaagtgaaattttgttgtggtttggatttaatttttccaataagttatgttggcactttttcgtatacctaccggcattttgtatgtcttctttggagaaatatttatatatgtattcaagtcttttgcccaatttttaattagtttgtttctttgtttttgttttgctattgagttgtaggagactctcctttatattggacattaatctcttatgagataggtggtagccagaggttgtggggagaaggaaatagggaattgtttttcaatggtataaaatttctgttatgcacgttaaataaattctagaggttttctgtacaacatagtacctacagttaataatacagtattgtgtttattaaaatataagaggatatatctcatgttaaattttcttactgcaaagcaaacaaaaaacacacaaaagaacacaaataaattattggaggtgactatatacttagtaccttggttgtggtgatggtattatgggtataggcttatggcccaactcattaaaagatatacgttgaatgtgtgcattttttgtgcatcgattatatctcaataaagctaaaaaaataaaaattgaaaactgaagtcaggggaatgttggccaataatgacatgctttttgccaaagcactgcttagttgggttatgaaaaatcaaagagcatattggcatctcttaagaacaaggttattttagtctaagtaaaatacaaattctactttgaaaaagtacaaggacttctttcccatcatactgtactgtgacacatcaactaaaagcattacttcaacttctgtctgtgctttcataacccttttgtcatcttcttggctttatgtctcaaaccaatgggacttttataggctgatcatagacacagcttcactttttgaaagggccactagctttctccatggtggcctctccctagagcaaaggagacaaacaatgcagggtctgatgttgctaattaagcaatctaagattttggcaaatgaactccaggcactggttgattgagaattcccactgcagctctagctgtgggtttgtgtccaggttttgccacttagatacagaacagtgaagttactcatgagaggtcttaaagtttctgtctcttcatttgcataaggtagataataagagactctaaagaaataatctaaagaattattgaacaataaaatgaactagttcatatacaattatatgattatctctatgtcactgacaagaaaatagactcagagaggtaaattaacttatttaatgtcacatagttacaaagtaacgtgactgggacttaaataaataaaatttactttctttatatgctaatgctgcttattacttcccatcctgacagagagagatttgcagagccctccacttaacacacattcttttttttttttttaatactttaagttctagggtacatgtgcacaatgtgcaggtttgttacatatgtatacatgcaccatgttgctgtgctgcacccattaactcgtcatttacattaggtatatctcctaattctatccctcccccctccccccaccccacaacaggccccggtgtgtgatgttccccttcctgtgtccaaatgttctcattgttcaattcccacctatgagtgagaacacgcagtgtttggttttttgtccttgagatagtttgctgagaatgatgatttccggcttcatccatgtccctacaaaggacatgaacttatacttttttatggctgcgtagtattccatggtgtatatgtgccacattttcttaatccagtctatcattgatggacatttgagttggttccaagtctttgctattgtatagtgccacaatagacatacatgtgcatgtgtctttatagcagcatgatttataatcctttggttatatacctagtaattggatggctgggtcaaatgttatttctagttctagatccttgaggaatcgccacactctcttccacaatggttgaactagtttacagtcccaccaacagtgtaaaagtattcctatttctccacatcctctccagcacctgttgtttcctgactttttaatgatcgccattctaactggtatgagatggtatctcattgtggttttgatttgcatttctctgatggccaatgatgatgagcattttttcatgtgtctgttggctgcataaatgtcttcttttcagaagtgtctgttcatattcttggcccactttttgatggggttatttgtttttttcttgtaagtttgtttgagttctttgtagattctggatattagccctttgtcagatgagtagattgcaaaaattttctcccattctttaggttgcctgttcactctgatggtagtttcttttgctgtgcagaagctctttagtttaattagatcccatttgtcaattttggcttttgttgtcattgcttttggtgtattagacatgaagtccttgcccatgcctatgtcctgaatggtaatgcctaggttttcttctagggtttttatggttttaggtctaacgtttaagtctttaatccatcttgaattaatttttgtataaggttaacacacattcttaccttcacattaatctgtcctaattcctcctatttctacctaaataattcctttggattatgacatttgactccagaaatcaaactgtgaatctgaaaactcctacactaatccatcaaaacttacaggtatcttaggataaattgtatggttatatggtctgtcacttgactgcaaaaatctcttacaagatattcattcagttagccatgtactaaattgaggaagtatgcatcagtttagatctaagctatgttattaaaattgcctgaaaattagtacatatgatagttaaagagatataaataattgtgtgaattgtattaaatcattttttgtagaaggtaaacaattagaagtttcacatttgaaagattaaaaatgatattagagaagaaatattcatattaagaattatggccaggcgcagtggctcacgcctgtaatcctgtcactttgggaggtcaaggcgggtggatcacatgaggccaggagtttgaaaccagcctggccaacatggggaaaccccttctctactaaaaatacaaaaattagttgagtgtgatggtgcacaccagtaatcccagctcctcaagaggctgaggcaagagaatcacttgaacctgggaggtgtaggttgcagtgagccaaggttgtgccactgcactccagcctgggcaatacagcaagactctgtctaaacacatacatacatatatattagggctaggtggggtgtctcattcctgtaatcccagcattttgggagaccgaagagggaggaccccttgaacttaggagtttgacatcagcctgggcaacatactgaaacccatctctacaaaaaaaaaataacaaataagccaggtgtggtggcatgtacttgtagtcccagctacttgggaggctgaagcaggaagatcacgtgagctcaggagtttgaggctacagtgaactatgatcataccattgcacccaagccagggtgacagggtgagaccttgtctctacaaataaataaataatacataaaatattctctacagagtgaccttggaattctgtactatctttggatcacacacttcaatacatgagtttttatttattaagagttaatatttttgaacctatatttccaaattgacatagggaaaaaactattttaacatcgaataagaactttgactatatgacctgagttaaatattccatctctcccattttattaaagcatttacttcaaggtcatatattcttgcatttattctaaaaggtgaaaaattatgtcattcaacaaactttgagtatctatcatttactaggcattaagctgaaggaattggacaccgtacctgaccttaaggtaataggagcctaggactgcggttggaaaactttcccgtaaaagaccaaatagtaaatattataggtttgcaggtcatatggtctttgtcgcaacgcaactactcacctctgccactgtaccctaaaagcagacatagataatacaccagcaagcatgactatatttcaataaaatttgatttacaaaaataggtagtggatcagtggaccatagtttggtgatctagggatgaagcaagacagttaatcacaatacaagaactttgcctttgtaaatgcgtctgtgaagaatctggagtgagcaggaaaaagggaaggaaggaaattagagaaattatcaagcaagttttctcagagaagataatggctgaattttatcttaaaaatatggagcaattcacaaggaggccatgctaacttctatttcatgttaagaatagaggctattgtaaatcttgtcacctcagcctaaaccaaagtttccaaactatgtagtatggaattcctcaatacgttaatagatattcccgaataaaggagttacctggttgagtaagtttgaaaaatactcttttccttcttcaattagctttctcagtgtttttaaatttcttttagcaaataaagactttaataagtcatgtagtaaagaggatttttcaaatttttataactcagaattttaaaatttatttatggagcccttctcttgatgtggaatacccattaatgtatttcagaaatagtattttgaatattgtggttttcaagacagtcataaactaaggattaagagtcctagacccatttatctgcccatatgtaggcagcaaggtttcagaagcactttaaacagatggcttcccatcataggagtgtcctgggcaacaggtgtccagcctttgggagatgagaggttgagcaagactcagtcaccaggggttttgaagtttcatgcagaacaaatagcaaactcacttgctgaactggaaaaattatgaaattataaagtgagacagtattgctcccaaagggcgtttgcttgtcacaaggatcaggaatgctattggtatttcatgggtagaaatgagagatgataaacgttctgcagtacataggccagccctgcacattgaagatgtgtgctgtcccaaatgccaatagagccccatggagaaacactgttgaagaacaaggagtgggggatcacctcccaagtttcagaagactgggaagaaaattggggataaaccttataggcacatcaccattagtgcagccattaaatatttaaaaggtcatacattcctttttcattcttaacaaccagatgtaatttatttaattccataaaaatgtatatgattttatttttgatgcaggcatatgcaattgtaaaacttacagagcaaagatcaggtgcagtgtgatcttttgaataagccattgcattagatgctattaagcatttcagaggcaatttaataaagtgtgtgattagtgcctcacttcctgatggtcattctgacaggagcaccagagtaacctgagtgctgatttcaaacctagcccttcagtgagttttttagaaggctgctgtaacagccttttataagaaaactctgtcaataaatgtttctcttctgaattcgtctcaagtaaatagcctcaaggaaatattcctgtggttcctgaaaaatagcaagcagaagatactttacacagaccagggtaatcataaatttggcaccttttttgaaatataagatgtgctccctcctctgggctgatgaagctgctgtcagggcacaatgggtggcatacagagagtgaatgggctgaatttcagccctcactcaggccccctgcaggtgcctttgtacatttgcaaactgtgtaatcctgtctagtgaccctgggtcagaaccactgttgcttcattgcatttggctttattgcatatagtccttcaatctgaatgttttaagtacccactacatggcatgctctatattaagtatagcattacagaagctaaatgacgtgttcctttaattgagtgcttaccctacagcagccccttggccaaatatttcatatttattaataataacaacaacaccatgagctaagttttattgttttaattttccaactaaggaagcttctcggctttaagtatcttgcctgtagttacacagctaggaagggaaggtgctgggattcaaagccttttttttcccctgattctaagtgtcctgttactatttactacaaaagcaggactttcaatgaatttatatattagagaggagacaaatataccaacagatggttacaatacaagtgtaagtgctattcaggtgggatgcctacttagatgtagagagaaagttgtcaggggccaatttccagaagcagttgtccttgagttttgaagaagtttctacaaacatatgggaatccaaaggttaataaaccagaatgcaggctgaaaaacttggctacacttcagaaaataagttggaataggtttgtgtgttttagtgattattttaagttatcatataccaaatgaaaataattgactggtaaggctatcaatcttcctgcacgttaaaattatctgagtagaagaacaacataaatgaactttgaagacattatactggatgaaataagcagacacaaacggacaaatattgtgattctacttctaagggatacctgccatagtcaaattcatagagagagaaagtagactagtggttgacaggggctagttattctttaacaggtacacaatttcagctggtaatgttgaaaaagttctggagacagacagtggtgatggttgcataacaatatgaatattgttaatgccatttagctgtatacttaaaaatggttaagatagcaaattttatgttaagtatattctacaacaattaacaaaatagagtgatttcttggaacctaccctatgacctcttgaatcagggtatccaatgactttacggttcggaaacaactggcccaggacattttgaccaaagatctgttataagaatctgctgaactgaattacattaaaatgaaatctgaaagttcatagttagatatagtgtagttttagaagacggttttaaagacaacagttttaggatttgtgttgttttcataactgatatttgtatagtgatttaattttaaatgtattctcttctattattttatggcagctatctggtattgcttggcctgacttcttatttgtatgttagagatgagaacactgagtttcagtgagttagtgttgcctatctgttacacatgctgctatagttacgatgataaggaagatgcctaactgatgagaatagaactcttgtctaaatgagaattatagggataatagagaaagttcacagatttcttttttgaatcatttaaaaattgttatatttgctgccacattaaattaatcatctggactgagacttattgaatgaatggagaggtgtcgaagaattgagtttccatgagaaaaggcataaagcttaaggcttacatagagaagggcagcgtttggctgtttttcttagcaagagcaggacagaactggatgagtagtgaagatgacaaaaggctcctctttagagccctgtccttgaacttttcagtttcttctgggtgtgtccctttcctcagggggaatcaagagaatgtgtgttgcccaatcccttctggagtaagaatcaggaccttgggatttcttgcccacatgttcctgagctcacttccagtatctgcatgggcctgtttcccaggctttttcttcctgccctgtcattttgcccaacccatgtctgagcattggccaaaaggccacggtttctgtgtgtttggagtggactgattttggtagacaaagcttggctgcaccgggaaccagagtcctgaaaatgctagggatccatctgtagggcagtttattcaaatataaattgttaaaatatcttccctatattgttctctttttcctttcccaagcaggtggttaggctctttccgtctattggtctcagggtttttggtcaatactagaagcgtctagaagataaggtgcttcttatgtatttttaaagcctagattcattggaatctaagagtgtctggagtcaaatggagaaagacaaggaccttggagaaatttccccaagagtgggtttctctgcgtgcaattgcctagagaggttgacctgaagcaccagagctcccagcctgacagaggttccctttctcctctgtgcacacaaaagcagagagccattggactccaagggccccttgtgacattgatagcagggaagttaacaattttgctccccaccttttggacatgacacgcttcctagattcaggtaggaccttgaggaagagttaaacaatgaatgtgatttaatatcttcctgaaaaagaaaggctggtactccaaatcaaacacatatgatttgattttaaaaatgaagaaaaggatatttccagcactctttgagtctagactgaggttcatatctgatgtactagaaatttgttttgattactgaaggtcttaaataataacagcattcagaacattttgcatatactgtatcataattgtggtagctgctgaactttattaagcatttattatgtgccaggtaccttcttaatatgtcatacctactatttttcttgtgtttgccacaactctatgcagaaggtgatatcatcttatttttgaggtaaagaatctgaggcctggcatggtggctcatgcctgtaatctcaatactttgggaggttgaggcagaaggatcacttgaggccaagtgttcgagacaagcctgggttcatagtgagaccctgtctctacaaaaaaataaaataaaaattagccaagtgtggtgcaatgtgcctgtattcctagctacccaggaggctaagcttaggtgacagagcgagaccctgtctcttaaaaaaaaaaaaaaaaaaaaaaaaagaaaagattctgagatgcagagaggttacataactggccaaaacatagttaataattagtagcagagcctaaacttaacccgatttcttttgattctaaaactcatatgctaacccagtatacaattctccagtataaggagtttaaacttttatcacatatgtaataaaaatacagtatattttgtatctcaggagtggtttgctttatttaaagtatttttatgtgaaaataaatttgaattctcctaatctggcaagataatagacagctattaataggttgtggccattgcgtgataagggctaaacattgctaaaagaaaataaatctggcagtgatgtgtaaagtagattgaagtcagatgtgggacaagaaactaagagaagaaagaccagttataagacaattgcataatagactgaaccaggataaatgccaaatcatccagttaagggagaaaagtatacttgatgcagaaaatgtctaataagcttgctaaggggaataattaggtagctataaggttgaggacctttaatccttcatcaatatggattgatttttttagtaagtccgagatttctgcttttattcttttattctgtaaggaagtcactggcacagaaataaacaatacttgtcaatgttggtggcactaatttgatgcagagatgatttcttatatgagaatcagaaggctactcttctccatatgcttcccagagataattaatataactctgtatgcttcttcctaggtagaggacattgttgaactatttgcagatttctgtttgttcagatgttttggcttatagatatggggctaaatctgatattctttggttatattttaaaactataatcttttgaaaatatcaaaccctttattactaacttagaaaataactcgcttattgaatatttaaaaattaaattgtttttattggttcctttcaaccacaaggagccatccttgtctcttctcttctctttcattccacattcagtctactaggaaatcatgttgcttctgctttcaaaatataacagagcccagctgctcctcatctcctcctttgcttccatgctgtccagccctccatcctctgtcatgcagtggactctcatctggtctaccagcatccccttttactactttacagtttattctccctaaaactggcagaaggatttttttttttcatgtgtaaataagataaatcacacctagactgaaaatcctgcaatggctctacatttcactcagaataaagctaagctcttacaatgatctataagcccctttgtgacctgaccccacccttacctcttgatgtctactaatctccctcttttccccagttcactgaagtctagacactctgacctctttgctactcctggaatctaccaggcacttaaaaacccttggctcactctgttcactctgcctggatgctcttccccagaatccagttatctatctccctcacctttctcaggtttctgctcagatcttacctttaaagtgaggacatcctggttaccctgtttaatcttttaacttgcccctctttccattgtaataactgctaccctgttcatctttaaatcatataaaattctgtagccattatctaatgtaactctatgatatagatgtatatttaaaatatgtataatatacattacttattatatttattctttattttctatttccttgatgaataagctgaaatcttttctttggtgcactgatgaatcctaaatgcctaaaacaatttctggctcatgagttactcaataagttttgatgaagaaacaaattaattaattaaacaacaatttttttccaatattaaaaaaaaattttggccaggcacagtggctcatgcctataactccaacagtttgggaggcaaaggagggaggatcacttgaggccaggtgtttgaaaccagcctgggcaacatggtgagaccctgcctcttcaaaaaactggtggcacacatctgtagtcctaactactcaggaggctgaggcaggagaattgctggagcccagaaggttaaagctgtgatctgcagtgagttatgatcataccactacacaacagcattggtgacagagcaaaactctgtctctaaaaaagaaataatatttttttctttaaatgggcccattcagatgcattttatctacttataaccataattgtgcactttatatttttggtattataagaatatatttacaaaacagaaagtttgaaaatataagaaagtagtgagagagaaaaaacataagactaatactaattccacctaacacaatatctgttaaccttttgattttttcctgcaaagctctattcacaattgtaagaagtttctgtaaaatgtaataattccattgtatacataagttttagtatcttctcttaatattatcttgtaggtattccgtgttttacatatttttcatcaatacatcaattttaatcaccatgtcagtgattcttcaacttaggttggttatatctgttagtatttactgcatttggaattaaaaatgaaaatatttgaaaaatatttattcactaattcatttggaaacctcaataataaacatattatattgtaacataaagtctatttttaattaaaataaccatattttcccaaatcaaaaaaaaataaaatagaaaggagtttaagtttacaattatacatctcagcactttggaagaccgagtagggtggatcacttgaagtcaggagttcgagaccagcctgactaacatggtgaaatcctcatctctactaaaaatacaaaaaattggccagctcatgcctgtagtcccagctacttaggagactgaggcaggagaatctcttgaacttgggaggcagaggttgcagtgagcccagatcccaccattgcactccagcttgggcgacagcgtgagagtctgtcaaaaaaaagaaaaatgtatatatatatatatatatatatacaaatttctcaatatctaactatctaacttgataaaagactggattctcatattgatatggtttggatgtgtggccccctcccaatctcatattgaaatgcaatccccagtgttggaggtggaactgagtgggttgtgttggatcatgcggttgcatacctcatgagtgggttagtgccatgcccttggtgatgagtgagttctcactctattaattctcatgaaagctggttgtttaaaagagcctggcacctctcttactctctctctcaccatgctatgcgcctgatcctttattgtcttccaccatattttaagtttcctgaggccttcactgaaagccaagtagatgctggtgccatgcttttacagcctgcagaatcattagcccatagaaacttcttttctttgtaaattacccagccttaggtattctattatagcaatgcaaaacagactaacatacatatcttcttctgcattcaatctgttgaatttatgtggttgaggttgaaatatatgaagaaaatacaacctcacagatatatgtagcagcaaaagggaggtttacgataatagcctttcaagataatgtggacattcttttttgtgatttcatccttcattaacatccaacaagtggcagttccttaaaggttagttgcaatatggactctgaaactatagcaataaacttttcatactctattataacatcaaaatccattgatccaccttataatttgaatgaatcatttaccaatgtgtgatttttataacattatgctttggtcatttggaaatcattggctcactgagttatgcaaaatttccaacataaaaaaatcatatttcttaatgtcatatttcttaactactgatcttagcagaaaaagtcttcaagtattagaaagcttttatgcttacagtggcagataaaagttttctgaagttttaatttttggttgaaagtttgaattttatcataggcaaaaaccactgtctgttattgccctttaagtgatggacttaactttgttcattttgaaaaataggctgccaaaacccatattttttttaaatcattttctagtaaaaaatggtgttccatgaaaaaagtggctaactcggcttgtaactccaacaaccattcaaatgattttgcttgagacaactttcatacttcaatattttgtcacacacacaatatcaaaaacatgtatacaaaatttaatttaaagaattaaatttaataaaattaataacttttactatttcaggaagaatttcatactttaaagtaaaactggcatgttatttatctttttctatggtgagtgtgtggtgaataagaaaataacaactagtatagtttggtgttactgctttgatttgtactgagagccaccatcacttttgcagcatcaatgcaaatgtcaacatagtcattccaggataagccttaagagtcaaaaagttattcaagtccatcttttaaaaagttattcaacactgaatagcacagttaccacttgtgttcattgccacatattcatgtaaatgataatttctttaatgattagtttgttctggtactagaagaatgattagtttgttctggttctagaagcaaatccagccatgtctgtagcttcattcatttgtaaagcaaaagtacaattgtgcagacaggatcttaactcagtctttgttttgaagctaagcctttaattccagcaaggtaccataccgtttgaaagatgcagtgcaataatttcttttactgactttgcatctggcacgcattcaacaaagccaactttacagggtttcatttgtctcttaattattgtgtgatcttctctagtgaatgcaatatggtaactgacccgtaagatgcttgactgattttcagttttaagttgaaaagctatacagaacacttttcctttagaaaatgcatcatgtctacattttaaaaattcaatttctttttctttaaagtctgaatgatttgtctcaaaatggtgtcacaacttagctggcatgataatctttccaaaaatgttgttttataacataataatggaaattattatctataccatgagagaaagatagctttcatcctatttgtatttcttatttacagtgtttccaagtttctttggattctctatctatcttacatgagtcaggaactctctgatgtgacatttaaaaaatatcattgataaataataattacacatacttatggagtacatgtgatattttgatgcatttttatattttccaagtgtctttggacttaaagattgactgctgtgacttgagaatatgagtcttctaatcaccttttcaaagcgataatctattcttaaattaagaaaatataatataaacttttattttttatttttgtttttattttttgagatggagttttgctctcgttgcccaggctggagagtacagtggtgtgatctcagctcaccgcaacttctgcctcccgggttcaagcaattctcctgcctcagcttcccaaacacctgggattacaggcatgtgccaccatacccagctaattttgtatttttagtagaaacggagtttctccatgttggtcaggctggtcttgaactcccgacctcaggtgatctgcctgcctaggcctcccaaagtgctgggattacaggtgtgagccaccacacctggccttaaactttattttattaacttcttaataagtactatacacttctaaaattataagtaagataaaattttaaatgttataaatgttttaaaaatatgtaaaactgttattgaaaaataaggtatccaaatgtatttacttgttgtttttctactcaggcacacagaaaacttaaggatttcaaaagaatgacctagtggatgatgataataaggttacagagattatagcaggtgtaatgactagtaagagcacagtagaagtgctaatagcatactaatttctgtaaacagcacacctatcataaacctactaccttaaaaattatagaagacccaagaacaaacaagcatgcatcccattagtcattaaagtgataatatcattctatgtcaggtgatctctagagaattctactgtgtacatgtgaaataataagtgaaaaaggcaaactccaatttatggaaatagttttgacctttgaagacccatacaaaagggtcacaggaaatccctgggttcccagaccacattttgagaactcctgctgcatgtaattatgttattctatatgtgctcccaatttttgtttttattgacacatgctttaataaaattttttgtacctaggttttccccctcttagctattgttttcatgtaataggttaacataaataaaattactaagatgaattaagaaaatgggacatctactaatacagctgtcctcttcaaaatgtcagtgtcatatgggcaaatgtgggagggttgtcgtaaaatgagagactatagagaggaataacagccaaaagcagtgttcagattttgactggacttggtttgaaaacaaaacaaaacaaaaaacaattgataaagacacttttggacaataggtaatatttgaatgtggaataaatactagatgatagtgtagatttatagttaattttgttaggtatgatcatggtattaaggctatatacttaggagaatgtttttatttttaggatgtgtatgctgaagtattgaaattgtttcatattggcaacttactctcaaatgtttcattcaaaaataactgtatatccgttaatctatgcacacacacagaagaatacatggattgagagtagataaacaaaaaatgatacatgttaacagttgtgattctgtgtgttggggatagaggcaatctttattattccagactttcaatttatttgacatgctttataataaaatgtttggaaataaatgaagtcactaaatcaaatgttactaatattatttatttatttccatatcactatctaaaagagtaaagtgttgttttgaaaggcattttttagtatattcattgaaaagtatgtagctcagtgagtaagcaatcaactccaccatcatttacaggggatgtttcatcctttcttcaccagtgctgagtggaatgacctcaggcagactttcaaggtctcagttgtcttatctatacaatagatgacaataagaatggctatttgataaggttgttgtaaaaatgaaatttatattatctataaaacccttagctcagtgcctggcaaatagaaactactcaaatctcatcttctattattgtcattacaaattgtaagtcgttgctacattcaattagaaaaaccaatggaaaagcactgcacattagatcatctctattatattacattctagtgcattctgtaacttcgggcctattgcaagtccttagggaaccaaaacaataggtaatgcatctgtaagaattactcataattagcatgtaaattgttacaataaattatttttttttgcataactgaaaatattcttctctaatgtttaaacattttatctggaagtttgtccttgcaattattttgctttcagttttctaaaggatagaaaactttattttgaattattttatatataatttagtggagtctaaaatgatgtattttgatgtattggaggaaactaaactaatatatttcgtgggtagaatttcaaactataaacattctgaattgttttgttcctagtgtgtatgctactagtagaccagtcatttttagaaagcaaattaattacgtgacagaatttatctagtgtttgcagaatataaatcttagaattgtaaagatggctagaaaagtgttttcacagtaatttatgacagtgaaggcacttatttttcctgttaaatggttttctttttgtgaagtccagaagtgcttcagttgttactggtaatattttagagtgtttcttcttaaaaatcatccttaatttgtattagcaataaatgctgctcaatgttttgaggcatttaaaagaggcatttaaaattgtgaaagatgatatatttaaaatgccatcctaaaacctgatgcttttgttttcacttaatgcattatatagtcaagtaaatttcttctcttggataagaactctcatggaaatgaaaatactgtattatggctaggaatagccagagcctaaagtaaaataataggtgtagtataataggaataagctggtctaaagaaggaagccaattataataaaatgagaaaaactcagttctagtttgtattttccaggaatacctaatgggatagaagcactctaattattcatctcagaagaaactgaaatatagctcattaaaagaacaaggcaggactaaatttttcaacctacataactcatggcaacagcttcctctatctccttctgtctttatgtgatatggtccatccagctgctgaaatagactgccttctggaaattaaaccccacatggctcagaccatagcagtaaatctggtgcaacagatggtcctgggtgaattgttacacctctgcataaaaccttgggatttcatcaataagccttaccctaagtaatggaaatcaaagtgacaaattaacaacaaaatgttcatgcttttaccaaaagagagcattattgtttcttttatggtatcattgtaatcaagccaaaattatgctgtaagtcaaacatcaggcatacaaatgtatatgcactcagttatagccttttctccattcagatattaagctatgattaattaagactatagttccacatcccagttagattttccagtgaggtttcaggaattatatgttgataaccttttgtttttttttatttaaagttattataattttgcataaagtaagttttattggtttgtgcatttgacatcatttagtatttttatgtactgtttaatggggagaaataagagaacaggatgaaaagaagggaactaacattgtattttgatgtattggagcaaactaagctaatatatttcatgggtagaacttttcaggtctaatcactgtcctatgaagcattcacaaatccatgctttcataactacattcaaaatatgttgtttgttatttataaatcgctgaaaatacagggggttgaaaaagacagacatagttcttatttttgtggatttttaattctagcagagaagacattcagtaacaaaaatccaattaattatctaattacacttgtagtacgagattaaagagatcgtgataggagaacttgacctagctggagaggggttgaggagagtgggaagctttccaaagttgttaagtgaatgtttgcagatctgaatgcatcatcaatcaacctgtgtcttcaataatggttaggagtcggcctggagaaaggtgtgtgtatggaggaagacctggaaagggaaatagagcttgaaggaacctggtgacagcagactaacagaggagagagtgtttttctcctcattatatgttgaggcacctatcaacaaaaagagtcaaactctgtaaaatatttgaagagattcattctgagccaaatgtgaggaccacgatccatgacacagccccaggaagtcctgagaacatatgcccagggtggttggtttacagcttgattgtatacattttagggggacagaagttacaggcagacatccatcagtacatataaggtatatattggtttggtctggaaaggcgagaaactcaaagtgggagcttctaggtcataggtggattagaaggttttctgattggcaattggttataagagttaagttattatctgaagacccagaatgaataaaaggagtttctggattaagataaggggttgtggagaccaaggttcttattatgcagatgaagcctccaggtagcaggcttcagaactcttatcagacataaaaagatgccagactcttagttaattctctgctagattagggaaaagacctggaaagcaaaggggattctgtatagaatgtagactttccccacaagagacagctctacaggagagaaataattttcaaaatatgtcaaaggaatatattttggggtaaaatacttcaatttctttcagggtatgctatctgtcatgtgattctatactagagtcaggttggaatttggtatcttatttctataaagagtctgttttgtcagtcttaagatttctattttaagacttacaatgagacttaagatttctatttctatttgaatgttaattctagtaagttgtgactgaaatccaaaggcaggagggtataatgaggcatgtccaatcccttccttcccatcatggcctgaactagtttttcaggtttactttggaatgcccttggccaagaggggcatccatcagttgactggggggcttaaaattttatattcggtttacatatccatggtcacacaggtaaatgtaacagtgatttggactcagtctgtccaaactccaagtttttttttcatactccatgccttttccctgttagacatcaaaccatgcttaaatgattgctttgatcttcatctgcaactttgttcttttttttcaggttgtgtggctaatgcatttttttttttttggcagattccttgtcatgaaatagttttgtattttaattagattcatggtcatttttattacttatgaaagtaagttgtggttcatgtgttcagcactattctgttttgtttttcagcgttccaacattccagagccttcctgaagagatcctcagcaagcttgctgatgtccttgaagaggtaattgtttttagcctttgaactttttgagatgggatccagcctgcttggctggcttctttcacagctgtgtgatgaggaatcacaaactgcagagatctttaaaaaatttctaagctctgggatgagctatatatttggcttcgtatagaaagcagcttatcatgtctgacatttatatgcagaaaggtgcaaatcaacctaattatagagggagacaaactttttgttgtgataaataccatgttactttgacttactagaataggaactggcatatttctcttattttaactagtgtaaagtaaaattgtagttatcaccactctgaagcttcagattagcaatttacaactaggattagtagttgggcacatattttattaccatataagtatgtttgatacacataattttctgcctgaaagtggaatgccacttttagttgtttttctctgaacccacaaagctatggttttgagaaagaggagaaacaacacacattaggctatccttttgtagactgggattcataacagcagcagcaggaggaagtttttctgttcaaattgatgagctttatacggaatgtagtctaaagttgttctcctaaaggtattgggcatatgagttttgtttcaggtcgaaaagattaaaaaattgtcttttcctgtttgctgaggaaatagagatacattggtggtgtaggaaatttcaaactttttctctaaaggttaaagtctaagtcttttgaagtgaattgacaatagagagattaacaggagaaaatgtcatacaggaatagtgtatgggggaggtcatggtgacagaattggaggatggagtcagaaaaaggtgtgtctagagtgctataagtgcagccaagtaatggagagccacttaggacattgcaattaatttagcttttacttagagtgagatagaagtcactggatggctctaggcagagcaatgaacttatttgacttagatttttaacaaaattgttgtggctgctgtgttgaaaaaataaataaagaagctgctacaataatccagggaacaatagtggtgactttgttcactgtgggagaaggagattgaaaaatcatcagattgtgactctctctctctctctctctctgtctatctatctatatgtaatttttttttttttgagacagtgtcttgctctgtcgcccaggctggagtgcaatggcgtgatctcggcttactgcaacctccacctccctggttcaagtcattctcctgactcggcctcctgagtagttgggattacaggtgcctgccaccatgcccggctaatttttttgtatttttagtagagacggggtttcactatgttggtcaggctgatctcaaactcctgacctcgtgatctgcctgcctcggcctcccaaagtgctgggattacaggcatgagccaccacacccagccgattgtgactatattttgaaggtaaaactgaaaagctttaccattgcagtaaacttgtaaaatgagagaaagagaggaatcaaggggaaaccctgaggtttctgttgtaaataattagaaggatggagttgttatgaattgacgtgaagaagactggaagaacagtacactgaggtggagagataagaagctcagggagagaggctggagtaaaatcagaagcttaagtgatctttggcaggtagatggtttcttgtagcattgtttaagtagagggagctattggctatctgaatatcattctgtgggaccaaatgcggatgaatacaaggcagaaccctgaaggagggagcagccaacaattattataaaaccatgaatcgatcttaaaaacatcatgccgagagaaaagcttaaaaccaaaaaaaaaagagatagttattgaaagatcatttacatatacgaagacatatgagcacaaaaatacattttgctgggagtcctgacaaaatattgaaaattggatatacgtgaacagtggtctgtatcagaaaagggaagggagatctatagggataaaagggaatgaatgaatgaatgaatgaagaggaaggcataaggccttgactgattcttcacatttctactttaagagactgaggaatgaagagggaccaggaaagcctgtggaagtaggaggaaaatcaggagctttttgcttgttaaaatccaagagaagagaataacttagagaagagtcagcaaagcttggattttaatttaggtgaaaagataaggagagaaatggggtcaacaggtaggaaagggaaagtcaggttgagagaagaacagaagatattactgaagcaggggacagagaggtttgcacacataagccccttgagtaagcacaagagaataggcgctgtagtgcctctagaaacagggaaggtagactatctggttacacatgcaggtgggtggattgatgtaatggctggagctgtggaaagcctattctgatatattctattttcataggatgcagaaagcaagtatgattgctaggcatcattaaggccctgcttgatgttagtaatcccaaatcttattcaagattattgcaataggggaaggagaattaattccatggaacaaaaggtaggagagcttttaagcactggggtgagctagtggaaaagtcacataggtaaatccagtgggggtactctaggagggaggcagttgttcattgtgattaggccatctgtgtttgctatttgttcctgatggaagttaggctcccatcctcccaagagactgagagaaaaggatctgtctcttttcttctaagattacatttcaaaaggatggttccaaggtccttgagaaggacattcctggggtgtgaaatcagctgggagaagattttcatcacaaagaggcagattaagaattttcagttgaaatttctttaaaagtaagtgctccaagtaaagggaaatcaggagccttgagtcaggaagctgactgtctaaagtttagtcaaaagtttagtcaagcagaggggaatattaagccctcttggacactagaacatttgattatgtgtctgttttttagcctcattcgtttacctggattcactttccaggtagatatagaattggatttaaccaggattgttattttgccaagcgaagatgggtggttgatagagggaatggggcgttgagtgcatatggagagtgattgtaatgattgaccttggaatttaaacagggcaaggaggagacaagcaccagatgggcaatggccagtgagaagtggtaggatcagtgacttttagtctcatgaggttaaagaatttctggagtagggctataagaagggataagttagaaagatagtgaaaatgcttttgtctctaggtactgactataccagtaattctgtgatccatatacagattcttagctggtggtttattgaagtcagctttgctgtgacttactggtctccttcatctatgtgaacacaaagtgaagcagaacattgtcacatttgactcctatgttcaagtataaaaaatttatgagaaaaagtactggctatatttctctctgaatgtgctgacctataacctctgtaaatataaaactacttttccaagttggtcttttgccttttgctttttttattgaatacactgaagactctctggtgacattgtgtgttgttgtttttaaatcaaactaaagcacaaatttattagccccagtcaacctcctaaaaaaaaaaaaaaacccaacaaaacaaagacttcatgaaattctttaatcattgtctttcttttccacagctgtaaaagtatttgctattttgtgtaacaaaagccatagctctataaataattctgaccaaagaaatgttttagtattttatgtcagattttctaatcagaagatgccttaatttgtgtttggattgtgtgagccatagtacagtccataccaatgctgaattaaaatggaaacagattattaagtactcatacatttgttttcaggatgtaaaaatgaagtaaacacacaaaatgcaaagtagacatgtaaatacagtacccagtacaaacaaagtgtttaactcaagttgaataaacaggcacaatgagaaactaaattatatatcagataaagtgaagcaaatttggaagagcaaaagcaatactgaagtcacataacattaaggggaaatgtgcttgcataataattgagctgtctatctcaaatagccacaagaagatgaaagaaccccagataattttgaaaggaaagcagtaccattaaagccttcaacaaagaagtttatagctttgttcgtttgacaaatatttatggagcacttgccatgtgccaggaattgtttcagggcctggagattcaggactgcgctctctcatagcatgtgtttcagtgaaggatactatgataaggaaggaaggaaaataacatcaagtgagaaggctacttctgtaattactaagggaagaactctctgaggaggtgatatttaaaccaagatctaaatgaacgtatggggagccatgtgcatctggtggaaggaagagcagacacaccattttaaagtaggaatgagtttgctgctcttaaagaacagaaggaatatttgtggatggtggtagtgtgttgagaggaggctacagaaaattaagcaggaccaagttgcagagggttctgccagtcatgataaggagtctggtttttattctaaatgtaatggggagatttttatggttgtaagtagtaaagtgacataagctgagttacgttttaataacatctctctgacacttgtgagaagaatggattactgagggaaaggccagttagagggctactgcaaaataacccaggtgagggtggatggtttgcatgtggacttatttcttattgactattcattctgaatattcattgtaaaacaatacttccagcagaagagaaaacaatttaaaagtaatatggaaagacagagactgagagaaacaagtgtaaccagacaaaaagagcattgaacataatgatattgaaagtgatatggatagttaagtgtgacaagaaggcaagggtacaacacctggggaatcttgttatgaaaatgaaaaaattaaaataaaaaataaaggatttaggagtgatttctgccatggcccaccccagcccccacctacccccttctgaaatttctagcataaatataccacccacttgtgagtttctccccatgagattatagtacaggaatgaatctctttattctttttgtttgttcattggcattattactattgttttaaaaattcaacttctattttattttattattatttttttgagatgaaatctcactctgttgcccaggctggagtgtagtggtgcgatctcagctcactgcaaccttcatcgccccgtttcaagagatttttgtgcctcagtctcccgagtagctgggattacgggtgtgtgcctccatacctgattaatttttgtatttttagtagagacagggttttgccatattggccaggctggtcttgaacgcctgacctcaggtgatccgcccgccttggcctcacaaagtgctgggattacaggcgtgagccacggcgcccacccaatttctattttagatacaggggtacatgaacaggtttgttacacgaggatattgcatgatgctgagctttagggaatggatcttgtcacccaggtagtgagcataagtatccaataagtagtttttcaacccccacgccctatcctcctctagtagttcacagtgtctgttgtcctcatttttatgtccatgtgcactcaatgtttagctgtcacttataagtgagaacatgtagtaatttaatgaacctttttctctttcctttatataacatactagaacaatttcctttgtatagtgaatcactccttcttcaagaacaaatgagagttttctctagtctctttgaaaagttgtgtatacttacaggtatagagtttcttggtcaaaaatctgtccagaccaaacacagtaatctcaatattttcctaggctgtgttttgaaagacaagttcaagtaatttacttgactttctaagtgttcactgttattgtcactgtagtatactctacttatcccatatttgactcaaatcgagacaataaatattagagattattttaggactcagatttattttgatagagaagccatttttagtttgtaaaataggagttttaggtgcaagtatggaacagaaaactctgactttataaactggttgcattaatctctatactatcccatatagtactgtgaaaatatgtatttgaattaattgaatgtatttgagtctattctgagagtctaggatgtacctgggggaagaggaaaaaattgtgaaattataaaacaggatccaatctcctctttcttactgtaacaagctaactcattttctttcttctcttatgtatactaagataagtctctatacatgaattacatttttcaaatggtttgaagaacccctaactaatctccagctaagaaatagctccctttaattattgcttacccaatcacaatggagaaatgtcagtgagaaaataaaaaaaaaaaagtatttatctaaatgttgaggctatgatgacatctttaaagaaagcagcaaataaaaactttttttcatagagaaaagtagcaaagattaacctaatatgtcacaaaaagcacttaaaagtcaatttgaatcaggggttatacattcacaaatgggggagtaaaagttgagataccttgaggaaaaccgaactttattgaaaacaccaaattggagaaccaaattaagtcaacaaattcactttttaccacctggtgtgagtaccattcctttatctatgtgaagagaagtggggcatggatgctatgtttagatctcctgatttttaggtagaaaacaaagcatatcagaaccacttctttgcttgtattaaagtcaatttcatgtccaattttccctttaaaacatttgattagattttcttggaataaaagacttctgtctcactaactttttaagaactctctacctttgatttgcaattttgcatgattggatcttggaaacatttcatcctaacttatgagttgttctgatttgtgtccctggatggtgcacttatgtacgttattatccactggatatttatacttctatggcaccgataaggtcttgggcaaataacatttcttacttactaaattattaattggaacattataagaaagttttttaaaaaagacaaaaaaataggcaaagagagaaaacatatttcaactcacccttgcttaatgatatagtaggaagtacatatcagattatacattccagggaccctcttgggaaaaggaggttaatgtagccaacttactcttacttgctgccaggtccagcaggctgattaaataatttagttgttttggctgtgcagctgttcctcagttttactgtcctgtgttgacatcatcccagactcctttgcattctctccaactgtgagtaacagagaaaaagtcctgccttaggcggagttattggagtactgtgaagctctctcttttatcattctaaataggcctagactcttcaggagagacactgataaggtcaatggcaacattattagttctctttgaaatctgttgtttgtaactaaactttttcttcccttccttcaggttggctcttgccatttaaagccaagctggaagagattaaaagtttctgttctttctcaattgctttggcctaacatgctctgagtttggaaatttaactgcctcttttgttctccctcatttcacttgtgtcttcccttttggggagcaaattactgcttttgaaggagaatgagttggaagatgtgtgtgtgtatgtgtgtgtgtgtgtgtgttggtagtatggaagatggggaggataaaaagagaagagcttaagaagtaaagacaaaactctcagttcggtattaatatctccacgtcttatttacaaagcaaatagggaatgggagaaaatatttgctaattataggtgttataagggacttgtatccataatttttacaagacacttacagcttaataataaaaagatgaataattaataagatgagaaaagcacttgaatagacctttctccaaagaagatacacaaaagtcctataaggacacaaaaaatttcttaacattattagtcattcgggaaatgcaagtcaaaatcacagttaacatactacctcacacccaccatattgactagaataaaacataatagacaataacaagtattggcaaggatatagagaaatttgaacctttacacatagctggtgagattggaaaatggtgtgccttctttggaaaacagtttggcaactcctcaaaatgttaaacatggggttaccgcgttgtcagaggtgtgtgagccagagcaaccccatcttgagtagaagctgggtaaaatgagcctaaaacctactgggctgcattcccagacagttaaggcactctaattcacagaataagataggaagtcagcacaagatgcagatcataaagaccttgctaataaaacaggtttcagtaaagaacccagctaaaacccaccaaaactaatacaatatggtgacaagagtgacctctggtcgtcctcactgctatactcccaccagcaccatgacagtttacaaatgccacggcaacatcaggaagttaccctaaatggtgtaaaaacggaaggtatgaataagccaccccttgcttagcatataatcaggaaataaataaccatcagtatgggcaaccagcagccctgggggctgctctgtctatggagtagccattctttagtcctttactttcttaatacacttgctttcactttactctgtggactcgccttgaattctttcttgtgtgatatccaagaaccctctcttggggtctggatcaggacccctttcttgtaactgtatgacctagcaattctgctcctaggtgcatacccaagagaattggaaacacatgtctatacaaaaacttacacacaaaggttgatagcattattattcatgatattcaaaaagtgcaaacaacccaagtggtcatcagctgatggatgggtaaataaaatgtggtatattcatacaataaaatattacttgactttaaaatgggtgaaggacttgatatatgctacaacatggatgactttgaaagcattttgttaagtaaataaaagtaaaatgacacatattgtgtgatttcatttacatgaagtatataaaacagacaaatctatatatagagaaagtaaattagtgaaggaggacagtggagaaggtgagtgactattaagagtgtgggctgggcacggtggctcatgcttataatcccagcacttcgggaggctgaggcaggcggatcacctgaagtcagaagtttgagagcagcctgcccaacatggtgaaaccccatccctactaaaaatacaaaaaattagccaggtgtggtggcacatgcctgtagtcctacctactcaggaggctgagggaagagaattgcttgaacctgggagacagaggttgcagcgggccaagatcgtgccactgcactccagcctgagcaacagagcaagactccatctcaaaaaaaaaaaaaaaaaagagtgtggatttctttttagggtgataaaaacattctaaaatttgatggtgacaatggttgtacaactctgaatataccgaaaaccattgaatttattctttacatgggtaaattttataatgtctcactaaagctgttattaaaaagtacatatggactttgatttcagttgtgataatttcaatgaaggaaacttttgggcttataagaagaatgtgtacttgggggtctcatttgacttgacagccatgcaaatatcctgatggcaaagtatagtatgaaattttaagtattaacaaaaataatacatgttttaaaagtaggcatgtaaaagagatttggtagggatgttgtagatacttacacgttgatttagtggttgaacaatattaactttttagcatctatctgagattctgtatttaattctcaacaaagatcttcctagttctaattctcagtgatttttatttctctccctatagagaggtccctctcccatattttgtaagtcaatttagccatcattacatagaaaaaaacaaatgcttgttcattgctttaaattggtgtctagttatgtgaacataacttgagatataaattccttaaaagcaaaactatattcatatttcctttaactgggttcctatatgcatttgattaaaacaacagtaataccttccacttattgatgcaaactctgtgccaggctaaggccatttgtctaatcccatctgagtaataacaatagtactattcttattattcctagtcccaatgtgcaggtgggaagactgagcctcagataacacagcgaattaaatggggaagtattttaccctatgcaatccgaccctggaatcagtacctttcagtactatactgcattgtaacttgaaagtttgcggaattaataaaagaaaaacttctcccacccctgactctttcttttaaataggttgtacttccttctgaaaatatcgacttgacttattttttttttatttttttttttgtgagagtaattagctttttctcagtcagcattttaaatttgttgtgacagggatccattttatgctttccacgagacccgaaacaaagtgtttctagacattttattgccagaatatgcatgctttgctccatgctgcttgtaattcattaaaatgtatgtgctctgcaaataggaaaccaatctgcaataaatcagctttctagaaaacattcatggaaagtgttcgaaatggttgctctgtaagaatacacaaacctgcttggtatttgtgtgatttgctgtcatttatggggtttgtaaacaaatagtggatttgtgtgaaactgtaaattagtagcctgccttcagcatgtgtgtgagatctgcttacaaaatgccatttgatagcatctgagcagatcacgatgagctccaaattccttttacagggacaagtgatgcacactggtctgaattagataaattgccctgacccaagattttcaactatttttttttcttaatccgagacatatttgtagctgccagaaaacctagctcacgggcttgtacacagttggcatctaaggcataaatcaatgaagaatagaagcccactcgtgcttacaagtaacaggctaaagataagaaaatcagttgggctttcagttttagccacagaatacaaagcttgtttgtgctagggagagttatcaaacaacgtggtgcaggagataatgtgggtattcagttccaggcctccccaagacctttgactacagagtacttctctgaatccatagcaagggcaacctactgcttccctgcggaaaaggaatcatgcagttccttaggccagggggtataagtctgtttcctggtagataaggctctgaaccagggcaggcagtattttagtaatgagcattcctcaaatcagtcaatgttaatgaggaacaaaccgtgaccaaccaaggctttagggagatggcagttgttgtgagaaaggatgttctgtttgcctcatgttctacgtgttcccttaattattatgagattctgtaagtgagctcctcttcactctctgggaagagctaccattcttttttattacttacacctaaaaattattattttaataaacgtaacatgatttgtcttgtaaatagacctgctgtgcaataccattctgcagatttttttttttgctttgactttgtgcaaatcagtttacattacagatgttaataattgctaggcatgagagtgttgtctctccctgactcctctttcctcttccaaaaatgttctttaaggtcaaattgaacagccccccaccttttttttttaaagtggcttaccctgactaattctactctatcctgtttgttgttttcttaatccttttgtacagtttgtactacaaagctgcatgcttgatcctatattgcctggaacttgtctgtctcccagttttctgtaagtacctaagcacagggtatgtcttaacatatatcccaagtttccagcacagcaaggatttgtggaagaattatgcctggtacttattaaataaacaataaatatttgttgaatcagaagtctgagtaggcttacaataaatgcatacatgctacccgagtgacccaatgaatgaaacaaaattgttctgttttgcatttggatgctttattaccacaactagattaaaaatgcatcaaggacagggagcatgccttctgaaatacaagaactcatcatgagggcatgtagagtagaggttgctggtaggagattgtcaaggatacacaatcaaggtggaaaacaaagaaggtgtgggaagctaaggacagaaagatcatgggaaaggaataagactcatttttcttctatcatccttctcctttccctatccatcccagggagatataacaaaggccaaacctttagaaggatattttgaagaagaaagaaacttttgtagaagttgttgattttccagtataaggccccggggagagagctgaactgttgtcagttactgttcactccacaaggatgtgaaggcctctgatagccatcttgccgatttcccagttacagtttagtgcttgcctatgggaatctcctaattaacaatcttacagtgttcatgtcttctctctttctgtttagtttcgtgtctacagaatagagatagtgatcctacatatatggatatatgtatgcatatatgtgtgtgtttatatatctatctttatatcgccatataattataatgcctgggtttgaatattggcagcaccctttaattgtggttcaatcattccttagctatgtgatcttgagcaagttacttaactcccctaagctccatttgttttcttctggaaaagaaggatagtaataatacctacctcatagaactgtttctaattttacttttaaacataacttttttttctcatgagtagaccttattatttttagagcagttttaggtttacagaaaaactgaacagaaagtagagaattctcatatactccctctctcccactcacagtttcctctatttttaacatgttgcactggtgtggtacatttgttacaactgatgaaccaagattaaaatattatttttaattaaagtccataatttaccatagagtgttgtacagttctattctttgggttttgccccccagaattaggattttgccaaatgaaaaatgtcatatatccatcattacagtatcatacagaatagtttcactgccctaaaaatcctcttccacctacttatcccctctcttttactgtctcagtagttttgctaatatacatgatattgtgtttttaatttcaaatttcaattattcatgcgagtatataggaaatcaattgacttttatatattaaccttgtatcttgctacctttctataatcacttactagttccaggagtcatttggtcaattatttggaattctctacaataacaagcatgtaatttatgattgaggacaattttattttttccttccccatctgtctctcttttatttcctcttactgtcttactgaattagatgagacttctaatataatgctgaataggagtggtgtgaggggacatccttgtcttggttttgatctcaatgggaaagcatctagtttctcactgttaagtatgttagccgtaggctctttgtagttttttgttgctgttgtttttaacaaaacttacccctattcttagtttatgaagagtgtttatcataaatgggtgttaaattttgtgaaatgctttttctgtatctactgataggatcatgtgatttttcttctttggcctgttatgtgctggattacagtaattgatttttgaatgttgaacaagacttgcacacttggaataaatactacgtagtcatggtatataattctttttaggcattgttagatttgacttgataatactctgatgaagattttggcatctatatttctgagagatgtcggtcagtagtttttctttcttgtaatgtctttttctaattttggtataagggtaatgctggtctcagagaatgaagtagaaagtattctctctcctatttggtgaaccagaatatatagaattggtattattttttacttaaatatttggtagaatttacctgtgaatctattagggcctagtgccttctgtttggtaggttattaattattgatttagtttctttgatagataaaggactacttagattatatctctttgtgtgtgttttggtagatcatgtcttttaaggaattggtccacttttctaaattataaacaatttagagttgtttataatttttttttattttttgttaatgtccataggatcagtagtggtggccccttcttcatttatattagtatttttgtatcttctctctctttttttcttggttagccttgtagggatttatcaattttattcatcttttccaagaaccacttttggttttgtagattttctctactgtgtttttgttttcagtttcattgatatctgacttgatttttataaattcttttctaatgcttatgttggatgtaatttgatcttatttttctagttttctaaattacagcttagattatttatttttagatctttcttcctttgtaatgtattcattcaatgctgtaatattttctttaagtactgtttctgctacattccaggaattttggtaagttgcattttgattttcagttagcccaaaatagtttttaatttttcttgaggttcttctttgagccatatgttattttaaaaatgtgttgtttaatttccattacttttagaattttccagctttctattattgatttctaatttaatttaattgtagtctaaacacatactttgtataatttttattcttttgaatttgttaagaaattttttatgacacagagtgtggtttatcctgatgaatgttccatgtaaacctgaataaaatgtgtattctgctattgttggatgacatattctaaaaatgtcaattagactgattaatggttgagttcagttcagttgaactacatccttactaaaattctacctgctagatctatcaattaccaataacagggtattgaaatatcaaattataataatagattcatctatttcttcttgtagttttatcagtttttgcctcatgtattttggtgctctgtcgttaggtttatgcacttaaaggattgttatgtcttcttggacaattgatcctttatcattatgtaatgcccctctttagtcctgataacttttcttgctgtgaagtttgtttttttggaaattaatatagcgatttctcctttctttttattagcattagtgtgatatatctttttccatctcttaacttttaatctctctctgtctttatatttaaagtgggtttttaaagataacctatggtttctttaaaatccatttaacagtctctgtattttaattggtgtatttacactgttcaaatttaaagtagttatagataatttgaaataatatctatcatattaatattagcatattattatatgctaatttgtgattattttactatatattatatacatttataatattgacataatatgctaatattgctaatactaattttagcatattacttctatttctttttttttttaacattttttagtggttgcccttgagtttgcaacataccaccaattcaggccatctttcaattaacactacatcacttcacagatagcatatgtaccttataacagagtattcctgtcccttataaggttgctgtcattcatcagatctattcataatctataataactgagtatattgttactcttattattttgaaccagttgttacctgttaaatcaattaagaataagaaaaataaatgaatttattttgccttcatttactccttttctaatgctttttttttttgagacagggtctcattttgttgcccaggctagagtgcagtgatgcaatcacagctcactgcaacctctacctcccaggctcaagcaatcctcccacctaggtctcttgagtagctggaccacaggtgtgcaccatcacacccagctaatttttaaatttttttgtagagactgggtttcaccatgttgcccaggctggtcttgaactcctggatgtaagcaatcttcctcagcttcccaaagttctgtaatcaaaggcatgagccaccacacccggccttacttcctttatttttattttttgtatgtctgagtttctgacctttatcattttccatttctctgaagaccttcttttaacatttcctgtaaagcaggtctactgttaacaaattccctcaatatttatctaagaaagtctttatttctcattcacttttgaagagtaatttcatgggatacagaatgctaggttggttttcttttttctctcaacactttaaatattctactctattctcttcttgcttgtatggtttttgtagagaagactgatataattcttacccctgtttctctataggtaacgtggtttattccctatctctcttctttcaagattttctcggtctttaattttcatcagtttgatgtgatacacacaggtgtgaattattgggtgtttattctgtttgatattctctgagtttcctggatttgtggttttgtgtctgtcattaattttggaaaatcatcagacatttttattccaatatttcttctattcctaatgttcttttttatcatgctggtattctaattacgtatatgttgcatcttttggaattgtccctcagttctcgaatattctttttttttttttgtcattcctgttttttctttgcattccagttttggaagtttttatttatatactttcaagctcaccaagtctttcttcagccatgttgagtctactgattggcccatcaaaagcattcttcatttctgttgcagtcttttaatttctagcattttcttttgattctttcctagagttttcatttctctgcttatattactcacctgttcttgtatgttgcctagttttttttttttcattagaactcttaatatattattcatagttagtttaaattccttttctgatagttacaaaatttctgccatacatggttttggttctaaggcttgttttgtgtctttgcattgtgggtttttaatttgtttgcttttatgttttgccttttactatgcctcgtaatttttttgaaatttgggtatgatgttttgagtaaaagaaattgaagtggagaggtatttagtgggaggttttttttttgtctgtttggcaagaagttagtctgtgtttatcatttgttgtagctgtagtgtcaggggctaaaattccctctggtgtccttgtctttgactcctattttgtctttgagtttccctaggaacttgttcttaaatagattctgaggcttatagtcctatagctttaatattgttatacaggagcactactgatgtagtgataaagtgtcaaggggatttcttctatattcctgtgtttaggtgtcagtattttagcaagctggagttatgcatacccctttctccttatcaaagactagagggaactggactgggtatttgccttcttccaggttggttaatccttgataaaatcccagcaagttaggctctggtgaaataatttcctttgagtgcaggacttgttaaggagaacacagagctcggaatttacttcaaaaatggttattttctcttgagaaaaagtacagatcacttttcccctagatttatgatgaagacccattagagtttctagggataaaactgatggaagtgtggagttgcccctaaaactgaaccccatagtctgtctttctgatttttggggcagcagtttgctctgtgactttatttttcttatgaagctctaagaaatgctattgatctttagtttgttcagctttatttttcttataaggatgaaagtgttgacttacaagctctttatatatcagaccagaaactactttttaaaaaatataaaatataatcaccatctaaagcacttagcacaatgcatggcatgtagtgagcacatatttttagctcttactgttatttattattattccattgagaaaaacatttcctaataataatgaaatgacaacatgatatggtagcatcacaaaaatcaatacatctttctgagcatattagaaattatttctgtatgaaataacaggtttaaggaaaaaatttaatgtggtcagaagtgtgcaatcaaaataatgagatgacattggcatgaagaacaaactcgagctgaacgctaggccagataacctgtaacaagagagaacagtgaggaataggaaagaaagtagcagaaactgggattgaaggagtgtaagtttggaaatagaaaatgtggtgagggggataatagcctctgtagatatttgacccgtagcagaattgattcagcaagctttgtcttttgttttcaaagatggtgctttctgatgaggattgttatttgtaccaagagatgctgctgaacagtttattccgagaaaagctgccctttggttctcagctgtcgccactgtttaaaacaaagctgtcatggatgtgtggcttgccccacctctttgcttccccacccctgataactgtgcatctgcttgccctgggtgctactgcatttttccagcggctagaattgtcacagcatttgaaaagcatgaggaaagcattcctcctgtcctgcctgcttgtagacatatcagttttccatagttacggcttattttctctgaaaatttcttgcctagcatagttttttttttttttttaactgaataacatctcctgagtatctcccaagtagctctagaagttttgcttgcttccaaaacctcacgatcagcaattctgccataccttttagtgttaagacgatatgtagttctacctggtaattgtaagtaaccaattttatatttataaaacagaaagcattgcagcctggcaaatgttggatcccatctgcaccatgaattttcagtttgttctagaccttgattcctgtatttgtttcctaaatggactactagattatatgagtcacctggggaagttgcttaaaatatagatttctagaagccacctgagaattactgaaatgtatcaatagatgatatggtttgaccatattcctatccaaatctcattttgaattgtagctcccataattcccacatactgtgggagggacctggtgggagataattgaatcataggggtggtttctctcatactgttcttgtggtagtgactgtgtctcacgagatctgatgattttataaggggtttcccattttgcttgactctcattctctcttgtctgccaccatgtgagacgtgcctttcacctttcatcatgactgtgaggcctctccagccacatggaactgtgagtccattaacctaaaacctctttttctttataaattacccagtcttgggtatgtctttatcagcagagtgaaaatggactaatacaatagggaaggagtctggaaacctgcacgttaaatagtaacagtaatattgcaagtcaggttacagattggcagcagcaatcaaacatacacaaaaacatgcacatacacacacactcatgcattcacatgctatagagtcccactttatttagttaaggaaacaggaactaatggaagtgggtggctaaagacagcaggaataaatacttcctatctctgcagtgcttttcccatgacccctccttctattactaggactgaaaacaaaagttgacacttccctctctccttgcacttttgttataagatttgtattatcatttgagactatgttattctaaaattttggcatttccatttaaggcaggagtcagcaaattgtttgccacctggttttatatgaagtttttgaagctgattttggcagcaatgaactagaccttaattctctggatacatttctggcaattatatcatgtgccttaaggcaagtactagtagactgtggctttctaggcatatgagtttgtgacaactttcaggaaacaggtcacactctaaatccagatagatgagaaacttccttactgaattgaaaaaggtgttttaagtggaaatcaggaggcctcctgaggcttctgtcattactttcagtgtcagcttcttaaaaagctcaagggccagaaagcttgaggtgggagagaaaaagtgttaataaagaacaattatggtacactctgactgacatttgaatttgtaatactcctttctaattagcattaaagctttctctatttgaggaaaaagatatgtgactgaactttaactcctaaagagatgttttaacagctgctcaccatcctaagatgaatatcagcaattagaactattatcgttttctgtcatcattatggctactgttatcaatcttcagcacagaaagccatgatgctaatgctggctgtaccaaactatgaaatcctaattaccattccatgctctagaaaagaagctatttgtaagaacaaaacagctattaagtggaggagggcatggtagacttttagtgtgctgataatttggaatcaccagctaaaagaattctggaaagtaaccccttctttcatctgcttcttaactgattttaagggttatcggatattttccaaagcagtttgggatggatattgtatactttgacctctcaaatgtggctcccacactgattttgcaatcagctaatatcactgtttgatgacaatcaaagagcgttcatgcataattactgttgacccacaaagagatacagttagtggaaaaatggctctaatatataaaaaatagtacatctgttactgagacacagccttcgcaattatatatagtagtctaaaacgtatacttcactattaagttatttgatcaactattttgaaactacagagaatattgcccttggccactcactctttacctacttttatttgatattcaaagagagtaattaaattgtttattctaactgtagtcataaatacaccccataccagaccaaaacaataacaacaaccatactttcaacattaatgtataaatcaagaaagctgaatatagaagactgaaactaattaacttgccattttacttatctacgtttttgttaatcaaataggactcacccaccaattgctgaggagttatcaatggatcaagaaggagttttatcagtaatgttaaggcaaaaccctcagacttaacactatatcatttttctttaagtggaagagtgttaaaaggaaagactttcttttgaccccagctacataatcttcttcctagcattgcctgaccaacatctgaattccttccttttttttttttttttttttttgagaccaagtctcattcggtggcccaggctggagtacagtggcacaatgttggctaactgcaacctccacctcccggattcaagcgattctcccacctcagtctgtggagtagctgggattacaggcatgtgtcaccatgcctggctaatttttgtatttttagtagagatgggttttcaccatgttggccaggctggccttgaactcctgacctcaagtgatctgcctgcctcggcctctcaaagtgctgggagtacaggcatgagccactgcacctggcctgaattctgatataaatgtaaaacacagaaagttagagggtctaaagctgtgtttctcaggtaaaatatgtttatgagaattaacataaattctagatattctggagcttcctcttagaggatactacatattgaattctaacaagattttttgacttttgttaccgtttctctaactgacctagggacatgttattttcaccttttacctatctgttgcacagaacaccatgaaacgtactgtgaggatgctggtctaggtatgaatctttgtgtaataaagttggcttccacatagaagcgttattggaaatctcagttactgtaaggtagcatcagaggtactggaagaaaagaaagtgacatgatcttaggtagcagcatgtctagagacccaaagttcactccatgtggtggtatgtcagaatttccttccttctaaggctgaatgaaaccttgaggacatttatgctaagtgaaataagctggttactaaaactgtatgattccacttatgtgaggcatttagaatagttaaaattgtagaggcaaaaagtagaatggtgtttgagatggagtggggggaggaaaatgaggagttactgtttaatcaatagagagtttcagttttacagatgaaaagagttatggagctgaatgatggcaatggttgcataacaatatgaacatacttaatgctagtgagatgtacacttaaaaatggttaagatagtaaatattatgtcatgtatattttaccacagtacaattaattagaaaaaaagaatgccttctattctgttgtagatctttttttaattttaaaagaacctttttttttcctctttttttttttttttttttttgagacagagtctcgttcaggttacagttcagcggcatgacctcggctcactgcagcttctgcctcctgagttcaagtgattctcgtgcctcagcctcccaagcagctgggattacaggcatgtgccatcatgcccagctagtttttgtatttttagtagagacggggtttcaccatgttggccaggctggtctcgaactcctgatctctagcaatctgcctgcctcagcctctcaaagtggtgggattacaggtgtcagccactgcgcctggccaaaatgaacattcttttagaaaaagaaaggcaaacgtagtagttttcattatgttttgttttaaaatattctcacttaggaaaataaaatttaatgaccctattctctccctaagttattaatatggtttcaaaatattgttaggtttctagactctgtaagaattgacagtatactggaagtgcttctctcctgtcctcagcattggtgactctcagtgagctagctactgctcttattgaggttgtgtttctctactcctctgtaacatcgtataaatttgtgtgttgcaggagccttgtggctatgatgtaagtttcgtctctgcgcagttaattggtccattatggaactgaatattcaatttttgtgtctctggcacatctgtctgacaaaaaactaattgtcctggattgaacctattattagaccatcttttgttactcgaaaattaatgtaccaggggtcaattcaacatctcaaaatacaataacctctaaaataggaaagtcatgggatgataataaataaaatgctagaggactgggtgcagtagcttatttccataattccagtgctttgggaggccatggccagaaaatcacttgaagccaggagttcaagaccaggctggacaacatagcgagacccccatcgctataaagaataaaaatctaaaatgaaataaaatgctaaagatgggaaggaccctggaggaatcaaccagaccaatcccctcatgttatcaatgaggaagccagacaggatgtgataaatacataaggttcccttgtctttagcttctgaaactcctctcagttaaatgtatttccatcatgtgggtaatacaccattcttataggaaaggaaaaactctcagttgtactagggcaagtataattcaatagacaatacagagatccagagggaatcaagaaataattttgcatattccttctgtaatatgatcaaccatagtaaataaatgtttataagaaggatgtagtaaaaataacaagattcacatttatgaaatgtagttataattttttcttattcaagtatttgtgggatcatcttaggcacatttagaatccaaatagtctattatagaattctgtcttcaaactgtatttaaaaaggagagaaatgttaccactataaatccttgatatgtttgaaaatcctggtgttattttcagtttttctctgtagaaagcaattttctctgctgactaatatggaaatttagctggagtccatcctcctcattaggtaggataatttttgttaatgtaacattataaatcacttagtcttataaatattctgctttattccttacctcagaaatcttcttatttaagatattcagtatcattttatctttcctgaattggtttggtgtttttttttttttaattgaggacatttttattctttaactatcaataaaatcatttccatagttccaaaaatgtccagaaaataccatacagtctggaaaagcaagaaaagaacattgagaaacggttcagtattgaccccaaatgtcctttaataataacagcttccatttattaaattatctttatatgttagtcatgagggctttatttagtttcacttgttgaatctttggacaactctatgaagtaagtggtactaagaccattttacagacaaacttggccaagaacacccacctaggaagttggattgggatctagatctgctatactgccacggccaggttttaatttttatgctgctctgccttgccctctaagtggacagatggaggagaagctttactagggaccaagcgtggggtttcgttgtgcctctttaaaaggcccagccctggtggggactgtgacaggacatttggccagggcagttctaacaagggtgatgccagctgcttgtgaaaaattgagtcttgtgaaacctttctgtagctttacaatttctgtttcaatgaggagctttcagttacatctattgactgctgccagtgaactgacaataaaatcaacaatgatacttcctttgtacttggaaaggaggtgaagcgggggttatctcagagtcagagaaaaaaaaatgtatcttattctttttataatcagtccctaaagtgttttctggaactgttgacattcttgtcagaaattgtgtcttggctacatgactatacatttttgaaatttgtagtctaaaccaacaggtattatccaaagactttagtacattatcacacattgggtagcagccccaatgtgtgataatcatgatttccaagtacagatgcaagatgtcatgtgcggactatactgtgtttcctaattacaatcctatcttacattgctccagaggttcagactttactaaaggggcctcctgtattctggccagctcttgctgtgcaggaatagaagggcttgcatctattctaatttctttttaagccaaaaaatccagatttttatatgaaatccagagtttttttcaagagaattaaatcatttattgattacacatgataatggatgatctataagcttcattcccatctataattttatctggtcccattattcaatttaaatatattgcataggatgcgccaacaatcatttttataaccgataatttcatgattttgcttgggtaatcccttttaatggtgaacttcaggtcacaacagtaactatcaattcaactacaccaaggtttctgaagacaatgccttcttcacccaaacagaaatccagatttttatgtgaagttagaatctcctaattctagttcttaaattttagccaagttttttttttttagttaatacttgcagatcaaaagaaacaaaaaaatttgtgccttaggttttctctagtaaataataatacttctgatgtcataaggttattgtgaggattaaataaaatgattagaatatgtttaccattaacttttagctgcttaataacttttagctactttaataataagaagaagaagattttacattgctttcagtacagcagtaagaaaatatgtgccaaagtcacaatctctatacaagcacttcagcagtgacataacacaaacatgaataacacttagttgtagtatcatcttaaaaaatagttaggaagcattatttgaatttttgttataaagtacaaatattttgttttgagtgagcagattatttatgtgtataaatacatacatgtaaattagataaaccaagggactagctagaaatgcactttcctggtgtacagcaatagaaccacatcaaaattgaaagaaagaaaagctttgctcatatgattcaaaaagccatcacccagattccaagatcataacaacaaattagataagaaaatcagagtaatcattggaaaagaaaaaatccacaagtgtagggttgtgtgcatgattacacacacataccccccccccaacaccgcccacacacacgcacagatttttcaggttatattttgagttgtgtcagccaaagtgcaatgtgcattaaggaacaattctacacaccctcagttttatgttttgaaaattctattagggaaatttgttcttaacattttagcttcacacttttgaaatctattgagaattctcaatcattttgcattcgttaagatatattaagttgctctacagtaaccaacgatccccaaataacagcagcttaaatttgttcctcactcacattacatgttcagtgtaggtcagtataggggttctgcttattgtggtctctcagggaccaaggctgacatggtttccgttgacctctgtttctgtgatcaccatagcagaggcaaaggtttatccctgttttccctaccgtctgtctgtgacgtctggagtagtgaaagattagccttgccaattgtggatgaggagaaggacaaactacaaggagcatctctgattgcttcagtatttttagtctgcacacacaaaggcagagctcatagtcaattatgtctgagcaattgtttttgtcacagagaaattgagcaaaaagttcaaccattctttactcatggatttcaatcaggtatcaaatgagaagctaatcaataagccaggacagagaaagaaacagatgatagagttttgggcagaactatgaggtgggggcttagaagactttctatctgcctctagcctaagcaggatggttccggcaatgggaactggtgacactgtactcattaccaggcttctctacttgctactccaaaactacctcttcctgcccatggggtagcttggctatagtggagtgagttaagtccctggaaatctttgtcttattcaccttgaaagttgagttgactgggaagagcctctctattctcaagagtaggggacatcagcttctaaatcttagagaagtgctaaatatttatactaattgaacttaagaatcattcagcctgatttatacatggttgttaaatatagaggaaaactcagtataacctgtggttctgttaactattaaactgttaaattttctggagataagtgctccttatgatttaaacaaacaaacacaagagcaattattggagaggcgattcaattcggtaaacagttaccgaactcctacaactggatttcagtaattgcagggcttgagataggatagatttgaagataaaaatgttttaaccttggagcacagataaccagacatcttacttccccttttaatttcatacaacccggcatttgttcttctctaaactcatatatcactcagtcatgaaagacttcttagttaccaaatccaattgtcgcttcttattccttataatatgtgtcctctcttgggaatttaatatgactcataatttcttcctcaaaacaatcaccttatcttttgtaaccccatacttttctaggtttttttgccaattttattggctattatattgtcacctttacaagctatgagtcttccagttttcccttcagcataggtattcaccacagtgaagtactcactaaactttcctgaagttactttgttacattaatatgcatatgcaaatgatctaaaatgtatggcactcttccatttattatttctgaagacagccttatgtgttaattgcatagccacccctcctataatctctaactcaccctgtttcatactgagctcatcatcttcctcaaacttcatccttcttttcccattttattgaatggcaatatttgttcaaggaaactggatcttccttgtttccctccctttttaaatttctaaatttaaattctgtttattcagccttgtcagaatctcacaaatattatcccttctgttcaatctagtgtgggctgggggttaggtgcctctttccatgtgttgtctcaacaactgatttatatctctatcatagcaatttatgtgccattattatgaatccttaattttatttaacttttttccctgttgctgatggcctcctcgagtcctggaacatttatttctcaattcacagcatttataacatttctttcatataatgcataactaaaccacaaatgaataaagttagtagtgcagagatgctgacaattaaagctatgcctgataattttgttttctgaaagtaaatgacaatgtccttaaattttcgacaaggggctaactggatttgtacctagaggtagtgaaatgatctgtgtaggcatagtactggattctaaggaatgagtcaacaggacttgtgaaaaatctcccatttcttgcatcttatatctttgatacttccatttatcatgctgggggtagagagtatgagaaaagctaaaattataattttttgtttgtttgtttcccaagtgtacttgttatgatgctggcttaaaaacaatttttttaaaaatttttttgcttgcataaacacatacttgggcagaatcaaaggaaatgacaaatagaatttacaattcttaaagattttctaaatgtatgtgaaatatgcattcctggtacagaagcttatgacattcatattagaaacaacccatttctcctgaattcttacaaactttttagatgacagttctcattttgtttttgggctttcttggaggaattgatatagttagaagaggaagtataagagatttatgagaagattttcataatgattcacagaaattcagaaagaattattttgctgtttagttagcaggagtgccttcttttaaaatttagctttacactctagagttggaaaacactttaagaaaattacagaaacaaagatgaggtactctcagtaccagacctaatgtccataatgccatttctaggttttccagaccacttcataggacttgatttacaagtatgaaatagttcttcacatgcaagcagggactgttgtatatttcatatgattttattgtggccatattctatgccgctatgagctcttaggaggaaagtcattaaataaaccgattaaataaaaaataaattaatatgaatctgactctctctcctgcaatgttggcctgttttgaatgtttaacctaatttaatatttccaggggctttaagctattatgtgctctcagaaagagcatattgaaacaggccatggtttgtaaatcttggcagatgtttaagaactaagtctttggttagtctgaattcttttcgttccagtctgacttaagaaatcagatccaagagttgtacataccatctgtattcaaagattctctgaactgcctgtttatttactgtttaattttgtggtagtttatctaacttcttagaaataatactttgttttcctttttatgttaactaaaaatgagagacttctggtcagcatgctaaggatagtctctactcaggaatatttaaatgcctgatttccactgactgagagtgccaaagtccaaaaattcatccaaatacagtagttcccccttatccacagtttcactttctgtggcccgaaaatattaaatggaaaattccaaaaataaacaacttataagttttaatttgcatgctggtctgagtagtgtgatgaaagcctgagcccacactgttccactgagtatgtgaatcatcccttagtccagcatatccatacttatacgctatctgcctgttagtcatcgacatcgtccgctcctgacttccaaccatcaacattgtcttggcttcatgatctaaaatcacctgaagcagatgatctttcttctgacatgtcatcagaaggtcaatagtaggctaatacaatgttcatgatgcctatgtcattcacctctcttcatctcacatcatcacaagaagaagggtaaacacagtacattaagatattttgagaaagagacagagaccatatacacgtaagttttattaaagtatgttgttaaaattgttgtatttcttattagttattagtctcttactgtgcttaatttataaattaaactttatcacaggtaggtttgtataggagaaaagatagtatatataggatttggtactatctgcaagttttagacagccactggggatcttgcaatgtatcccctatggataagagggggtcattgttggctttttatgaatctgaacctaaatgtggtttagagcaaggtggaaagacatttgaattttactttaagagggcattaatgtcattccccttctttaaagtgattggaaactacaatcttaagcattcctttcttcttaaactttgtatgatcctaatacatatgtcatttttatcccttttccttctttcttactcacccctcttcccactgagaagacacctgcacatgtgatgtcctccaaggattgtgtgacatcaggggtatccctagtcacattttagtacttctctggagtcagagtacccaaaatcaagtcccacttttgctatttcccttctagatatatgactctgagcaaactgtttagtcttctaaagcttagttccttcatcaggtaaaatgggaataatatcattgtatgtacttcagaaagtttttgcaagcttctggaaagattaaatagaatatattattaatactattttatcatttgtattatttttgcagtggacactgatagggaaagggtatgtggatagacccagcaaggagaatgaattttatagtgtatgagtatgtacacttttaagaagtaaagtctaaaaattcttctcgttatgtgttagtgcttggttcagctttccttagtttatcctatgaatcctctattctgttttgaccacttcagctattatcttattttattctcttagtgttgctccattgtcaccacacattaattgccagaattgaacattattttgcattatttccttttttagaatctaaacttatttaatgtaatattgctacaatagctatagcagaactcacacagaaatttttatttgctgtagaaaatatgtcacatacggccaaattgagaatccttctgccttgttgtgattggtactggatcctatttggttttgttgattttaaaaccataattaatttttttaaatccacaaaaaataaaatccacaattgattacaaccctgaacagatacatacaaactctgaaggatgtaaagaagtaaagcacaggcttaacattgctttgcttctttataccatattatttatataaaatcaagagcaaagtctgatctcattgtcaactctcttctttcttgatgagtttataaacttaatttttttttttttaattttgagaaacaccactatcttggtcatgtccttaacatgctttaacttgtcttttttggcctctggtaagtactttagggagtagagtccttaaatatgttgagtggccatgaaacagcattttaacttaccagtgggaataatacatatatatttggtaaatgcaagagtactatataactgtagaagaaaaatctttgattttctctcaaatctactaaaatgtggtttgctatgaaaagttatgctgatgagtgatcctgtttacattctcttagttattcctataggtgacttagatactcagaaaaactgagactatttgttgaattcctagaaaatttaaaacattcaatgaatggagtcttttatatacttgatttgtttcatactgcctttgaattaaaattaatgaaaaatttctatagccttatagctgcccctagtccccaccagaaacttaaagagtcaggtaattggtcattctctgttgcttttagctctattctttttttcatgacttctctttattctttgcaagacaggtataccaaatatcccctgctttttttggttggagtgaaaaataagcccttgtcttttttccttttaaacatttgggactctgtcttatttatttcaggaaaacccttctcttattttggggatcagctttctactgataatcagccctctattaataattagccctctactgatggtcagtcctctactgataaatatatgatcccaggaaacgtacttttctccaaaggttaatcctggctgctcttaaataactctactgctatggaaaagagagacccttttgatgtgatatgtgaatatagggctgggtcaaggcctctgtttatagctcttgccactggtacaagtttggatacctatgatggctatactggtttttcaaagttcaaggaaaaatgggccctacctctcatgtagtgtcagccagggatatttttcaccaaagctgagtgggatcccagacatcaagctttacagagtcatttaaacatgcaagtcctgccaggccattctgtttctgaggagtgaggggagggttttttgggaccttcaagcaccacttctcttcaactttgccatgttattacttcccttaactttcgtcttcttctctctcttttttctttcaccaaagcaccaagcccataaccatttcctattctagaatgagtaacacatccttttgagggaaaattctcatcagatcacagtagatattgtaatgatcattatctatatgatgaaagtgagagatagaacaattttacttctcaatatccaagtttggggaacacaatcaaagctagatagagaaaagtatcaacttaccattgtagtaattccatctgttcccctctctgccacttgttacatagcaaaaaaatcactctattttattaaatttcaggatccatccattgtaagatacatcctaatttgaggaacaataaatcaaaaacagagcatcttagaatcagtgaaatttagtacatagcatatatgtatggtttagggatttcttttcttttgttccatgtattttcttatgctttcttttaaacaaatttaaaatatttggaaaatgcaaaagataataaggaatagtataatgaacacttaagcaccaactatgagacttaagaaatagaagtttataattaaaattgaaaccttcagtgtatcctctcatgtacaatattctgtctcagtcactgtaagaaattctacattgaatttaacattcacatgcttttatttatattttgatcacacgtgcttatgtttttttattattttattttattattattatactttaagttttagggtacatgtgcacaatgtgcaggttagttacatatgtatacatgtgccatgctggtgtgctgcacccattaactcgtcatttaacattaggtatatctcctaaatgctatccctcctccctcccccgaccccacaacagtccccagagtgtgatgttccccgtcctgtgtccatctgttctcattgttcaattcccacctatgaataagaacatgtggtgtttggttttttgtccttgcgatagttcactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatatgtgtgcatgtctttatagcagcgtgatttatagtcctttgggtatatacccagtaaggggatggctgggtcaaatggtatttctagttctggatccctgaggaatcgccacacggacttccacaagggttgaactagtttacagtcccaccaacagtgtaaaagtgttcctatttctccacaacctctccagcacctgttgtttcctgactttttaatgattgccattctaactggtgtgagatggtatctcattgtggttttgatttgcatttctctgatggccagtgatgatgagcattttttcacgtgttttttggctgcataaatgtcttcttttgagaagtgtctgttcatgtccttcacccactttttgatggggttgtttgtttttttcttgtaaatttgtttgagttcattgtagattctagatattagccctttgtcagatgagtaggttgtgaaaattttctcccattttgtaggttgcctgttcactctgatggtagtttcttttgctgtgcagaagctctttagtttaattagatcccatttgtcaattttggctttggttgccattgcttttggtgttttagacttgaagtccttgcccatgcctatgtcctgaatagtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatatggcattatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggcgatgcgggctctgttttggttccatatgaatttgaaagtagttttttccaattctgtgaagcaagtcattggtagcttgatggggatggcattgaatctataaattaccttgggcagtatggccattttcacgataatgattcttcctatccatgagcatggaatgttcttccatttgtttgtatcctcttttatttcattgagcagtggtttgtagttatccttgaagaggtccttcacgtcccttggaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagatgatggggttttctagatatacaatcatgtcatctgcaaacagggacaatttgacttcctcttttcctaattgaataccttttatttccttctcctgcctaattgccctggccagaacttccaacactatgttgaatgggagtggtgagagagggcatccctgtcttatgccagttttcaaagggaatgcttccagtttttgcccattcagtatgatattggctgtgagtttgtcatagatagcccttattattttgagatatgtcccatcaatacctaatttattgagagtttttagcatgaagggctgttgaactttgtcaaaggccttttctgcatctattcagataatcgtgtggtttttgtctttggttctgtttatatgctggattacatttattgatttgcatatattgaaccagccttgcttcccagggatgaagcccacttgatcatggtggataagcttcttgaggtgctgctggattctgtttgccagtattttattgaggatttttgcctcaatgttcatcaaggatattggtctaaaattctcttttttggttgtgtctctgcccggctttggtatcaggatgatgctggcctcatcaaatgagttagggaggattccctctttttctgttgattggaataatttcagaaggaatggtaccagttcctccttgtacctctggtagaattcggctgtgaatccatctggtcctggactctttttggttagtaagctattgattattgccacaatttcagctcctgttattggtctattcagagagtcaacttcttcctggtttagtcttgggagggtgtaggtgttgaggaatttatccatttcttctagattttctagtttatttgcatagaggtgtttgtagtattctctgatggcagttcgtatttctgcgggatcagtggtgatatcccctttatcattttttattgcgcctatttgattcttttctcttttcttctttattagtcttgttagcagtctatcaattttgttgatcctttcaaaaaaccagctcctggattcattaattttttgaagggttttttgtatctctatttccttcagttctgctctgattttagttatttcttgccttctgctagcttttgaatgtgtttgctcttacttttctagttcttttaattataatgttagggtgtcaattttggatctttcctgctttctcttgtgggcatttagtgctataaatttccttctacacactgctttgaatgtgtcccagagattctggtatgttgtgtctttgttctcattggtttcaaagaacatctttatttctgccttcatttcgttttgtatccagcagtcattcaggagcaggttgttcagtttccatgtagttgagtggttttgagtgagtttcttaatcctgagttctagtttgattgcactgtggtctgagagatagtttgttgtaatttctgttcttttacatttgctgaggagagctttacttccaagtatgtggtcagttttggaataggtgtggtgtggtgctgaaaaaaatgtatattctgttgatttggggtggagagttctgtagatgtctattaggtctgcttggtgcagagctgagttcaattcctgggtatccttgttaactttctgtctcgttgatctgtctaatgttgacagtggggtgttaaagtctcccattattattgtgtgggagtctaagtctctttgtaggtcactcaggacttgctttatgactctgggtgctcctgtattgggtgcatatatatttaggatagttagctcttcttgttgaattgatccctttaccattatgtaatggccttctttgtctgttttgatctttgttggtttaaagtgtgttttatcagagactaggattgcaaccccagcctttttttgttttccatttgcttggtagatcttcctccatccttttattttgagcctatgtgtgtctctgcacgtgagatgagtttcctgaatacagcacactgatgggtcttgactctttatccaatttgccagtctgtgtcttttaattggagcatttagtccgtttacatttaaagttaatattgttatgtgtgaatctgatcctgtcattatgatgttagctggttattttgctcattagttgatgcagtttcttcctagcctcgatggtctttacaatttggcatgattttgcagtggctggtatgggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgctgagagatccgctgttagtctgatgggcttctctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccccgtcaatttcattcagatacaccaatcagacgtagatttggtcttctcacatagtcccatatttcttggaggctttgttcatttctttttattcttttttctctaaacttcccttctcacttcatttcattcatttgatcttccatcactgataccctttcttccagttgatcgcatcggctcctgagccttctgcattcttcccatagttctcgagccttggctttcagctccatcagctcctttaagcacttctctgtgttgtttattctagttatacattcgtctaaattttttccaaagttttcagcttctttgcctttggtttgaatttcctcctgtagctcggagtagtttgatcgcctgaagccttcttctctcaactcgtcaaagtcattctctgtccagctttgttccgttgctggtgaggagatgtgttcctttggaagaggagaggctctctgctttttagagtttccagtttttctgctctgttttttccccatctttgtggttttatctacttttggtctttgatgatggtgatgtacaggtgggtttttggtgcagatgtcctttctgtttgttagttttcctcctaagagacaggaccctcagctgcaggtctgttggagtttgctagaggtccactccagacactgtttgcctgagtaccagcagcagtggctgcagaagagcggattttcatgaaccgcgaatgctgctgtgtgatcgttcctctggaagttttgtctcagaggagtacccagccgtgtgaggtgtcagtctacccctactggggggtgcctcccagttaggctgctcaggggtcaggggtcagggacccacctgaggaggcagtctgcctgttctcagatctccagctgcatgctgggagaaccactgctctcttcaaagctgtcagacagggacatttaagtctacagaggttactgctgtctttttgtttgtctgtgccctgcccccagatgtggagcctacagaggcaggcaggcctccttgagctgtggtgggctccacccagttcgagcttcccagctgctttgtttacctaagcaagcctgggcaatggcaggctcccctcccccagcctcgctgccgccttgcagtttgatctcagactgctgtgctagcaatcagcgagactccgtgggcgtaggaccctcggagccaggtgtgggatataatctcctggtgcgccgttttttaagctcgtcagaaaagcgcagtattggggtgggagtgacccgattttccaggtgccgtctgtcacccctttctttgactaggaaagggaactgcctgaccccttgcacttcccaagtgaggcaatgcctcgccctgcttcggctcgcgcatggtgcgctgcacccactgtcttccgcccactgtctggcactccctagtgagatgaacccggtacctcagatggaaatgcagaaatcacccgtcttctgcgttgctcagcctgggagctgtagacgggagctgttcctattcggccatcttggctcccctcctgctgtttgttttaaattcataaagtgtgaaggacactcaagcaggttcatgggctgaggagaaggagccctgggtgttgtggtgttgaagttgcaagaaagaagaagggctgcagagctgcaccagccaggatgtcagaccagccacagggggactccatggggactgaattccttcaggtcatagcaagatttggggtggagagggagagtctgaacttcatccagtgaatatgaggaaatgaccaggaagtcaggagatgacagcaccaaagaaacgtgaaggaaaactcagcagacggcacctacctcagatgagggcatgcacaagactggacaccgtcattaataaattttataattttcttaaaggtcttctacatttgtgctaaagtttattccttggtttcttatatttattattacttttttataaatggtatttatttttttcattatatatttttgatgaaagaatagagatttatgacaacatttctcaatttaagatatttattaaattatttacattgttacctcaaacaagtgctagttcaccatgattcaaaacatgtatttcaggagtttcatgtactgagaatattttattgccatacatagaacaatttcttcttagatttgactttgaagatacgaaagtggctttctgactgatatttacattcctactttaagtatatatatactgtttatttttgcccacttcctaagtagtaattttgtctatagtttgttgcccattaatgaacttagtgaaattgaaatattgaactattacaaacatttaacaaagaataggatagaaaatattaaaaatatactgcaagggataagggttttggatttcatgtgattcaggtattatttcatgaaacttgtgtgtgtctctgtgtgtgtgtgtgtgtgtgtgtgcgtgtgtgtgtgtgtaatttgataagtaattttaaaagaatacatatactgtactttttgttatatttaaattcagtcttggtgacctgagaaatagactctgagtattacttctctgagttgtcaaagacagagtttcaacgagccaactagtttgaaggctatcatcaccaccacaacctttttaaaattacttaagaagaagattcacaaaatcaactcttggtcacatagtctggaaatagattcatatatctcttggccatttatttgtcaataaactaaactgtagggcaatcttttcaaagtgaattatagttaattctttaaaacattgattcaataaggattacaaagtataagataaccagaataatatgaactatttgtgtgcatgtttttgaatacctctcccaattatataataataagacttgcaccataacaaaaaagttttatgtcaactacatgattttcattattgcgtctttgtcttctgcatgtccaacactttaggttcagcactggactaaagattgccttcaatatggacatctaagacttaaattccaccctcatgaagcctacaatttaatgaaggtgtccatataaacacttaagaaatatttaacatgtaaaacaaaatagcatatatgttgtcttttaggaggcaagattcaaaaagggatggtttgcatttttgaggactagaattgtgagacagggcttaatggaaggaataaacctagttgcattgggctttgaataagaaatttggtttaggctggacacagtagctcacatctataatcccggcactttgggaggccaaggcaggaggatcacttgagaccaggagttcgagatcagcctgggaaacacagggagacctcatgtctataaataaataaatatatatatatataaataaaatttggtttagattggtacaatagagtagaagagcatcatatgtcagaaggaaatgataagaaaagcaacaaatgcctagaacatgtgtacagtgatagccaagagagttgtcactcaggaattaaaggtatgttaaggtatcagagataagattggctagagtacagcctgattattgagaacttcttgcttccagggtggtagctgtgataaaataattctcaattaatataatgtcccttgtttaatcaagaagtctccaggttcgacttacctgcagacataaattaaatcatgtttacatgaatagcctcattttactctgaatttcatcatcatgtcagagggtgtcttctcagattataatcatacatgtatacatgccataagcatttccagatacattgttatgtcatgccatcaacttatatttggaattcttatgtccaaggagcgcttgggtgaagatttcaaggaaagcatttcagtttaaaatgaggaaggtgatagctgctacagtctttattgagcttcctgtcaccaaaggcattttagcaattacttttcttgatgaagattttgagtcaagcacaaaataaagaaaaagttggactacataactcctacatccttcacattcatgaaagtatgtaagactctctaggctttcaaatgtcacaatgccttttattcacaaaatcatagcatactcttgaaatacactcatatgctccaaatatacatctatcttttctcttttatgtataattaaaccctgcaaaatatttcttcttgacaattaaaagcatatctcttagtgattaatataaactagagaaaaaacaagtgataaactacagatcaccaagtacatactgaataaaacttgtttaaaattacaagttttcaattagacttatatgagaggctttttggaagagagaaagttgtagtgacacaggaattttctttcggccactttgccagactcgcagcaggggcaccctgtctacccagcccacagtgctctgccccttgcggaagggagcacgtgagtgagccagggcgggatctggctggccattccaagcacaacacaggagcaagcttcatgtggggcctgcagccagaccaggaactagggtgccaatgaccctgaagccccagagggggtattagtatgctaattagttcttttagttccactatccatggacagctgcacgtcagcagctcagtcagtccctggccccatggcatggagcagctgcccttcactggcaagggcaaaaggccagtgggacagtctttctgggtacctgcgctcagtgtggcctgagctcttgtccagcatccaagaagaatgaggttatgctgacaattgaagcatgagcaaggcagggagttttattgagtgatgaaataactttctgcagagagcggacgtgggggtggtcccccaatggtgggaaagtcccccagtgtagctgagtcccggagcttttatgggttcagaataggggaggtgcaagccataggtagtatgggaaaagacaacattcaattggataaaaggcattattcagaaaaaaatcagtcggggaagggtgggcaaccaggaacagaagttatccctctgggtcatgggtttcatccaggaccagcagttgggtttttcagccttcaggctgttttttttggcttgaaggtgtggtttcaccagagacctgcccctatgtgctttggcatttggctgcctcctgttgctctcagtagcagcatcttattagaaaaggattcagtgaagtagaaggccaaaagaatgtgattatatattgattaaagctatgaggcaaaagattcctgacttccagagatacacagccaacccacatgtaataaacttagatggttgcctgccagatgtttttctcttaaaattcttaagcttaatactgttgctaataatacacagaaatgataaaattcacttaacttttggatatggcctgaatagtttgcaagagatccttattccttataacacatgtatttataataaatatattttcacttatgagtttatttttccaaagaccttatggtactattcacagaatttttagaagaatattcttttgtatcttagaatttaaaatgagatagtttccagacattgggatgagaaggcaggagacagaaaggaaaaaaaataaaacaatggggacataactggaaatgtcagtaggcataagttggggaaataattttctatcaactactgttctagttggaacgaacctctaagagaaaggtaactggagtagttatggtcaaaaatagctcaaaggccaaatccagcatgcctgtttttgtatgagtggtgacctatgaatagttttacattttttactgtttgaaaataatcaaaagaagagtaatagttcatgccacatcaatattatatgaaattcagatttcagtgttcataaaggtgttattggaaccttgccatacccatttgttaacatattttctgtagttagtttccaactacaagaggagagatgactatttacaacagaaactggcctacaaagcctaaaatgtttactatctggctctttacagaaaaagcttgccaatccctctgctagaggataagttagagaagttgacatcaacttcaatatataatgtgggttttttaaactgacctgatgtttgtccaaatgttgttaaaaatttggatcttgggctgcttgcccgacctactaaatcagaatctaggagcaaaggcctggacatttgtattttttgttaagtatccaaatgtgcattttcatcaggcaaatttgggaatcacttgtgctggctgtgaacacaggctttggaatcagacatttagggttggagtctgagctctactacttactagctgggggactttaggctcttttggacaatacaatatgattgacttcattagcctcaattcactcattggtataaaaacctaactcatcaggtttttgtgatcatttaataaggtaatatatttagattagatatagttaagattaacacagtgcctaacacattgcaaatgcttaataaatattaagtgtcattgttcttagtgtaaataatattagcagtagtttttaattagaagtagagattaaaggaggcatcatggtacagaaagagcactgtacttagaatcagaggacatgaatatgagttccaaccctgtcacttactaattatgtagcattgaaccacacagccttattgggattcatttgcttcatctgtaaaatggaaatgaaaataattatgtatctcaaagtcatttctaaaggtcaggatataacaaaaagcagtatttatcttaaccattctgttgccatgtctaatacagagcctgggacagtgtgattaatacatgtttattgtatccaagtgaatctaaccaactcatgcctgctgcagaggcatatttcctactttaatactcattgtttcttctaaatgccctttgctcaaatgcatacattttgtaaatttctttagctttttctgtctatgtttaagttaaaatttgttagcaatcaagagtttattttctcctcctgtagttaaaatcctgttggtaagatcagaaatgatggctgcagaaaaggcagggatgtcaccaatggaagattataatttgtgtgctgtatttaacaagtcgtaggaaatttacaaggagaaaataatataaaagtggttcaccttcgccccccaaaatctcacacacattcaaactgttttccaggcagaaatgtcaatgtagaggtagaagtgacatgtgcaggcttttaaagtgtgagaaacaaaatcagtttctttcacttgcattcagtttccaataactgccaattgtagcagtgtgctggcatcatcaaaggacttttttcagtaaatgtcttttctctactttgccctaatccctggcctccccaaccctccactccaaggctgttaattgagtggtgactactgaccgatgaaaaggaattactcatgacaacagttagttcgggaggtacttgctgttgtctttgtgtaccgaggtatctccagagtctaccacagtgcctggcagtgtgtcagtaagtgcttaataatgtttgatgaatgaatgttaaatgaacattctccatggaaacaccatattgtgtgtgcggttttgttttttttttaacttttgaactgaaatcaacaaaaacgtaagtggtgtagtacttctcagttgtttggccattatttatttcaaattctgtatcctctatattattcaaactatgcatagttagtaattactacaggctttcttggttgtgacaatcaatatcactgtgactttgtgttaaagaaattgccccttttatcttctgatatggatttccactgagcaaaatgaggcatttattaatccattttaggattggaatgaaggaaattgttttctctcctaattattaaagatttactaatgaattattgttacaaccagacctatttttctatcaagaagtctgtgcatttgattccagtggaatcataagtgcataaatgtagttatataaaaaagttagaggatcccaagtttccttaaaaaaccatgaaaatcaaagcagtctccaaatttttagaaaatgtttttgaaatgacaattatgtaataatccattgaaaataataggctcaattttctggattgttggtacataagtaggtgttttgtctaaatatgaaatgaaccagaagtagagacgaatgcatgcagtctttgcttttctgattttgcctaggaaccaagaattaaattaatgacttgcatttctagaccaacattgcaaggattatgctttactgaatttactaaaattaaaaaaagaaatacaagtgctttgaaagatgaatgtgtataataaaaaatttgtactttcctataagaaactctatattttacacacagtggttgttagattcagtttgtttaccacacttgaaatgctttgtatttgcatgtgtttgagaaaaacacttagaaaacatatcacaccttagcttaatgaaattctctgaacatagacgcccactttctcagaacttgatttcaggaggagtcatatgtatgtatcttggcgatttgtaagtcataggaatttggtaaactcaataactgatcagagacttttatttttgtttatttaaatttgtaaccatagtattcactctgctaagcagaatagacttggtattgcttatggtttcttttttcccccatctggagacagaaaattctaaatttacaaagatggagagaatagtgtaatcacctcccaaccatgtacctacctatcactgagcttcagtaattatcaacattttgctatcttttattgtttctcctttctaccttaccatgtttctttttgctggagttttaaaaaacaaagttcagactgtcatttcaatagtcgatatttcttacatctatcacttttcaggttttgtgtgtgtgtgtgtgttttttaaaggacataattttgtagttggctttttaagattctttctttggcctatgggatgcaatctgttggggagtctttgaaaagcagtatccagatttgtaccaggagggccatcacaaattggtctctagcctgagctcactagtgggaagttgtgtctattggcaacactttccacgggaggaaaaccagcaaacctgccccattcaccaatatttgacagccctttaaggttaaggtactataggttaaggtgctcaggatcatggttttcttttcacggaaaaagacccattatttcataggttggtacaccatattgaagtaccaaaataaatcaaggatttttcatatgtactatacttttaatagtgtattaactttttaaggtatttaaaagatgaataattctaaaaatcaatttcttactacatgcatttgttaactattttgtaagcttcagcatattaagtagcactcaaatgaagatttcgtaggcaaaatgtcattcgatttcattattatgatgaatagttttttaatgttgtcaaatccttttagatttaaaaatgtctttatgtctggaaatcgttagtccaatacaatcttttctgcattattcatgttctcttaatgttaactagtttatacatggttaataaagtagagaatgacatagaatttgttggaatttatgtataatttcccccagaatgttaatgttttaaagtggttttttgtttgtttgttttcttttgtttttagagttaaagcgaaagtcttagaacatgccttccttttgtgcaggaagagctaatttagtggcttcaatagcgaccattcttctcttttcacatgccaagctttctggggaagctgcaagtacagatgaagattaaaaggcatttgttttgtgtttaaggggaaaaagattgatgaagaaagctacctttgaatcatatttttaattttgatgaaactgatctctaattagaaacatgtttctttaaggaaccacatcttgaaggatatgatttctgtgatgtaggatatcacaaatgaactacagtggcttcctgttgcaaatgtcagtaaaaatttaattgtgctagtatttttattaggattattattttgttggtatttttgttgtatcattttgtggtttcaagtgatatactttccccataagctctgttattcttagtatgcaattttattggacacaagtttccacaggaatacatatctggtgttacaacaataatatctgtattaattatatattaataaagtatacattattaataacatatattcattttgtgtatattatcaattatttttgaatagtaacaataaaacaatttgaaataagaagcaaagtgagaatctgcccaattgatacttaaacttaaaagaacttaggatactttccaagattccaccattaatcttttggatatttagtctaaatttgaagagaatgaactgaggatattttcattatactctatggctttaagtatttgaaatcaaagtaattcagatttacaactttattgagttaccagttgttttatttgaaactacgacaaccaatacataaatgaatgaactatttcatattctgatataaaactcctctctctcttttttacatccacaaataaattttaagtttccccactcatattcactctgtaccatgtagttatttctctctctattttttccttactcccatgtaaatcatcaaattctttatgtacttaccatattcactggtactgtccagatctatatgttactagccctgaaatgtgagaactcagaatttcagggagtcttgaaagtaaattgtgggacaaattttctttctttccttccttccttccttcctctttctctctctctttctttcctctttctctttctttctctctctctcttttccttttttccttcctccctcctttcttccctccctccccatctcctctctctctttctctccttctgtcttttctttctctctctctttctttctttcctgctttctttctttctctttcttctttcctctttctttctctctttcttttacttccttccttcctccctcctttcctccctccctacctccctctcctctctctctttctctacttctctcttttctttcatacatagcttttcctttctttccttttcttttcttttttttttcttttctcttctttctttctcagggtctaactctatcagactggagtacagtggcacaatcatagctcattacaacctaagactcctgggctcaagtgatcctcctgccaccgcatctacagtagctgggactacaggctcatgccaccatgcacggctaattttttaaattttctgtagagacaggttctctctatgctgcccagacttgtcttgaactcctgggctcaagcaatcttcccatactggcttccccaattgctgagattataggcataagccattgtgcccaactgtgaaaaatattttaaaactataaattactattgggtcatgcaggtctgaatcttttcactttgagtaagtatattgttttcttttccagaataagagagagaatctcagtataccttataatttacaaaatatgtgttcaattctcctctgcttagggctatatggagctagtaaaaaacatttcttttcatccaatgaaatcacagtttgtaacttcacctgtaatagtgtaggacatatagttgttgttacacatttatatttccattagtctgtaagctatctgaagtccgaaacaaaggcttatttatcttgacactttaaagacagtgccagtgagttagatgctcggttgaatgatgctttttgaatgaataataatgtaaagggcaaaattctcaaagtagagtatcattgataatttttaccttagattttttttaatataacaagcactctttaatttgaataaaatagaagtattttttcaactttgtttatctgcaaaaatagctttgactagagcagatgttccctggaatgaaaatgtacacttattgtgatacaagagaaattgtttaaccaaatctatcatccacaagaattgctatacttcctaccttatttaatttctcccatcactcaggcctcctgggccattatcagggtagttcttatgaaaaaacaagtcaagaaaaaagaccttagaacttttagagaatttgtgattgtagaagcaaggaaaggaacaaaaaaagaaaatccaggatagatgaacgaagttgatatgttagtgtgtgtagatgtgttttggaactaggggcaggggttatgaagattcagagggatacagatacaaactggaccagagttttttttaggataacttggtcctttgtggcctatgatgatcttcaagtatttcaaggaataggtcgtccattgttgttccttttttttttttttttcagttggacgtctacagagtatttttttttttttgtcaatgaatatgtgtacacatgagtgttggaagggaagaagcctatgtcaggggaacataaattactaaggcaattatatatatttttaaataaagtatatttcctggcatttcaagtccagtaaaatggtctgacatagaatcaggctacaactgtttctgattgctgctacagtgcatggccagaactattttgtttaacagcatcaaatattagtagttccactttaatcaggacataaagtcaaacaatgttagaggtagaaggcattacctgggccttctagtccaagcccaatattttacagatgactatgttaaaacctaaatggtgagtgatgtggattacctgtgccaaatactgtagtcagtgctttatggccattttctcactttgtcctcacagcagtcttgtggcatctattgttagatgagtacgtggggcttaaaaattacactaccttgctcaaaatcttaaggttacttagtggtagagctggaattcaaaaccagacagactgatttttagacataatttatttcaggtgtaattcagtaattaaagatgaatgacaggctcttctctcatagactagacactcaacatgttgtgatagtgttatgtgagaaatgtgtacaaatatgcaatcacagagtaattaatcatcattttacgataattggagaagattttgtagaggagaaaatagttgagctgtgccttgaaagatatctaggaatttgctaggcagtcaaggatattacagtttgtgaaacctatcaaagagtgtcatgtggatagttctaataatattgagtactgctgcgcaactgaaggtggaaatgtagagtacgttgaggtagcatacaagagacaagactggaagggtaagcattgcttagagtcttgtatctcagttccagctttgatgcctcctaggttggtcacaatttttctccttctccccaggtactcactgctccagttgggtttattcagtctgttgagtgagatctaggcagtgagtgtttgaattagggcaggagtcatagggtttaaaaattagaaatagaatagggagagagtttggaggtaaaatttgttgggctcagtgactgatgaaatgtcagaggtgaaggagattgaagtatagcagatgatgccaagatttctaactgcagagagccaagtgggtggtgatgctgttacttaggatggaaaaagttggaagataattgaatcttgtgttctctaaattcatttcatatttccctgagttttaatgtaagggaaatatctttctactttgtttcacattaagtataaacagagctatcacagattgaagatatcaaaattatgcatattcatgtatgtacatgattagaaatatgtgtgattttatatattctcctagtagaatctaggatccattacagtgttctatagctgcagaaacttctagacatcatctaatcaagaagtcaaaaatttgttcccaaagacctttttactttggtttcctttttttttttttaagccaaaccaaccagaaaacaaacaaaaacattgaaaaggaaattattttggatgggtaccatttagcatccttatcctcttactttagaacctctgaactcatttaaatgagctacctgctctaacaggcacttgagttttctacccttgagctaattcaaccttctcattgactagatgtgaaactgggttagtttaacagactttggaaacaaggtatgaaggagggaaaaaacaggagcagtagttatacaacaaaatagttgcataacttatataaactataataattataagactataaaaatatttatgggagtaagatacttttaaacaagatgggatattttttcctgccccctccccaccacaccccccaccaaaaataaccgttttctattttttctgttcatgtagtgtcacattgattctatatcgttacccacagtgccacctattggtaaaataaagacgacgtaaccagtttttctgtaacccatatttggtaccagagtcttaagaaatctgccctggattttcgcaggcagatgttagaaagcagattgtctgtgatccaactgaaatgggagatgaatcacgtgttttatgcagagatgctcaagcttgtcatttagaagaactccaaataggatctcaaaagcatgatatccgacttccccagttcgtggttctgccaacaaagagcctgtgaaactgcttagggattctaagaatttagattgttcccacatattgggatgcaaattgttttatatgccatgctactcaggcgtgattgttgctttttagcgacagcaagttgaagtattgagctcatttgatatgtgttctgccagtcttcatgttatcacacaggctattaagtgccaaaaaaggcattagtttcactgaatatatttaatttttaaaagttagttttataaggttagtgaatgtaattttctctttcttcattataagcttttctagagaaggatattatttctacagaactaacataataccaaatacagttgtcttgatattgtggggggaggattggtttcaggatccccttaaatactaaaatccatgcatgctcaagtcccacagtgggttctgctgaaccacagatatgaaaagttgaccctcgtgtccacgggttttgcatcccaggaatactgtttttgatctgcgtttggttgagaatgaggaacctgcagatgtggagggcccactgtatttattgaaaaaaaagaatctgcatttaagcagacctgcacaattcaaacccatgttgctcgagtcaactgtgcaaagtaaggtgtggtatatatggttgcaggagtaattaatacatttaacagatatcagcaattggtgctcaagtgcacatgcaataacacacacccagaaaggtacacagtagagatggatgtggtaaagtacaaacattgatgacttccctcttctatgctctttgaataaaatgctagattcatggtgattgttatttgtttgaaatcaaaagatttagtcatatcctccctcccacaagctgttattgtccaaatttttacgtgtattaccagaatgtatttctggttagctttgctcacttttgagtttttatttgttgtgtattcgatacttgaggtagtttttggaggcaagctgtactgacattgttgcagctactcttccagttatttagagaccaggtagtgatcccaagtaagccaccagaagactgatctgtgatatccacgtcaggaaagacaaaattgttccccagttaaataaaaaattaagtaaataaaaatggaaaaactagcaccatcggacatcatgcccttttaaagaaattggggtttaaaagcaagttgtatttagattgaagggctatggggacaaaaatccaaaatctatccaccaaggagaggcaagttaaaggcttgaaagcaaagagtacaccacaggctggaagactcttggttgggagagaagggtcaggaaggagctcgggaagaatgattcttaaaaactagcaccaaggatgggtaggagcactagccctggagctggacatctagggttcaaattctgggagctttgtcagatactgaggcattcagaatggtgggtgggaacactagtcttgcagctgtacagccttgattcaaatcctgcttccccctattatagctgtgagatctcggtttccttacccaaagatgggtagactcaatttagtatgactgttctgtgaattccatgaaataataaatacaaataggatgatcataggtcttgaatggctaatttagctccagatttctttttcttttcttttcttttctttttaaagtgagatattatataagccacgatggatttggtaaacctccctttgatttgcagctgtggtcatggtctcttcctgtgttcattgagactaaatttggagttcaccagggataatcctgcttttttttcctgactctttccagatataatttaactaatgtaatgtctacctttcaaggacagcatattaggctttgactgtaaaacaaagtgcacaggggaatgtggtctaggcacatgtagctcctgatgtggagtggctgtaggagaaatattcagcactaatgtccctaccaatatatttgttggcagccacttgagcctagctctatgtttatattaatatcttcaaaatgtttgaggctacaaggaatttaatcggtgagatgagtgggggaaatgtgaattattatggagtaggtttatcttaactattttgtgtggaaaacagaagctgagaaatctttctagtttgagtttatcaagaaaggctggatgctctcagtgtagttttgtcatttatcatagtagaaatgtacacctgcttatttattttatgttttggcacaaactttttttttgcaatgaattctttctgtagcaaaaaggtaaaaaaaattaactggcggatttctaaaaatttgataatgaatgtgtaacttgcatacagcattcattagtatttactatttactgtggatgtattgaaatcactagctacatggcaacgaggagacccaaatctgctgaagattcaaaaataggcagttgaattctccacttcaaaagttgatagttattttaagaagactgttcattaagatgatgatttagcacgtgctaaagaagcacatgctaaagctacaaaagatgtgtttttatattactgtgaagcagttttcatttagatctagtgtcttattttaaattaatttcattcatttttatttttatttatttattattattttttaagagagagtcttgctctgtcacccaggctagagtgcagtggcaagatcctgggtcactgcaacttttacctcctgggttcaagtgattcttcctgcctcagccacccgagtagctgggaccaccatgcccggctaatttttgtatttttagtagagatggggtttcaccatgttggccaggctggtctcgaactcctagcctcaagagatccacccactccagcctccccacatgctgggattacaggcgtgaggcactgcgccagcctcacttatttttaagtttccttgtgcacataagaaaaattaggtaaaatcttcaaaacactgtcccttctggcaaaagataaactttgcaaacattcaaatgattctgattttatgtcagtatcactagatgctgtattagtttcctattgctgctgtaacaaattactacataacaacataaatgtattattttatagtcctggagatcaaaagtctgaaacgaatctaacagattaaaatcaaagtgtcagcaggtctgtatttttcttaaagttccatggaaaaaatctgtttttttgccttttcactgtttctggaggcaccctgcactcattggcttgtgaccctatcaaagaccatcactttaacctgagcttccgttgtcgtgtatccttttgctgacattgaccctcttgcttccctcttgtaatgatcctggtgtttgggttcactggataattcaggataatccctccacctcaagattcttaatcacatcttcaaaatccctttgccaagtaaagtaacgtgcataggttctgaggattaggatgtaaacatctttaaaggctcaatattctgcctaacacagatgcttcaaatacatctttatgttcattccaataacagtttaatgacagcattgaattaaataaagcttgcccttattgtgaatgttaatgtaaattcagtttgaaagttcagcgttgatggtaaagttatttgttttcaaagtgattacaaatttggcagagccatgtcatcgtgacaacaatgttcttacaaaattaagagatttatggagcagaaatgtatttgaaacaggttgtggtgtaaaaataattcatgtgcccataactgagtcccaagaaactagaatatactaacaataaaaatagatgatccagttatcaaattttataggtacacacacgcataaacacacagagaaaaactgaactgaaaaacctttatgatagaactgacattaaatttaaaaaagtaaaacaaccctccagtatcacagtcttccttttgttgcccagcttcaactgcatccaaaaatatctgaggcactggaggactcacttgtaaataaacctgagtgtcctacaatggcattcaattcctttgtacatgagtcatttggttgcagttttatttaaaatcagttggaaacgtttaatcaaagtattcaaaaattggaaacccaaaaaactgaagcttttagaaaattgtaattattgaaagcaaagcatgaatataggcattgaaatttgttcttataaaagcatggaataaacagaataaattaaaatttgaaagctcaaaaattttttaaatttatattttaagttcaggggtacgtatgcaggtttgttccgtaggtaaacttgtctctttgtttttgtacagattatttcatcaatgaggtattaagcctagttaccattagttatttttcctgattctttctctcttcccactctccaccctctgatatgccccagttgtgtgtagttcctcactatgtgtccatgtgttctcatgatttagctttcatttataagtgaaaacatgcagtattggttttctgttcctgcattagtttgctaaggataatggcctccagctccatccatggccctgcaaaggacatgatctcattctttcttatggaaagctcaaattgtatgtaagatttaattttgaaaacctgtgattgcactttgaactatcttgttttctgggaagaatcatttgatgatgttcctgttttaaatttgatacatttatattctgtttcagaatataacaacattaagaaggaagttctatgattttcaaaagaatcatatagcaaaacaaggtatttgatgagatttgtctttcagaaatagttgctgacaaagcatagtttgaagggaggcaccaggcagtaacagtaaaaatatctggatgaaagtatttacaaattccaatatgaaaaaaattacaattgagaatatcctccacttagcagtctgttcttatctattcagatatttttgtaactgtagaaagaatattttgtcaaaaatggtgtgatctagagagaagagttagttgcgaatgtcaacaatttcaaaattagaaaccttaaaatgtaattttgaagattgcagtcagttctgtgaagaaacaagatatgtaaaaatacattctttagaaagtacctctaatatgcattagaaagagatataaacatagattcaattatatagttatgcaccaagaataattattctaattatgtgatttttagtactcaaataatcaatgtaaatgtttttaattttaattttgcattaatatatgtgaatgtattttatattttaatgacagaaacataaatcgtttctgaatggaaccatttcataggtgtttcatatttcataagctgattagcaaatacatattcatgattttatatgattgataatttcagcaaccctttccatctgcaaacagtacctggctcattgtaatctcttattattaccataagcagcttagtgaggaaccttctgagacacctaacctttaataattcctttctctgtggcctgtggaacactttcttacatatgaattcaacatttttttgtgtcattttctgctttaatctgtttcatacatgctttttctttttccatgtcataaatggcatgtcctattaacactttttctttccgtatttccttactttaactggcattttacgtcaatgccatttctttcaaagtattatgcagcagacaccaaactttctcccaattcctttaacttctcctggaggaagggctgactttgcttatgctatggctgtgtttgtgcactgtgtgtacagccccatgattcacagatgagggagcaagcacaggctgaaattctatagggctctcttcacctatttgtgcaaaagagtcacctatgccagcagcgccctggtgtgccactttcactctcctttagaagcctctgctctttgtccaggccagcctttcctcatccttgtcaatgctcagcatcactggtcatcagagaaatgcaaatcaaaaccacaatgacataccatctcataccagttagaatggcaatcattaaaaagtcaggaaacaacaggtgctggagaggatgtggagaaaaaggaacacatttacactgttggtgggacggtaaactagttcaaccattgtggaagtcagtgtggcgattcctcagggatctagaactagaaataccatttgacccagccatccaattactgggtatatacccaaaggattataaatgttgctgctataaagacacatgcacacgtatgtttattgcagcactattcacaatagcaaagacttggaaccaacccaaatgtccaataatgatagactggattaagaaaatgtggcacgtatataccaatggaatactatgcagccataaaaaaggatgagttcatgtcctttgtagggacatggatgaagctggaaaccatcattctcagcaaactattgcaaggacaaaaaaccaaacaccacatgttctcactcataggtgggaattgaacaatgagaacacatggacacaggaaggggaacatcacacactgaggcctgttgtggggtgggggatgggggagggatagcattaggagatatacctaatgtatacgacgtgttaatgggtgcagcacaccaacatggcacatgtatacatatgtaactaacctgcatgttgtgcacatgtaccctaaaacctaaagtataaaaaaaaaaaagattgttttctaaactccagagccatttctccgtatcttcaatggcctcagcccattggccttgacattattctttatgacttcagtattgttgacttcacagcctttttacttcttcaactccaaaatagcactgtcgtttcctagttggaatcccgccgttcctcagaaagtttccttccctagcgtcatgggtttttacatggcttttgtgaccacaatcatcttcaccactcctcccctctttcttgcagaatgtgccttccatatgcctcacctcaggacctcaatgttttggtgcttcttcattttctcagttcatcacctgctttaggctttatttaccttcctttgtcatcagaatcccaccagccattctcagtgattctgttcactaactgcttagaaatctttctctgttggagaaagcgttacagaagccttagagcttaagacagtgtttagccgtttccttcttactaatacttgaatttgaaagtcttgactatcttctttattgccttctagagttttgttactcaaaatggaagccatggatcagcctctgggaacttgttagagatgcagatcttgccttatgccagacccatgagttggaatctgccttttaacattattcacgctgaagatggacaggcactgctctagagtaccaggagaccaaggccaactgtaaagattattctttactacttctttggcaagccagataaactctaggagtgggtgaatggttggctccaggctatgtaggcacagcaaggagcagaagaaagagcaggactgtggggatgccatgcatgggaggaatgggggagaagaagaggcatagacacaaagactgtgaaaatgatcatttcagagaccctaaattactcatacatacattcaattcctgtgtgtgctgagtggcgatggtgatgatggtattaataataatagtaataattagaccaggcatggtggttcatgcctgtaatcccagcactttgggaggctgaggcaggcagatcacgaggtcaagagttcgagaccagcctgaccaatatggtgaaactctgtgtctactgaaaatacaaaaaaattagctgggtgtggtggcaggtgcttataatcccagctactcaggaggctgaggcaggataatcgcttaaatccaggaggcggaggttgcagtgagccaagatcatgccactgcactccagcctgagcgacagagcaaaactccatcaaaaaaaaaaaaaaaaagaaaaaagaaaaaaatagtaataattaaaaattgttcatcccaaattatgaaaacagaatctgcacttcaatgagaacactagataactcatacatataataaaatttgagaggtattttctaaagtagtggtttttaaagaactgttgtgtgaaatcactttaatgattctaaaacagcagcaatgacaataaaatggattaaaatagaatacatagaaaatatcagggtatgattaaaaaacatggtaaatgttaacattggtttgggaatttttcagtaatatttgtgtgtgctcaattatgatataaagtaaatttcttacttgggtaaaaatggttggtaaatctcatctagacaatttttcagtagcaaatgcaaaaccaggctgaagaagtctactcaatttctggcatctcttgtcaatcctgccttcatttctccctagaaatcttaatcatcatcatgcctcataactttgtgagaaagaaaaggtggaactgtgattcattcaagtgagattcacacaaaacccatcagagtacagataaaagtactacccattggtctaaagtagaatttctaagtcttttctgagaattattcctcagagaataaggatatataactcaagccttttccctgtaattttggagtttctttgaaaccactttattttcctttaaaatttatgcaaagtcatatgaaagaacttttacaaatcaataagaaaaagacaatcctatagaaaaatagcaaaaagtctcaaagtgttatattgtataagaaaatatgcaaatagtcaaataacatataaaaaggagctcaaaaccattagttttcagagaaatgagaaaggcaaatcaaaactacaatgcaatacaattgtattcccactagaatggctaaaatataaatattcacaacaaccagtttatgactaggattaaacagcaggatctcttatactctgccgataggatacaaattagcaccatttcttttttcttaaaaaagtcctctttatttggaattgattttaaacttacagaaaagttgaaaaattgaaaatagttaaaacagtataaagaatacctgtatacttaccaagataatcaattgctaaattttactctgtttgctttatttgcccattctcttcatacacacacacacacacacacacacacacacacacacacacacacacacacccatatttatttatatatttttctttaattccctgaaccattatgttatatatatcatggcccttgacctcaaaatactacaatgtgtcttccctaaaagtaagactgttttcttacatcaacatagtgcagttatcagcttcagtaaactttaacattgatataatgcttttcaattttgaacttacctttaatacgtttaacttttaattttgttaattcaactaataatgtccatcacaacactttttcttttagatcatgatccagtataggatcaagtattacatttagttgtcatgtctctttaacctctttaatctagaacatttctacaacctttttttttgtcttttatgacattatataaagaatagagcccctatttttataaaataggttgatgcaatcacttttaaaaccttgttttataagaaatttcgaacagataaaaagaaaataaattgtattatgaactctcacgtatgactcactcagcttcaacaatcatcaacttttatttttttatttatttagtttttgctatccttgtttcatttgtacttatgctcactggtgtagctagttttgaaaactttgaagctgaccatattgtatacatgattaatcatctgatatatatatcagatatatcatctgatatatatatatcagatatatcagattatatatatatatcagatatatcagattatatatatatatcagatatatcagattatatatatatatcagatgatgtgtatatatatatatgtgatatatatatatatatatctccatccccaacagaagtacatgtgtaagtacctaagaaaatatggactagagtattcatagcagttttgatcataaatgccaaaagctagaaataatgtaaatactcttgactactagaatggctagacaacttgtgatctattatggagtaccacacagcaatggaaaggaataagctaatgctacatgcaaaacattgatgaatctcacaaatatgattctaaacaaaagaagaacagagtatttggctgaaaacaagcaacgtgaatgaatccatagcattagatgtcagaatagtttttacttttggagggggtgtagtgatggacaaaatcataataaaggtttccaggatttggcaatactctatttcttaacgtgggttgtgcttgtgtccattttagaaaaatttatagagctatccaataattttccacttctctatgtccatttaattttaatttaatgcaaattatttttaaagatttatatgaagtttattttctacttcttaatatatctgtactcattttaatataaagatatttcaaagtattcaaaatcattaaaaaacattttacttatctttttgttaccaaatctacaaatttagaaaatcgatttgaagtaataaagctttgaattcaggcagtttctctttttttatcttattgtcaaaatattttgagcactccaatataaaagaataaatgttaagagttttattcactgtctttacagctatatgagtaattacttcagtctactgttgataaaaatgttgatatatctatcttttgttaatggatcaagttgctcttgttatacagtgaactgaatggctctttacctcttacacaatctcacaggaacacttcatcctaatgtacacttcattttattatagcaccttgtcatgtgcagtaaaaatattcattttgtcatagagttgctgattgagtgttcagccttgaaaaaatatttgctattaaaatgaactgtgcaagtcagtcttaaaaattaagtactatttcacacatgcaataacacagtttgtaggcatccaggaatccactatctagatataacgcattttaccattttgccaatttgctgcagatctttgttaaattaaattaaatgaagttatatctacagattctttcaaagctttctgtttcctgtcttattctccataaatgtcttctctcttcttccctccctccaagtacaattctcctgaagttagtgcatgtttttacaattatgttcttacccttttatgatatgtatgagcatgtgtaataatatgtttcatatgtttaacattttttacataaatggtcctatactttgtgtgtatatatatataatcttttgcatttactttttgcacatcttatatttgggatcagatagtttaaaagtattctgtttgataaatatgcaataattaacttaaccattcccatattatcagttgttaaccactgtgtgctattgcagcaatgctgttcttgagctgagtggttattgcactgcggtcatacctctggtcatatactgaaggtgagattgctatgctgaatcatgtcaaatccaccttatttctttactagctcttacctgatggctaagaagtgtaccaatttatacttataacacgtggtaaatggaagttctcatttccctacatgcacttggttctgttagacatttaaacttcagttgtgagtttctgtttattattaaacagtagattaattgaccttatctacattttcatctgcttttatatttttttcctgtgtgaagaaatgtagaatttaatatccccaaattctgacctgtcccttacttctagttacccaaggtaactgtagagtatcaaacagttaaagctatttctcatcttggtaataatctgtcttttaaaataagtatcagaattacttttttgtggtttttacagttctgatttgatatagggttttttttttaacaacattttgtatttttgccacttcattggaaatgtcagttctgcccacagcaattcctagggtatcactgaacacgaagcctcccaggagcacagactgaaagtcactgatctggtcagactgaagtaaatggaacagaggcacagaagttgcttctttctaagggttccctagtgggacccacatgaggcagcggcactttggagcaacaggatcagcccaagattcaaccctgccagtctctagtgacaagcttctgcctaggggaaggtgcaggctgatcctgtcacatggaatgtgtgaccaatgcttgccatggcttcattagcacctccaggagctgaaaaacactgttgctatgaaccaaggtgaaatgatctgcctcacattccagcaagctacactcaaccttgctgttactcagcagtctgttttatgaatctcacgctgcctccctgaggttccagatcatactcattttctactcaaaccatcctttactcttgtaaaagtagcaccatcctccttttcattcagactcaaatgcctgacacataggctgaatttattatgttccattgcatgtcttctaaactggaaaccattggaacaatgccacctcaacagtttctcttgaagaaactgctttctgacttattcatcctgtgatcattctgctttggtcctacttacatctttcacttggtatattagttgcaatgttcctccatagtgctcttggcattgctctcatggatgcagaaatagtggactcagctctaaacagttcatcttcaatgactttatttttcttatacatctgtttttattagatgagaaaatcttttctagaaattctttggtggacttttccttatatctcatagatcagaaacacatcacatagccaattgctccctaaacataaacgggcagggagttcagagtagcgacaattggttaagattaggggttggcaaaatgtaactcatggatcaaatacatcatgctgcctggttttgtatggcccaggagctaagaaggaattttacatttaagcggttaaaaagtcagaagaatatgttataacacatgaaaattatatgaaatttaaatttgagtttccacaaatgaagttattttggaatgcagttacattcattcatttccacattgtccatcattttcttcatcttacaatgacataaatgagcaattatgactgagaccccatggcctgcaaagactaaaatatttactatctggtcatttatggaaaaagtctactcaaccctggcttaggtcactttatttttgtcccttagggaaggatccacttttcttgagcatattgctacctgcaagattctggaacagcattagggttctgttagcagaaccctgtgtgaatgatgactactgggaggtacacagcagtgtcagccttatttggaatattgtagtaactgacttgtttctctactcctagtctgcttacactcctccccacccaaatcattttgtatgttgctgaagaaaggatcatcctggaatacccttcttaacatgttaggtttctgtttagccttgcatcacctgtcaaagtccaaacttgatccatcgtttagtgccttctgtgctctggatccaacttactcccatgtgtcatctgtactttagacacatcaagaatctgtattccctttatttctgcaaatattccctctctttcatatgtccatatgcttatgctagttcttttgtttacctaaagacccctaattactttaggagttactccaccttaatcctaaccatattttaatgttcaccttaacttctccagaaatttttctgacttccgcatttgcataatgcatatcattttctgaaccccaaaggaattggcttgtatctcttatgacactgtaacattctgcctttttaatagtctctctgatgtttttctaaaagataataaggcccttgaggttgtaaactgtcattttaaaaagtcagtacagtagcttatacctagtagaagatagtgacagagagtatattggaatttggtgcccaactacgtagaaaatgtcttcaaagctagacaaagattctcaatctggaatagtaggaaataagaaaatatactgacggtttttactggtatatctggtagggagtggttttggggaaaaggaagactgatgtatttataaatcaattgtttaatgacagttacatgctgagtgcattaaatgtgttacctcttcaattgcaagatatttataagtaaccataaaatacgggcttcataggtccattttatagttaaataggttcagagatactaagtaatttgcccagggacatacagatagcacaatttggaatagaacccaaatctgtctgagtctctcgtgtagaccaatctctttccatcactttaggacagaagcagccttcgcatggtccattatggatgactataaaggcaatcctttcctacctcacaagcaattaaagactcaagcgggggaaataggttatgacacaatcagaaagcagtaatcaaaactgttgtggaaaataaaaaaaaaatgagttgcattgtatcatgctggttgtaaacattccacacatacataccttatctagaatttgggattcataaaatgctgttcttatataagtttaaagcacttctgccatacatagctaggtgtgtgcaaatgtatgtatatttataagtatgttgttttgatgaaattatgcagaaggttaattcatgtgttttctacctgagtcaggttgatagtactgtatgctaaaagtataaaactcttagaaggaaacataagagtaaatctttgtgactttgggtcaggcagtggtttttagatatgacactaaaactaaaaatttatacaattgacttcatcaaaataaacacattttgttctcaaaatgattatatcagtacagtgaagaaaacctactgaatgggagaaaatatctgataagggacttgcattcaaaatatttgtcttactattcaataataaaaagataaataacccaattagaaacaggggaaagaatttgcataaacatttcagccaagacaaaatacaagtggccaataagcatatcaaaaggtcttaaacatcattagtcattagaaaagtgcaaatcaaaactgcagtaagataccagttcatactgactaggttggctataatcaaaagacagataataacaagtgttagggatgatgtggataaattgtgaccctcatatactgtgggaatgtaaaagggtgcagacacttttgaaaatagtttgagaattcctcaaaatattaaacatagatttaccatatgaccccataattccacttctaggtatatatccaagataaataaaaacacacaaaaacttctacatggatgtccattacagaattatgaataatagctcaaactgaaagccatgcaaatgtctatcatgattaacggaaaaacaaaatgtgatatatctacacaatggaatattactcaagcataaaaaggaatgaagtccttataaatgctacaaactggataaaccttaaaaacaatgtgctaagccaaagaaaccagtcacaaaggccacatactacatgattctatttatatgaattgccaagatgagtcaaatctatagaaacagtagtagattcattattgctggaggctggggtggtaggagttagtggaaatggggaatgactgctaattgtcacatgttttcttttaggttggataaaaaattcttaagttagattgtagtgatggttgtacaactctttgaatatactgaaaaacactgaactgtacagtttaaaaggctgaattttatggcttgtgaattatatctcaatgaagaaaacaactcagttatttgatagacaactcattaggaaaaacgagaattatatttttaattaagttatgacctgtgttagctacttatttatgacttataactgtattcaaagtagtaatcaaatataatcattttttccatatatattgaatgtttctgaaaatgaactttcataaatacaatgctttgtttttttacttttattttaagtttggggcacatgtacaggtttgttagataggtaaactttgtcatggggtattgtacagattattttatcacccacatattaagcctagtgaccattagttattgttcagaccctctacctccaaccacccacaactctccaataggcccaagtgtctgctcccctctatgtgtctatgcattctcatcatgtagctttcatttataagtgggaacaaacatgtggtatttgcttttctgtttctgcattagtttgctaagaataatggcctccagttccatccatgttcctgaaaaagatatgatcttattcgtttttatgtctgcagagtattccatggtgtatacgtaccaccttttcttttatccagtctaccattgatgggcattagattgattccatgtctttgctattgtgagtagtgctgcaatgaacatacgcatgcctgtctctttatagtagaatgattgatattctttgggtatctacccagtaatgggattgctgggtcaaatggtaattctgtttttaagtctttcaggaattgccacactgttttatacaatagttgaattaatttacattcccaccaacagtgtataagtattcctttttctctacaaccacaccagcacctgttattttttgactttttaataattgccattctaactggtgtgagatggtatattattgtggttttcatttgaatttctctagtgatcagtgatactgagcttttttttcatatgcttattggctgaatatgtgtcttcttttgaaaagtgtttgttcatgtcctttgtccatttttaatggggtcatttacttttatcttgtaaatttgtttcagttccttataaatgctggatatcagacatttatcagatgcaaagtttgcaaaaattttctcccattctgtcggttgtctgtttattctgttgatagtttcttttattttgcagaaactctttagtttaattagatcccatttgtcaatttttgattttgttgcaattgctttggcatctttgtcatgaaatctttgcctgttcctatgtctagaatggtattgcctatgtcgtcttccaggttttttatagttttgagttttacatttaagtctttaatctaccttgagtaggggtccagtttcaatcttctgctgtgactagctagttattccagcaccatttattccagcaccatttattgaatagggagtccttatcccattgcttgtttttgtcagctttgttgaagatgagatggttttaggtgtgtgaccttattactcgtctctctactccatttcactggtttatgtgtctatttttgtagacaactgggttactgtagccctgtagtatagtttgaagttggatagcatgatgcttccagctttgttctatttgcttaggattgccttggccattcgggctctttttttttttttttttagctccctatgaatttttaaacagttttatgtagttctgtgaagaatgtcattggtagtttgataggaatagcattgaatctgtaaattgctttgggcagtgtggccattttcatcctattgattcttcctatccataagcatggaatgtttttccttttgtttatgtcatctctgatttctctgtgaatgttttgtatttctccttgtagagatttttcacctcactagttagctgtattcctaggcgttttatttttttactgtcatttggggatgggactgcattcctgatttggctcccaggttgactgttgttcatgtacaaaaatgctagtgattttttgtatgttgattttgtttcctgagactttgctgaagttgttcattagatcaaggagatttgggctgagactatgggttttctaggtataggattatgtcatctgcaaacaaggatagcttgacttcctttctttctatttggatgtgctttatttctttctcttgcctgattgctctggccaggtcttctgatattatgttgaattggagtggtgagagacagcatctttgtcttgtgctggttttcaaagggaatgtttttagctttttcccattcagcataatgttgtctgcgggattgtcatagatggctcttattgttttgaggtatgttccttcagtgcctagtttattgagagttttgaacgtgaagagatatttaattttatccaaaggcttttcagcatctattgagatcatgtagtttttgtctcttgttctatttatatgatgaatcacagttattgatttgcatatgttgaaccaaccttgaatcttagggataaagcctacttgaatgtgatggatacgctttttgatgtgctgctggatttggtttgacagtattttgttgaggatttttgcttcaatattcatcatggatattggtctgttttttttttttttttttttttttctgttttgtctctgccaggttttggtatcaggatgacgctggcctcatagaatgagttagggaggggtccttcctttcaatttttggaaatagtttcagtaggaatggtatcaactctcaactcttctcctttgtatatctgatagagttcaactctgaatccatctggtcctgggctttttttttttttttttttttaaggttggtaggccatttattactgcttcaattttggagttcattattggtctgatcagggattcagttttttcctgactcagtcttgggaggatgtatatatccaaaaaattttcccatttcttctagattttctagtgcatgtgcacaaaagtgttcataatattctttgatattttgataatattcaggtcagggaaatatcctgtttgtcatttataattgtgtttatttggatcttctctcttttgttttttattagtctagctagcagtctatctaatttatattttaaaaactcctggattcattgatcctttgaaagggtttttgtgtcccagtctccatcaattcagtcctgattttgattatttcttgtcttctgctggctttggggttgctttgttcttgcttctctagttcttctagttgtgatgttaagttgttaatttgagatctttctaactttttcatgtgagcatttagtgctataattttcttcttaagactgccttacctgtgtcccagagattctggttggttgtatctttgttctcattagtttcaaagaacttcttgatttctaccttaatttaattatttacttaaaagtcattcagaagcaggttattcaatttccatgtaattgtatggttttgaagaattttcttagtcttgatccctaattttattgtgctgttgtctgaaagaatagttgttatgatttcagttcttttgcatttgctgaggagtgttttgtgtctgattatgtgattgattttacaatatgtgccctgtggtgatgagaagaatgtatagtctgttattttgggttggagagttctgtagaatttctatcaggtccatttgatccagtactgagttcagttcttcaatatctttgttaattttttgccttgatgatctgtctaatactgtcaatggggtgttaaagtctcccattgttattgtgttggagtctaagtctctttgaaagtatcttaagaacttgctttataaatctgggtgctcctctgttgggcatgtatatatttaggatagttaggtcttcttgttgaattgaaccctttaccattatgtaatgcccttctttgtctttttaaattattgttggtttaaagtctgttttgtctaaaattagtattgcaactctgatttttttctgtcttccatttgcttgctagatttttctccatccctttattttgagcctatgggtgttgttgtatgtaagatgggtctcttgaagacagcataccaatgggtcttgcttctttacccagcctgccatgttataccttttaattaggacatttagcctgtttacattcaaggttaatattgatatgtatggatttgattctgtcatcatgatgttaggcaattattatgcagaatcttttgtggggttgctttacagtgtcactggtctgtgtacctaagtgtgtgtgtgttttttagtggccagtaatggtcttttctcttcatatttagagcttcctttaggagctcttttaagcatgtctggtgataaattccctcagcattcacttgtctgaaaaggatcgtatttctctttcacatattaagcttaatttggccagatacgaagtgctgggttggaatttcttttctttaagaatgtcaaatggctaggcgtggtggctcatgcctataatcccagcactttgggaggccaaggtgggtggatcacctgagatcaggagttcaagaccagctggccaacatggtgaaagcccatctctactaagaatacaaaaaattagccaggcatagtggcatgtacctgtaatctcagctactcaggagactgaagcagtataattactggaacctgggaggcataggttggagttagccaagatcacgccactgtgcttcagcttgggtgacagaacaagactctgtctcaataaataaataaataaatagcaaaaaataaaaaaaagaatatttaatactggcccccaatctcttctggcttgtagggttctgctgagtggtcccctgttagtcttatgggcttccttttgtcgcttatctgacatttttctttagctgcctcaagagttttttctttcatttcaaccttggagaatctgatgactgtgtgtcttggggatgatcttctcgtgaagtattttagtgaggttatctgcatttccagaatttgaatgttggcctctctagctgggttggagaagttctcatggatgatatcctaaaacatgttttccaagttgcttacactctccctgtctccttcagggacaccagtgagttgtggatttggtctctttccatgatctcatatatcttagaggttttattcattcctttttatttttttctctatttttgtctgactgtcttatttcagagagccagtcttaaagctctgagattttttcctcagcttggtctattctgctattaatacttgtgattgcattataaaattcttgtagcatgttttcagctctatcaggttgattacattcttttctatactggctattttgtctgtcagctcctgtatcattttattgtgatttgtatcttccttggattgagtttcagtgtattcctgcatctcaatgatgttcattcctatccatattctgaattttatttctgtcatttcagccacctcatcctggttcacaacttttgccggaggggtagcgcagtcatttgaaggaaagaagacactcaggctttctgagttgtcagagttcttgagctggttctttcttatctttatgggctgatgtttcttcatgctttgaagtcgctgacgttttgatttattttcttttatcctatttgatgacctcgactgtttgatggtgctataaggtgggttcagccaactggctttatttctggagtattttaggggacaaacactcagctcccaactcctggattgtgttctgtaactctgggggacttttatcagccccaaactttgttctctgtctccttgagattaggaatccattgtgctgggggtgctgaggtgctcctggaccactgttcactatactccaatgggtagtgtcagcaaaagtgttttatagtgcagtggcagtgggatccatactcatttatacattccagcagcagcagcagcagcagcagtgtagtggggtgcacactcattggctgcagcagggtgctagcaggtgccagggtgcctgcctccatgcaggcagtcacctaagtggtggaggcagcatggctcaagggggagggcagggagtccctgctggcaactgtacccatggttgtgctggtgacggtgttaatatggggatggggcactggtggcctctttgtgtgctgcgggccctctttgtgtgctgtctttgtgccctctttgtgtgctgcgggcagggttggtaactcagggagggggttggtcggctgttctctgtgcctagtgtaactcccacaccagtgttggcaagggtggggcactggcaggcgtggggctggctggctctttcctgccaaggctttgactacaatggtggtccaataggggatcagggcatggggacagagtgaggtgctggtggggcaaggaaggttaccctccaggcccctaatccctacctgctacacacactgctggcaaagctatgtgggaggtggccatggggagggaaccggtgggctggtgtatggcatgggggcagtcccactgaagctctctaccagtcaggcatagtctgcctgtgaaagacctatgatgtgggcccccagggcacctgaggctgcactgtaagcaggtgtggccatgctggggccccaggagaggacagcagaccaaggggtgcttagactggaccagccccatctgatgggcaagaaccaccctgaagagtttaggtcccacagttcctctagggctaatgtctcctataggaacaagttgagcctgggggatgggcattcctggctgtgttcctctacagacactcccacaccaaacactctgggctctgcatcagctaatgtactgcacctaccacttctctaagcagctctccctgccagctgagtgtctgtggtggttaaggggtatcctgctgagattccagaagcccatggcgagaagagcttgcgcctttgccagttcaactcacccatttccccagagttgttgggggtcaggaacaagtccaggagcaaagtagccctgtgccgggttcccagctttctgcccccagccaagctactgtgtcaaatgcagttcttttaaaggaaaaataaatttgccaaaaattaggggcacctatttgaaatgcaattggccatatatgtagttctggagaaagatgaggaactcacagtcacttacgttaagaagtacacaattacagacacattaaccaccttgtgcggtgtgagaggatatatgtgatactaggcacagaagagaaatgcattgggaacctaaagaaagaaaacttctctgtgaggcatgttacaaagggtgatatgagaaattacttgggattagtatatggtagaaatattttgtaagaggaatgcattattgaagacattatgcaattcaaaattcgtgtaattcaaaactaattttaaagattggccagtgttattacttacaagctaaagtggcattggtaactgcaatactataaacaaagtttattattcatttccgatgattttgaaattatttaattattgacaaaatatttcttttgggagattcacatcgttttaaattttgagtataaagtgatattttaataatgtttcttattacactctgaagtatgcacaattgtaagtagctcaattgtgcttgtgttataggcaacaggatttcaccaacaggaacagggcaggtggaagattttttgtaatacctgtagatgcaacattgcaaagtgaacttcaaggaattattaatacataatattgtttatatactttaggtatctctgactggaatgtgctacaatgtaactctcagtggtaatgtgagagccatttttgtgtctataaaaaatgatttcagtcatgtagaatcaaagctgaatgctgcttgagttttttagttggggcctaatcgttctaaatgattaaaattccctcaaagctaatattagaagatttaacagaaaaagaaaatcctatcaagaggctggtacttggtaaggcaaggtcatgacagtaaagttaaattttgttcctgaatgatgttttgttccctctgggcagtacccttaatgcttcatgaagagttaagtgtctgaaaagaagaaaagttgcatattagattgcaagccacctaaattattttatttccttttgctaatattttataaataccataggacatatatttttaggcaatagttcattttgaattgttatattgaagaacttttccttcatagagcatggagcacatcttctatttttattccatgccttttgttaaacttgttcttttttggttcacactaaattagtcaaaactcttattagaaagcaataagaaattaggttagcccaggagcaaaagtgcttatggattattttgagaaaaataattcaagcttgtttcatgcgattgacagaggcaaaatatagtgaaacttttttcagctgcacaaaatttagggcatctcagagaaagcaaaatctttagtgttcatagtcttctgtatatgttattaatttaagtgtcaaaaaatgttattcatagctttatttaagtgaccatgattgttaaaatattttgcaatgctaaaaaaatgtaaactcatggaaagaacatgggaattgtatcacttgttcttttttaagattgcttctgtcagctcttggcacatcagctggggaaaataaagaaaaaaacatcatttcctcagttttgtttgtgagcttggaaaagttacagaagtttgcatctaattaatattttttatagccacttgttttctatttgtagtctgctgccatttaaaaaatggttgtatcatactttaaatttaaaatgtattggtaatataaaggctaccttaaggaagtatttgcttcattctctacagtctctgtggatgccaggtgtcttagtcagtttgggctgctataacaaatacagatgttcctccatttacaatggggttacatcctgttagacccgttgcaagtggaaatattgaagtcaaaaatgcatttaatacacgtagcctactaaacatcatagcttaggctagcctaccttaaacatgctcagaacgcttaacattagtttatagttaggcaaaagcatttggcaacacaatacactatagggtatttgtcatttaccggtgacagcatggctgactgggagctgtggctcactctcactgtccagaaccacaagagagtactgtgcttacatattactaacccaggaaagggtcaaaatttgaatttcaaagtacagtttctaatgaatgcatattgttttcaaccatcttaaaattgaaaaaaaattaacgcttgtaagtcaggaaccacctgtacaatgaagaaaagaaagtttctgaaactaggaattaacctcaccactttgtattttgtttcagtgactcctgtagttatttccttcaagaaatatctcttctaaacctctattgttcagaataattatattaacatagtcacatagaacacataagatagtcacttcaaaaaaaagatcttttccaagttcaagtgaaggaaaaagttaagcaaaaagcactatgatttttgatgagcactttctcagagatctgggcaaagtaggagaacattatgtgatgccagctaagaatatcagtttctatatggtttaaaccagagtaatgctgggatgttgacatcagctgccagagaaaaagtccatagtgggctgcaccctgtgaaatcacctgctccaacatgaactatggtctctagacttgtgttatttgattcttcagagcagactctaccttggtaacaggtgtttgggattagaagtgaaacctcagctgcagtgatgtctcacatgcatgcagcttagagctcgtatgagatactgggacttgcctgttggaggggaggaataggatgcctctcagagcagctggcattgtggacattcttcccatagaaggaacaggaaaaaatacgcttctatcttgagcatacacaacttgctaacaaaagaactcttcagggagatggggaagtctgtcaagatttttttttcagtattcttttattaggctgattactataaataagaaaagcttatcatgaaaatgattaacacttaggtctaatattttctttgagtatatatttttgattggtaactagttatgtattatatctacaactggaattaataattaaaaataaaaatgtgtcctatttgaaaattacagattctattagaagcatcatattaaaaaatcttaaagttgggtggttcaggttagtaaatatgtaagtggtttgcatgtaaatgatgtccagcaaaggaaaggaaaagtctctgggtacatatgttcaatgatgtatgtacttttgtgaagccactgcaagcttagcacttttaattaaaaaaaaattcgagggttatgtggttcaagacagagaaaaaaataaaactactgcagtcatctggcaaagaaggttcaagaaggaaaacaagcttatgttctatacgtggtagaagctttgttaaatgttgacatgtaaaatcttctactcattacttttttttttttttttctgaaacttacaattagaaaagactttagctatactctggtccaaatgtttcactttcaacagtcccagaaattctaagtcactaattgtgtgaattggaagtgacttcttagccactatgggcttcagtgtttcacactgtaaaaaaatgtattctataagtttatctccaaccgtaaaattcaaggctatttctttaattttagttcaatatttgtaactattcgctctaaagaaatttcattacctgtaataaatatctcccataatttcatgtcagtgtatgtgtgtctgtgtttatttgtgtacatttatctatgattgcaaagagttccctggtagatttagtaagggacaagtataggttcaagaaaacggccacaaggagcaatatttttaatgaaattataaagtttgaaagttgctgaatgctacaaaaataatataaaaacactaattatacctcacactcaaatttaactgttgttaactttatgccatatttgtttcaagactatatatacaatttagaaataaaatgttatagttcagtcctgcttcaaatctctcttttgccttatttgcttttctcctttttcacaggtaaccaccattctagccactattgtatgtgccctttacatctacatttttaaactttgcataatatcgttatggggaatatcattaaaacaatgcataatattgtttggtatgtactaaaaatatacataaattatatttcattggctatatttatttacgaatgaattttctactgattaatatatttttgagatttatccatgtggatatgtttaacttgatgcaacacattagaaaatttattgattcttccctagatggtcagtttatttcactaagataaataatgttatagtgaacctacttgtacttgtatatgattaagtgttgggttgctagaaattattaaagatttccaaatctccaatatgagagtatcaaaataagagtcctcaccaacagcagtaagtgtgtggaagtttcaatttttccacattatcaccaacatcttggtttaatacatttaaaaatgtttgctgggtttgaggtatcattgtttaaattttcacttctctaataataaaggtaaacatttttccataagtattggctattcaggtttcttcttctgtgaattatctatgcatatcctttatacctttttcttttaggtttttgtttggtagaggtatcttgttcttgttgattggtaaaatttttttcttttaggcactaatctttgccagttatgggtgtggcacatcttttcaccctctttatagcttgtctgtttcactttaaaataatatagtctttgctttctatagaagtttttaaaatgctagtttaaatgtagtttataggtttaatttaaatataaatcttttatgttgttgccttttttttctgtcttgtttaagaaatacttccctattcagacaccataaagctatttcatgttttcttctaaaaattagcttatcttttaaaacttttcatatatacctgaaattattctctgccctcttgatccacatacagctagagtagagatgagcacaaaagtgtgtaaggctgtgataacagtgttagtgaagatgcagaggtgagagaacgcatggaaagtgcaaggaaacaacaacaacaaaaatcacagttaagttgaatcatagggtatgttatcggatgggtggaagaggaaaagtaagtaggtgaagctagatgggtcttattatatgaggtcttaaatccattttaaagagtttggtctttatattgagattagtagggaacagttgcaaggtgttagtagacaatagcatcatcaaagatctattcattttaagaatgattacccgtaatgtggagaatgactggaagggacggatgaggcagggcaaaataggttgaaatcatgtaataattcaaggtcaagtcaatgacaactgagtccagtatagagacagtccctgtgctacacatctccagaggtgaatttagtaatgtaaccagattgcctgtaatgtcaatcataatagctttggctatcaagtctatagaagccaatgatgataaaaaaaaaaacttaaaaattatgaagagaatatttcctctaggacccatgaaggcactttaagaaatgcctcatagttcattgagcagcatagatgtcatgaacataggaacaatttagagaatctataaggtcagcagagaagaaaagaatctgccaaaaatcagactcatctttaaggagtaactttttttataaacatttcttttaagtttgatgtaatcccatgtatttatttgtgcatttgttgcctatgcttttgggccctatccaaaaatatcattgcccagaccaatatcatgggactttctctcttaagttttcttataatagttttaagatttcaggttttacatttaaatctttaatcccttttaagttgtttttgagttaatactttttttttagtatatggtgtgagaatagggtctaattttatgcttttgcatgtggatatccagttatttcaacactatttattgaagagactgccctttcctcactgtacattcttggcacctttgtcaaaaatcaatttgccctaaatgcataaatttatttctgggctttctgtaatattctgttatattaatcttatatctgtttttatgccagaaccatgcatttttgattactatggctttgcagtataatttaaggtcaggtactgtgttgcctgtaggtatgttctttttgcccaagattgctttggctattcaggaggttttgtggttttgtacaatgttaggattgttttttccatttctgtgaagaatgccattgatattgtgataaggattgtattgaatctgtagatagctttgaggagtatgcacattttagtaatatcagttcttccaatccatgatcgtagtatttctttactttttttgtattctcttcaaattcttttttattatgattatggtatttaatataaattttataatctttcaggtaatttgtattatttttataacttttattttaagttcaggattacatgtgcaagtttgttatgtaggtaaacttgtgtcatggagggttgttgtatagattattttgtcacccaggtattaagcctagttctcattagttattttttcctgatcctctccctcctcccaccctctaccctctgagaggctccagtgtctgttgttcctctctatgtgtccatgcgttctcatcattcagttcccacttataagtgagaacatatatttggttttctgtttctgtgttagtttgcaaggcatgatggtctccagctccacccatgttcctgcaaagatatgatctcattctttttatagctgcatagtattccatggtgtatatgtaccacgttttctttatccagtctatcattgatgggcatttaagttaattccatgtctttgctacttttcgatttctttcctcaatatttaacacttttcgttgtaaagatcttttacctccttggttaaattcatttctaagtgtcttttttatagccattgtaaatgggattgttcacctcatttcattttcagatacttttctattggtgtatagaaatgctactgattattcctgttgattttatatcctgcaactttactgagtttgtttattagctctaacagtgtttttagtggggtctttagggttttcaatatgtaagattgttctgtctgcaaactgggacaattttaattcctccattccaatttgatactctttatctttgtcttgcctaattgctataaaaatggtgaaagtagtcatccttgtcttttccagattttttttttaaatatactttaagttctagggtacatgtgcacaacgtactggtttgttacatatgtgtacatgcgccatgttggtgtgctgcacacattaactcatcatttacattaggtatatctcctaaagctatccctcccccactcccccagcccatgacaggccctggtgtgtgatgttccccttcctgggtccaacggttctcattgttcaattcccacctatgagtgagaacatgcagtgtttggttttttgtctttgcgatagtttgctgagaatgatggtttccagcttcatccatatccctacaaaggacatgaactcatcattttttatggctgcatagtattccatggtgtatatgtgccacattttcttaatccagtctatcattgatggacatttgggttggttccaagtctttgctattgtatagtgccacaataaacatacgtgtgcatgtgtctttatagcagcatgatttataatcctttgggtatatacccagtaatgggatggcctaaactattacactgaagaaactgtatgtgaggagtcaaaatactatttatgcaattattgtattggatggtatatattcttagttccaagcaccaagtcaaaggtaaaaatatgataaactctgtttataatttgagaattattataaccttataaatatactttaaattctatctgttttaatttagatatggaaactaacatgtccattaatattacagggtatttgataaatcatttggtattctttcctatatagcactggtttccaacctgagatcctcatggcaattatatgcccaattatatgtccactgaaattatatgcccaattttgtgaacagaagtgtgagtatagaaaatgtgcacacagagaaggattataaatttcatggtctcctcttcttcacctccaatctactgatctagactaagtatttcctgtttctttaacagttttcatttcctttttaaaaaaaaaatctttaatgtattgtaaaaatggaagagggagggattattttatttgctgtgttgaatgctttagaaaggcaccggtaagacctccgtaagaactataacatttttttttcctattcccacttcccttcatctgagctttatgtctctgggtaacttttagattacccccaactttgtccaccttctgccacttccccagccatgactgtcttcaacattactgccccaaaatcgtatcttttctctaaattgcaacagctctgaataatgcagttttgtcttctggcttacttagacatccaggcctaaaattatgtagcgtatgtgtgtctctgtgtgtatgtctgcatatgtgtgcatgcaaatatatgcatatgttatttcttctcaaatgcctcaactgaagttgaaaattgtattttacttgtgcaaaacccagataattattttcatatccagtgtcagtttgaatcagtagaagacagtagatatctagagtgatctgttagttttacattgattttgccagtttgattaaaaaatctgttgctagcttgatatttgcaaaactgagaccagcgtttgtgcttagtgctttcttcttactcacggaaggagagaatcaaattgaaggcattctttatagttgccatctgaatgagacataatatataattcataaactgttcttataattactgttatgagaaaaaatgttagtaactagtttgtaaaacttacctcctcattatatatctagcacacaaataagctttaaggcagtagatttccagcacaattttgtaatttttaaattttctcattatttcatttttaaattccctcattattccaaggtttttatttcctcttaagtggctctggctcagtagtataggctatgtatattgtgccttgataaaacttctcattaaaaaaaatatagtctgcctgcctctcttcacagaataacaaaagggacagaaattttaaacaagaaactttgacgtgaggaacaaatctagtgggagcattaataaaagcccccacttattgagcttattttatgtaatgcttattacaatcctatgagtaggattattaccatctgtgtgttatacattatgagattgagtctaagagagtttgaataatttgctttaatttatgtagctagcaattggcaatgccaggattctggctctcactgggtcatactgaggattcaagaaattgaaataggtaaagtagtgacagcagtagcaacagcagagctctttctgttcctcgatctacaaaccttttcactatagagtttcatgcagatgtagaaggttataagcatcctcatattgcttctcagtgttttgatttacatgacaattgtcaggttgacttcaagcttcccatttctcttgaatatattcttcctcattatctcaaaaccacctttataaacattaactctaaccccaacttcaggactctctcctgttcaaaagcctttcctagggctttctttactaggttaactttctgcttcaaaggagggtctccttccttccttcggtggcctgagctaaccatcccagtctaaagaaatggcatagggtttaataatgcactgaactatgttctgaaaccaggagaccacatacttcctttagcatttcttgtccctttgagagatacacaattctcagtctcttcctcagtggcaaactactgcttgctgtgttcaccctttcttcctaaagagaggtctaaggaactgaagctgcttttttctttcttctcatcttaggggtatatatttgtaaggcttggttacagagtataattaatttgcatcaacttttatgttagagagtgagaatttcagtctttctccttttgcttcagataacacctcagataaaactacattgatcaaggtctcctcgtggccctatattgctgacagaagatgccctcttgtaagttaagaaagagatgtccctgttatctcaaaaatgtaatatgtatccctgaaaacttccaaagtagataatattatccttacctttctgcctatctaagaacccctctgggcatttcctcacaggaaatagtgattttcttttgcttcatctctgcgataaggctagtcaattcccaatctctgctggtagctcaggtgtgagagcataaacttgtttgactgagaaagactgagatgtccttaaggagccttagtccttaggtccgtagtgcttttgatgcttgcaatattgttttctccctagaactatgtgctatttcacagcctccaggaggatagagtgtgctgttgtctcttcatatatttgaaacatgcctgctgagcttttttaatctaaagggaaggaagtactgttttatttgacatatggagcactgatatctgctccctgagattgaagaagtcactgcttctatcaccttgacaaagaaagataataaactgactacaacactgcaagctaaagggaaactttgatcactctacatttccacagttacttgtatcatctttttatgaatacttagtatacaccaggcactttggatacatcagctcattgaatcttcacagcaacactggaagatagttgctattaatcggcacttaatattcatacaaactagatccagagaggttaaataacttgcttatgatcacataaatagtaagagacagagctttaattcaaagccaattcttttggcaccaatttgatactctttttactttgcctagtattaacaacaaagcattttagcaactttgggaccaccgaaaccattctcaacaaaaagctatggttaataaattttgtgtgtggtaggtacttaatcagacgcctgttttaacagtgaatgagtcttaaacaggagcaggtaatgtacaatcatgcagttacattgaccttaactatcttaaaactgttagacaacttaaattaccttttctgaatgatctggataataaaggtgagaattattcattgtctaaaactttctcagtatacaaatattgacatataagataggccaaccaattttctgaattcgttaaatagcgttaaatgtttttaccattcatatggatacttaaattataataatgattatgttaaattgtgtgtgtgtgtgtgtatgcctgtcttttctcctctaccatattgtcacttatgtttgaacacattacctacataaaggaaagaaagtgcagtgatgtaaaaacagcacagactccaggatctggtggattaggtttgatagcatactctaccagtaaatgcctgtgggaaagttccataatattttagctcagttccttatctgaaaaatggaggtaaacatgtataccttgcagtgctgatatgaagcttaattgagacaatatatgttaagtgcatatagaaacatgacagaaaatattaaaatacaaaaagaaaacataggcggaagctccaggacattggtctgggtggtgattatttggatatgaccccaaaagcacaagcaacaaaagcaaaaatatatcagtgggattacattaaactaaaaagcttctgcacggcaaaggaaacaatcaatagggtacagagataactggccgggcacggtggcttacgcctgtaatctcagcactttgggaggctgaggcagatagatcacgaggtcaggagtttgagaccagcctggccaatccggtgaaacaccgtctctactaaaaaatacaaaaaattagccgggcacgtggtggcgcatgcctgtagtcccagctactcaggaggctttgacaggagaatcgcttgaacccgggcagtggaggttgcagtgagctgagatagcaccatggcactccagcctaggtgacagagtgagactccatctcaaaaaaaaaaaaaaaaaaaaaaaaaaaagataacctacagaatgggaaaaatatctgcaatccacatatcagatgagggattaatatccaaaatgtataaacaactcaactcaatagtaataaagcaaataacctgattaaagaatgggcaaaaggcctgaataaccatttctcaatagaagacctaaaattagccaaaaggtatatgaaatgaatgcttaactactaattactaataatcagagaaatgaaattcaaagcataatgaaacatcacctcccaactgctagactggctgttatcaaaaagatgatgataataagtattggcaaagatgcatagaaaagggaacccttggacactgtttgtgagaatgtaaattagtacatccattgtgaaaaaaagtatggaagttcctcaaaaaattagaaatggaacccccatataatataacaatcttagtactgagtatatatccaaaggaaacgaaatcagtatttcaaggagatatctgcactcccatgtacattgtggcataattcataatagccaagatatagaatcaacctgaatgttcatcaagggatgaatgaagaaagaaaatgtggcatatatacaaaattcagccataaaaaaggagaaattctgttatttgtgataaaatgaaggagcctgaaggttattaagtgaaataagcctggcacagaaaaaagtaccatatgacttcactcagatgtggaacctaaaagagttgatctcatgaaaatagagagcaagaatgttgattaccagaggctgggatgcttggggggtagagggcatgatggaaagatgttggtcaatggatccaaaattttagttagataagagaaataaagctgggcgcggtggctcacatctgtaatcccagcactttgggaggcagaggcaggcggatcacgaggtcaagagattgagcccatcctggccaacatggtgaaaccccgtctctactaaaaatacataaattagctgggcgtggtggtgggtgcccgtagtcccagctactcgggaggctgaggcacaagaatcatttgaacccgggaggcggaggttgcagtgagccgagatcgcaccactgcactccagcctggcaagagagtgagactctgtctcaaaaaaaaaaaaaaaaagaaagaaataagttaaagagatgtacttctataacatagtggctatagttaataacagattgtattctagaaaaatattgagagaaaatgttacattttcttaccacaaatgataacattgtgaaataatacatacattagttagctaggtttattcattctacaatgtattcatacttcaaaatataatgttgtacgcaataaatacatacatacaattttagtaaattctagtaatttgttggtgtatttttttgggtttttctatatacataatcatatcagcagtgaataatgacagtttttcttcctccttttcttttctctcctttccttcccttctgtcccctccccatctctctcttttcttttctccccttccatcccttgtagtttttattctctcttgtcttactctgctgaccataacttccaataaaacgttgaatagaggtggtgatagcaagcatcttttcctcttttctattctcagaaagaaagctttcaatgtttgaccataaaaacattattttttattctaggtttttggtggacactctatcatgtaaggaatgttctcttttattcctcatttgccaacagtgtatatttaaaatcatgaaaagatgtgaatttatccggactcttgatctacattttttaaaaatactatttttccctttaattggttaatataatgaatggcattcatggtttttgtttgtttgttttgctttgtttttttcataaactaagcatttgagtctacaaaattccctctcattggtgattatactgtccatgacattgacattgtgtcattttgggttcttgatttcgtgtgggagctccattcacccatccaaatggaagtttatggatactagtgttcaacaaatacccctaggctgaaacactctaaatgttcacttatatttacattgctatggtcactttttttggtcttggagtagtcattacttttttgacagatcatgatgcatttggaaagatgtttttaaatattttatctactgtatttagttgtttccaacagcctgttttttcagggtatctgttatatatgctgttgcaaacagatgtctaatatattatttatttttttcaaaagaacctgaagcatatataccaaactgtcacattgtgttaaatctgagtgaagcatacataggtgtttgtttgttacattaccctataatttttgtatattttaaaataaatcaattatttgcaatttttgaagatagtcctcttctgtttatcagggaaagcattcagcatcttttaaaattcttgactttcccttccctttagattattctcatttcccttcactgtcaaagtcattttcctgtggcacttccaggagggacttttcagtcttttcatctcgtgtttggtggtgggaaccccagagcaataagcaaaagcctaagggtgtatgtgctgcttttgtctataaagagtggtgactattaaatgttcacactaactttctaacattttttatttatctgtgaaagtcacctgtttcctcacctctgttttttggggtttaggggagcttttctctagaactttaaacagaaatgaatctaactataaccaaaagcagcagatgtgagcttatatgtgggagattaaaaagctaaagtcactgcctttctactctttcccaagctaaatctcagttatgaatacagcttactaccctttactcccttgtgtctgcttccaaatacaagttgagggcgttacattgtccgggacagaactacaatttgtgtcagcaggacatgcccggaagggatgccatctgttaagtgactcactattagagaacagacccatatgatgggcttttaggggatgaactttataaaactgagcactagtaaaaggaaacttgccagcttcgtagggatgttttagggttagaattgcaacaccagaatcaacgtgaacttggattaaatttaaaatatactttcattgttattactttttaaacatacctatctccgtatctttatctatcttttggaggaattaatgaataggtattctgtttctaaatatataaacagaactaaggtggcttttctttttggataattctagaaccatggatacataattcttttctttagaatactttgcatatactttaagagtttatatatatttactttgcttccacttttttgagaggatctttgataatttaaagaattaaatttataaaaattcaggtacagatgtatttttcagtctttagtataatttgtatatctccatgcattttaagggatcatgagataaaaaggttaacttttttcaactatatattttttaaacaaagttaaacaacaataatagcaagactaaagaataatgaagttaggcagaatatggatcagaagtttggcataggaaaaattttcgaatttatattagtccaataaaaggtttcaatttggctttttaatgtactatggaatattataaccctttctgattttttaatgcattttcatgttttgttcctttattgttgttccataaagttcactcacaccctttccattacatttttttcaaataaaatctcagataaaatgcagttccacatttatgggagataataaaaaagcagagctcaggatgatacatatttgacttctgtttagctgcattgttttatgataggacattagaaggcaggagaggataagtgctatgaaaaaggaaactgcattattgtttttcgtagactatacataaacattggagatatcaaaaatgagtgagacagcaatatatatatataatttcaacagatgattgaaatgtttctgtaaattaaaagaagtattttaatacttcaaggtgataatcttatttattgtgtattttcatctctacacatgcatttttcttgagctactcaatgggaatctaaatatagaaggtgagaaatcaagattggcatttacacgaacatggcctgtattttgttgaaatattgtggtgcgtagtttgagttagagttcttttgggtaatacagaattggttgtgaatgaaagcaccctttcagagatcttagaaggactggacttcttataacttgacatcttctaactgcttctcttcttctatctcttctacttattcaacaacaccatagggtttttttcttttttgttgttgttaaaatattcgtgaacataaaaacacactctcacacattgaattagtaagcaaaaatggtttaaagaagatcttaattgccagagtatcaaatgaaatttgtcttccagctactaatcacttcaatgtaataaaatccctttacaaccaaaaagtcaaaaagttttaataatgtaacagcttaaaagccatcacaagaatctgaaatttgagcaactcaaaaaaatgacttcaattttttgagttgtaccctgaagttttgtaccctgtgaactatatctcctctccctgccaaacacctagtaactaccattctactctctattacggtgggttcaaagtttttttttcgattccacatttaagtgaggtcatgcagtatttgtctttctgtgtctggcttatctcacttagcataatgtcctgcaggttcaaccatgtttttacaaatgacaggatttccttctttttcaagactggataatatttcattgtgtataacttttctttacccattcatctgttgatggacacttcagttataagaagaataaatacagagacctaatgtacaacatggtgactatagttaataatgtactgtacactgcaatttgctaagagatatttcaagtgttctcaccataaaaaaaaaaaacataactatgtgaggtgatgcatatgttaattagcttgtggtaatcattttacaatgtatatacctacatccaaacatcacattgtatatcctaaacatatacaactttttttgtcagtcatacctcagtaaaacttgttgaaaatttttgcctcttttttaggaatttatagatgagggattttttttccttcagtcattttttttccctaaaaatctgttaagtggtatttaaatataagactctctatcttaatagcagacttttaaagtgtcctgagtagcaaaagtaaatacttaaaaatgtattgaaacaaaaatagaagtaaaaggaaataaaaataacctctaccaccattgtttaaatgtacagaattgtcatctcaaccacccatatttacttggtatgaactcctgtttattattaagattcttgattcttaacgtatggaatttagaactataaaatggacagtcttaatattacttcacctcatacatcttttaaactgtttaaatctagagtaaatggttacacaaaacacatgtgaagttggggctgattctcttcctttggtatggaaaaaagaacagcaaccatgaaataagaattgtatatgatccatgaaaaggaaaggaaaaattaagctaataactatcagtgagatctataaacccatttcccatctcttcacaagtattcccaagaaatattattctttctacatttgtgatcaattatttcaagaccagttttaatttgaaggattataatcctattatccaattacttggcaaaagacaagctcagatttatatttttaatactgccttctttttcagtgatggattacataacaagttctttgcaaattctgtttattattaggcacatttctggttttgacaaattaagcctgtctgcttttgtcatcacttcttaagctttatacagtatctacacaatttgagggaatactttttgtttccactcagagtttggttaatgctttcttcttactattttgtgatggtttgtcttataacacactggtgcctccttttcttcatttcttccttttttcttgccttccctcctttctttctgagaaatgttaacacggatccactcaatggcactgtgctgttgacgtagaataaaacaaaataatgtgccattgtgtaggtgactcaccctcaagattgctccagttaaggagagaatctatccctgagtttttatattactaattattgagtggcagcttttcttttctttgggtttcacagcatgtgcctttggacaaagaactagggaagatgtaaaagatgagtttataatacatcaagatataaatgttaacaccctatgctgttcatgtaaatactaaaaacactatgaaagatcatcagcagcagttttttcttgcactttttcagctctcttgacatatatggttacagttggaggcatttttcagtgtaccaattaaaatatttttttttctacacaatccagcaaaagtgtgagagtaaacataatagaatttgagttagcgaaagttagtatgacatgtgaggttgtggttttagtgcatagtggttatttgtttatgaatcttattctggctgtgtctcatttaccgttctcaactctgtctctgcatttctttcaccaaatgcctccttgcatggtgtttaagcctgcaaactcttctttcctggttccatcccggtatcattctttttttatgaccaaactacactgtgtactgagtgaaggacagtgctacttttaagagataggatcttggctgtgccactaattaactggtgcccttaagaaagtgaattaaccttgttgaaatacagtttcctcaattataacacatttacagttccctatatgacctatgatgcagctttctgaaatttcttgattcatttattttgagtttgtgttctttttagtctaaatctcattatcctcaaattccattctcctttgcaaatccaggtgttcaatcatgtaggtaaaatagaagtaggattaagaaagtcatgagggaaacaacttggctatgaaacattgtaagaacagcaacagtaaagaagttttggagtcttgtgctcatcttttttgtccttttcttgcccctcccaacagttgtgtctttctcatatatacatttattcagcaaacattattgaacaccttccaaagatctgatgctggtcagactctcagaacccagatacgaaccagacgaagagtcaggaatatccgtctggggaagctacagaagagaaagctgacattttctctagctgagcaatccacaagctgttatggatacatataggagacacagagagataataataacctagagaaacaattcctcaatcaatcctggttttcctctcatatttctgcagcccatctatgtccctctgaatccttctttgtagcttagtgctcatgagtaggctctgaagtcagacttcctgcactggtagctcagctccttaatctagttactttgtggccctagaaagtcatttaacctctctgtcagttttctcatctgtaaaatgtgaataacaataactgtctaggttataagattatgagagttgaatgtatatataatgtttagtatagctttttgcacgtaataagcattcaataaattaactattcatattaattatctctacttttgtcatttcctctaagtgttttaagaagacattgaatttgtaaacttctagatgtttctattcaaaatgatattctcctcacaaaccactttttggctgtaaactccgggatggcaggtatttttgtttttgtgtgtgtttgtttttaattatattttcaaatgctagtaaaattctggcacaaataaatattagaagaaagaaggaaggcaagagttacttgcattgttgaaaacaataataatgtcaactgcatgttgataaacaggtagaaattcctaaaatatattaaaacaagataaagatgataagacaacactaattcttagctaaaaactgaagtatcattacttctcttcagcatctcctgggactgaatctatcctcccagagcccatctagacaaaagatccccatctactggataatgtgtgaacagcatctaacgaatatgattcttatgtatgttagggagttaatttaattttccttaaaaatgcatagcatggaatgtcatatttgggactgttttgtgaggtcttgctcaaggagaggagattagtgttgcagagtgacctggaagtggtaggggggaaacgttcataatttacttaatttgctgctattgttaccatattattcattcagcatgttctatttttgaaattaaaatacagttttagaggcgcagtggctcatgccggtaatcccagcacactgggagactgaggtgggaagattgcttgagcccaggaggtcgaggttgcagtgagctgtgatcatgccactgtactccatcctaggtgacagactgatacccagtctccaaaaaataaaagaaaaagaaatatgattttttaaaaatttaatcattatcaatatgagtttgcctaaatcccccttcaccttcctttcagttatagttttaggagccaacaaaatatattttcttccttatttcatgtgttacaggacttttgataggcaagctctctataagggtttgcttaagttattttctataccctgaagcttgccttttcttttcattaataccaccctggagaaatggcatatatgacaatgtggcatttgtgacttatacaatatagcaatgtggcttatggatgaatgaaagggtaatgcccatcttttttttttttttttttttcattcagtagagacggatttttgctatgttggccaggctggtctcgaactggcctcaagtgatgtgcccacctcagcttcccaaagtgctaggattacagtcatgaaccacccagtgaccagccagtgcccatgtttttaaaaggctgtggagcttcctattgtcctgagaaatacctggacagcaaagtgtgtgaccccacccaaccctgccactggtagttaggcaggcattgcatgctagagcttctggccctgtggcctgcttctgtttgaactcaactggtgggcacagctcgctgttgtcccagtaagcacatggacagtaacatgggcatttccacccacccctgccattggtagccaggtgagcaatgactgttagagtttctagcccagtggttctacttctgcctgaatttgctgagggatgcagtcttctgttgctctagaaacatccagatgtcagggtgggcaggtccaccaatcttacctcccatagccaaatgagccatacatgctggaggttccaacctgacagtcctgcttccacctaaactctgtggtcagttgcaacctcatgttttcacaggaagcacacagatgcagatcagggccaacctggcaaggatatggcttatctgcctgaggaggcccttggaccacaacaccgagaagaagaactgaagcatggggagaataatcagaggtgtcattaagacacagtagcaaactagcatcaaagccagtcaactgaacccaccttataccataatcaaacccccaagggcatcaaataagataaaagaaaacaaaacaaacaaacaaacaaaaaaaacaagtctatcaaaaagacagcaacttcaaagattgaaggaacatcatcagcccacataaatgagaaagaaccagtgtaagaactcgttcaactctggcaactcaaaaagccagagcactttctttcttccaaatgaccacacttgttccctagcaagggttctcaacaaggctgaaatggccgaagtgacagaaatagaatacagaatatggatgggaatgaagatcatcaagattcaggagaatgtagaaactcaatccacagaatctaagaatcataataaaatgatacaggagctgatatacaaaatagccattataagaaagaaccaaactaatctgatagagctgaaaaatacacaagaattgcataatgcaaatgttattaacagcagaatagaccaggctgaggaaaaaatttcagagctcaaagactggccctctgaaattactcagtcagaccaaaatgaagaaaaaagaatgaaaaataatgaacaaatcctccaagaaatatgggattacatataaagaccaaatctatgattcactgatgtccctgaaagagggaaaaaacaagcaacttagaaaacatatttcaggtatcatccatgaaaactttcccaaccttgctagagaggccaacattcaaatctaggaaatgcaaagaaaccctgtgagatattacataaggagatcattcctaagtgacataatgattacattctctaaggtcaaaatgcaagaaaaaatgttaaaggcagctggagagaaggggtggatcacctacaaagggaaccccatctggctaacagtgcacttttaagcagaaacccacaagccagaagacattggggacatgtattcagctttcttaaagaaaaaaaaattccaaccgggaattccatgtccaaccaaactaaacttcataagtgaaggagaaataagatcctttttcagagaagcaaatggtgaaataatttgttacgactagacctgccttacaggagctgctgaaggaagctctatggaaaggaaagaccgttaccagcaagtacaaaaacacacttaagtacacagacaagtaaactataaagcaaccacaaaaaagagtctgtatttaacatcaacaactaccatcacaatgacaggatcaaatccacatgtatcaaaactaaccttcagtgtaaacaggctaaatgcccccatttaaaaggcacagagtggcaaggtggataaagaaatgagaccaaatgttatgctgtcttcaagagacccacctcatatacaataacattcttaggctccaaataacaggatgaagaaaaatatacaaagcaaagaaaacacagaataaagcagagattgtaactgtaatttcacacaaaatagactttaaaccaacaaagaccaaaaagacagtgaacagcattatataatggtaaagggctgaattcaacaagaagacctaactatctaaatatatgtgcacccaatataggaacacccagattcacaaagcacattcttagagacttatgaagagatgtgaattcctgcacaacaatagtggaagtcttcaacactccactgacagtattaaacatatcatggaggcagaaaattaacaaaaatattcaggacttgaactcaatacttgcccaaatggacctaatagacatctacagaactctccacctaaaagcaacagaatatacattcttttcatcacatggtacatattctaaaatggtacacactctaaaatcagacataaaatagtactcagcaaatgtggaaaaacaaaaatcacaccaaacacagtcttgggctacagtgcagtaaaaattgaaatcaataccaagaaaatccctcaaaataacacaattacatggaaattaaacaatctgctcctgtatgacttttggaaaataatgtaattaaggcagaaatcaagaaaatctttgaaactaataagaacaaagatacaacataccagaatctctgggacacagctaaatcagtattaagagagaagtttctagtactaaacacccatatcaaaaagttagaaagatctcaaattaacaacctaacattactagcagaagaactggagaagcaagagcaaaccaacctcaaagctagcagaagacaagaaataatcaaaatcagagctgaactgaaggaaattgaaacgtgtaaaaccacataatacatcaacagatgtaggtgttggttttttgaaaaaattaataagatagacgactagttagactaataaagagaagaagagagaagattcaaataagcaccattagaaatggcaaaggggacattaccactgacctcacagaaatacagaagaaccatcagagactactatgaacacctgtgttcacacaagctagaaaatctagaagagatgcataaattcctggacacatacaatctcccaaaactcaaccagaagaaattaaatccctgaacagactaataacaagttccaaagttgaatcaataataaaaaccctaccaaccaagaaaagtccagttggattcacagccaaattctacaagatgtataaagaagagctggtttttaaaaaattgtcaagtttcctccccagttttttggaacagtttcaacaggaatgtaatagatataaaaatcctcagcaaaatactagcaaaatgaatctagcagcacattaaaaagctaattcaccatgatcaagtaggctttatccttgggatgcatgtttggttcaacatatgcaaatcaataaatgtgactcatcacataaacagaactaaaaaaacacatatttatctcaataaatgtagaaaaggctttcaataaaattcatcatcccctcatagtaaaaaccctcgataaactaggcattgaagaaatatacttcaaaaaaataaaagccatctatgacaatctcacagccaacattatactgaatgggcaaaagctgaaaggattcccttgaaaaacagctcaagtgtgccctctctcaccactcctattcaatatagtattggaagtcctggccagagcaatcaggcaagagaaagaaataagagacatccaaatagaaagagaggaagtcaaattcttcctatttacagatgatgtgattctatatctagaaaaccccattgtttctgccccaaaggtccttgatctgaggaacaacttcagtaaactttcattatacaaaatcagtgtacaaaaaattagtgtcattcctatgcaccaacagcatccaagtcaagagccaaattaggagtgaaattccattcatgactgctacataaagaataaaatacctaagaatacagctaaccaggaaggtgaaagatctctacaatggtaattacaaaacactgctcaaacaaatcagaaatggcataaacaaatggaaaaacatttcatgcctagggataggaagaataacatcattaaaatggccatactgcccaaaggaagtgtacagattcaatgctatttctatcaaactaccaatgacattcttcacagaattagaaaaactattttaaaattcatatggaaccaaaaaaagaggccacataggcaaggcaatcataaggaaaaagaacaaatctggaggcataacatactcaacttcaaactgtagtacaggcaacagtaaccaaaacagcatagtactggttcataaacaaataaatagaacagtggaacagagtagacagcacagaagtaatgttgcacacctacaaccatctgatgtttgactgagatgatgaaaacaagcaatggggaaaggactccctattcaataaatggtgctgggataactggctagccatatatggaagattgaaactggacctctagcttccatcttatatcaaaaatcaactcaagattgattaaaaagttaaatgtaaaacctaaaactataaaactcatggaagataacctaggaagtagcattctggacaaaagaatgggcaaagatttcatgacaaagacacaaaaagcaattgcaaaaaaatcaaaaattggcaactggtatctaattaaactaaacagcttctccacagcaaaatagactatcaacagagtaaacacacagcttacagagtaggagaaaatacttgcaaactatgcatctgacaaatgtctaatttccagaatctgtaaggaactttataagcaaaaacaacaaacaatcacattaaaaagtgggcaaaggacataaacagacacttctcaaaagaaaacaaaggatataaacagacacttttcaaaagaaaacatgcatgcagccaatacgcatataaaaaatgctcaagatcactaatcattacttaaaccaggggtgttgaaaaactaactgctgagtactatactcatcatctgggtgataggatctttcatatttcaaacttcagtgtcatgtaatacacccatgtaacaaacctgcacatgaacaccctgaatgtaaaataaaagttaaaattatttaaaaaaagaacctgcagaagcagatggaagacctcaaataatccagataaaccgacggccttcccactccccacttgtgacattggttaaaaagaaaatgttgcgaattcctattctttatgatgaagatggcctcccattatctgttaagacttgcaaccaatgttgttagcctgattttagggacaaacttcagaatactcataagagcacagcaataatgagtactccagaaagaaaaagccaaaccttgtgattgtggtgctgaagcaagcttctctgacttctagagactttgtcattttgttcatcccttctggaggtatttagtaacccaaatgttccatatctcctttacttgattcaagcatgaaaatctgttctgtcagtgttggacagttctcttagctctatcatagcaagtaagaagcagccatttaatttcagaatgccaagtacccagagcagaatgtggtgtgattagcttatgtttattaattgttggtagatagacctggttaggtaggccaaacagcctgaaggaaaatttcacacagaacttttttccctttaagtttctgccttcagaggaacatccaggctttatttttagaattcatttttttatgctacatagttctaggctgcatagatcagctggtattaataaacctgttgttttgccaaaagcctacatgtgctgttatggccttcttcaactatttaacttcccaaaaatatgtgtcagtggtcagaaggatgactgaaaaagcagacatgcataattctacaaaaggtttctcctttttccaatggcaaaataacttcctttctcccctccgcctcctttttttggtcctatctagagcctcaagaccacatttatttcccccaacatataccctgcttgcatcaccaagttcatccttttcaagtgctcctttgcttctcctggaaacagtttcttaaaatagaacaaatgtgtactcctcatctgatttgttaccacttgtaattcccaatcttacttcttcccatcaatgccaaactggttgacagagcagatttttaacattgcctccatttctagtcacctcttgatatggtttggctctgtgtccccacccaaattgcattttgtcactcccgtaattctcttgtgttgtgggagggactcagtgggagatgattgaatcatgggggcaggtcttatgctgttctcgtgatagtgaatggatctcatgatatctgatggttgtaaaaatgggagattctctgcacaagccctctctctttgcctgctgccatccatgtaagacttgacttgctcctccttgccttttaccttcctcccggccatgtggaactgtaagtccaataaacctcttttcttttgtaaattgctcagtcttgggtatgtctttatcagcagcatgaaaattgactaatacacctctctttcactcttcactgtgctccccattttatgaaattccacatagttgtctagtttagtgatattctatttttactctccctttgcacattttctgtttcacttggactattgcacagttttgtttttttccatgttctttttgaaggatttatttgccttttttttttttttgagacagggtctgactgtagtgcccaggctggagtaaagtggcacaatctcagctcactgcaacctccacctcccgggttcaagccattctcctgcctcagcctcctgagtagctgggactacaggtgcccaccaccactcctggctaatttttttgtatttttagtagagacagggtttcaccgtgttagccagaatggtctcgatctcctgacctcgtgatctacccgcctcagcctcccaaagtgctgggattacaggcgtgagccaccgcgcccagccgcgcccagctaatttttttatttttagtaaatacagggtttcaccatgttggccaggctggtctcaaactcctgacctcaagtgatttacccacctctgcctcccaaagtactgggattacaggcatctggcttatttgcctttttaaaatgcaatattgagcaccagctaaatcctagatagagagatgaggaggtataattagtaataataatattattattgatagttaattcctatgggatatatattatggatcaagtactgttctaaatgtcttagacaaatgaactcattttcacagaataccatgtgtgagatgtgattatattcaccgcatactatgtcaataccatgtggtaattattatactagtattattacttccatttataaagcaaagaaactggagttcagaaaaaataaattctccaatgtcacattcagtattagagctatttgagtgagtatggtccttgcccttaggaatgttgtagtctaataaaatagtaaactcaggctgcatacgtataattctaatgtaaagcagggtgtgataaaggttaaccagtgcttcaagaaagatggttgggagggccgggtgcggtggctcacgcctgtaatcccagcactttgggaagccaaggcaggaagatcacgaggtcaggagatcgtgtccatcctggctaacacggtgaaaccccgtctctactaaaaatacaaaaaaatttgccaggcgtggtggtggacacctgtagtaccagctactcgggaggctgcggcaggagaatggtgtgaacctgggaggcggagcttgcagtgagctgagattgtgccactgcactccagcctgggtgacagagcgagactccgtctcaaaaaaaaaaaaaagaaagatggttgggaggttgttgggaatgcactgtgactgggaaaataaagtgaggaggaggaggtagtatttttgctgtctcttgaatgggtggaactcttctagttgagtattaggggacagtcctaaactataggtacagcataagcaaaggtagtagcatgagcttatgttcgagaaaactggggagtctgatttgctttgagcacaggacatgtgtagagaggcagtgggaaatgtaattgcaggccttgattcaaagaaattttgactttaatgtgtgtttgaagtggggaccccttgatgaattttagaaatagcagtggctgatcaacctgtatgttagtaagatagctatggcagcagtatgaaggatgctattttctcaagtctgttcttgatatcactcacttttctctttcctctttactcacctctgtgggtatcatgcaaggctttctctccttgattttgtgcactctatcttgggtgctcattccttttcctggactcactgcccttatatttagctgactgccacatttcctgctttttccttagttactcccaattttctaaggaagagaggaatccagatagaatactctgaaataatgcattactaaacttggtgtcaggagtgggaaagaaaaaggaaaggacaggattgaagtatgaggggactagtttcaagaagaagaggtatttcaaagattattgtgttagtctacttgcacattgctataaagaaactacctgagactgggtaatttataaataaaagaggtttaatcgactcatggtttcatatggctagggaggcctcaagaaacttacaatcatggcagaaagtgaaggggaagcaaggtacatattatatggtggcaggagagagagagaaggcatgggggaagagccaaacactttgaaaccatcagatcccatgagaactcatgcactatccctatcatgataacaccatggcggaaacagcctccatgatccaatcacccccatcaggtcttgtcctcaacacttgggaattacaattcaaggtgatatttgggtggggacacagagccaaaccatatcattctgcccctggtccctcacaaatctcatttcctttacacatttcaaaattaatcatgcctttccaacagtaccccaaagtcttaactctttccagcgttaactcaaatgtccaagtttgaagtatcatctgagataaggcaagtcccttctaactaagagcctgtaaaataaaaaacaagctagttactcccaagatataatgggggtacaggcattggataaatgtttctgttccaaatgggagaaattggccaaaacaaaggggccacaggccccatgtaagtctgaaagctggcagggcattcattaaatcttaaagctccaaaataatctcctttgactccatgtctcacattcagggcacactgatgcaaggcataggttcccaaggcctgaggcagctctgcctctgtggctcttcagggtacagcccccacagctgatttaatgggctggcatagagtgcctgtggcttttccaagtgcatagtgcaagctgttagtaaatctaccattttggggtctggaggatggtaaccttctcacagctcttctaggcagtgccccaatggggactctgtgtgggggctccagtcctacatttcccttctgcattgccctagtataggttctccacgagggctctgtccctgcagcagacttctgcctggacatccaggcatttccatacatcctctgaaatataggctgaggctcccaaagctaaacttttgtctcctgcctacccatagacacaacaccatgtggaagctgccacggtttggggcttgaaccctctaaagcaatagcctgagctgtaaattggccccttttagccatggctagatttggagcagctgggacacagcgcaccatgtcccaaggctgcacagagaagcagggtcttgggccaggcccacaaaaccatttttcccatctagatctccagacctgtgatggcaggggctgctgcaaagatctctgacatgccctggagacatttttttccattgtcttggctattaacatttggctcctcattacttatgtaaatttctgcagctggcttgaatttctccgcagaaaataggtttttcttttctattacatggtcaggatgcaaatttttcaaacctttatgctttgctttccttttaaacataagttccaatttcaaattatctctttgtaaatgcatatgactaaaagctttcagaatcatccaggttatatactgaatgctttgctgcttaggaatctcttctgccagatacgctaaattatctctctcaagttcaaagttcaacggatctttagggcaggggcgaaatgctgccagtgtctttgctaaagcatagcaagggttatgcttcagttcccaataagtttctcatctccatctgagaccacctcagcctggacttcattgttcatatcactatcagcattttggtcaaaaccattaaacaaatgtctagaaaattccaaactgtccttcatcttcttgtcttctgagccttccaaactgttccagcctctgcggattacttagttccaaagtcactttcacatttttaggcatctttatagcagtaccctactctgtcagtaccaattttctgtattattccattctcacattgctataaggatactacctaagagtgggtaatttataaacaaaagagtttaattgactcacagttccacatgactggggaaacctcaggaaacttacaattatggcagaaggcaaagaggaatcaagacgttttttatatggcagcaggagagagaggacaatggggaatctgccaaacagttttaaaccatcggatcttgttagaactcactcattatcttgagaacagcattagggaaactgcccccatgatccagtcacctcccaccagatcactcccatgacatgtggggattacaatttgagatgagattcaagtggggacacagagccaaactatatcaataattccatcattctaaagtctttaatttagaaaagtgaaagaacgacaggcataatgtggttattggggaaacagctgctttataaagaaaggtaatgtctcttttaggatttatgaaatgtggaaataatgtagtcacttacaaatattttctaaatcctttattatgtgccagacaccttgctaggctctgaggatgcaacagtgaaaaaaagagagtccttgattttatagtatttacattctggtggaaagagatagaaaataagcatatttataaatgctatataataaaaattttttaaaaacacagcaataacagaacaaggtaaaatacagaacaaagagatgaagagaagaaggaaagggaggagggtatattaactagggcggtcagtccttcctaaagggttattttttgagcagacacttgaattaattcccagaggtagccaggtgacaaatttggagagagagcatagtagacaaaaagacatgtaaattccctaagtaagaagtgtggtttgtctgaggaacaaaaagaaggttatagtgactgaaaaagagggagtgaaggcttgagtattaagagattaaaatgtattttaagaaaaagaaaaacaaaagagagatacaaattttgaaggtagcatgctaagtgctttggcttttgttctgtgtcatggaggaaacatggaaaaatttgagcagggaaatgcagttctctggtttgagttgtaaatcttctcattgcattatggagattttactgtatttaagactgctgaaaagggagcatggagaaatcaaaattaatgcagaagtcaaaccagacagtgtcatggcttgaacaggtgcattatgatgaggagtggttggattagagacatagttttaaagtggtactgacaagtcttgctagtgagatgccagggaaagaagattctggggcgattccaaggttttgggtagatagtaggtaccactggtgattccaaggtagatggtaggtaccttggtgattccaaggttttgaggtagatggtaggtaccattactgaggaggggaagataggagcagaagtagaatttgatgggatatagataaaaagtttagatatgatacttgcaaaatgcctagtaattatccaaatggtgcagttaattaggccattgaatatgagtctggaggtctgggctgcagaggagtggagataaccatgtggagtgtgatgccacaatacctaagatgtttcccgggattctagacaatggaaagtggcacaatttcaggaaactttacaagacccctgttgtaatttatctttttccataattgcatgaaatcagaacttctcagttttataaagatcttattcatatattgtaatattagcattaagaagctgaggaaactatctttgaacaaccctataaactacaattgcacttttctcctattttctgggctggagacactcacattaatattccagtgtaagcatcgatttgcctaattacgcagtattttttggccatccacagttgtcatttcaagttcagtagagatcaactcaggggtgacttacagcatgctttctaaaagatttagtattttgcagggtaaaatgactaaatcatgagttccagaaacctattaacagctcataaaatgtggtgttgagccaaattttgtctcttcaccttgataggaatgatttaatgaatgggcaagaaactgtctttattcattttgcattttgaaagcattttataaaataaaactgtgtactcttaatatttaaaagataagcatgttcatggacaccatgactatttatttgtaagatggatttagtttgttgaataggttttttatgtccatttttatacaccaagatacaaattagtttcctgttctacaacatccacatagatgttgtagattatattttaaaaggaaatacattatactgcctcttttgaggaatcatatgattcttgtaccagattagctctgtaaccaaaacagtcaaacaaatgaacaaacaacaaaccccaaaacaacacaggatcttttcattttataaaatgtaacctagtttctttcatatccttctgggaatgaggtggctaatatctctatttatgatcttgtgtttactgatatcaaagaataattgtaccgagcagagtaaaacaggtcaagaggactttaattcaagacctctacaatagggaagatacattgaattcaactccattgaaacaaaaggtggtagggtttttaagccctggagtgagctagtgaaaaagtactggaagacattagaggggaatttggtcaatgtgattaggccaactgtgtttgctaattggtgcttatgaaagttaggatctgtctttgtctgcttcgtgttgctaaaaaggaacacttgcgcttggataatttatgaagaaaagggttcatttttcttatgattctggacagctggagaatgcaagattggatattgacatctggtgagggcctcatcctgcttctcatggtgaaaaagttaagaggagctgcttgtgcaaaggcgtagggggaggtaccaggctctatataacaaccagctttcctaagaactaatggagtgggaactcagtcaccccacggagggaaggcattaatctattcatgagggatttgcccccatgacccaaacacctcccattatgctgaattttcaacattggggatcaaatttcaccacgaggtttgtgagggacaaacatccaaactatagcaggatcctaccctcttacagagactaggagatggtgtcattatccttcttgatgattatgtttcaaagggaagactcacaggtttttgagaaagaaattcctgggttgtaaaactggttacaggctggaggaagatttacatctcaaaggggtagagaaagatttatagttccaagtttttgaaagtaacttttccaagaagagggcactccagggcctgtagtgaggaagaaacctgtctaaaatctagccaagttgaggagaatttaagattgtgttaatgaggatattttatactctgtgtccatgagatattgatatgctcagtcatttataaagaaggcaaattcagctcccatggaagtattttatttgggagaaagaataggaagagctgttttagcttatactcttagccataaaattaccaaaatgggtttaacttcctcagattgcttaaagttgcttgctgggattggaggtctttttgtctggggactgacagtttttgagtttggagagttctctaggcccccaagtaagataaaatcctctgagctgaatagccttaggcaggggttgagctttaaattcttgttacttgtatttcagaggatctggagttcagagtctctgaggacaaaggcaaacaatgaagataggaaagttggaaattaaagaaaataataatcttaatatattgtatttactcactgaaatatattttaatatattttattttattagtgggttgcttgacctttctttgcttcagtttctgagtttttttaatcttctgtaaaattaagataataaaatttactcattagagtcatatgagggtaaatgagaccatacatataaaaatcagactgcttggcttatagtaaatctccaaaactattttatattgttcttatttcttggtgtttcttaactgtctctccagtagattaaatctcccttcaacacaggaactgagtctttttcatctgtggatctctagccctccacagagcatgtcaaaagtatttgttgactgaatgataagtaaacattttaccagtggaaggtatccaagttactgccagcaactccataagagtctatagtaacctcaattcttgcctcctcagaagaaagaattcgatggaggggcataaggcagaaaaagaaacgaaggcaagtttcagagaaggagtggaagtttatttaaaaggctttagaacaggaaagaaaggaaagtacacttggaagaaacccaagtgggcacatgaaggtcaagagtggtgtttaaccttgatcctaggactttatgggctggcccctttcccatgattcttcccttagggtgggctgcccacctgtgcaatgccctcttaatgcttgggaggtgagcacatgcaatgtgtttaggaagttgtacaatgcccatctggggctttcttcccctttctggtggagtgcccctggaaggtcatagtcagccactttgtctcttactgcacgtgccccggctcactcacccagtacctgagattttattggaagttcctttttgcttctcccttgttcctgcattcaattagcattttaatgcaacaggtgtggaccaccaggaaatggcctctccctggtgcctgctgccaatttatcacttttagagaggcaatgtgatagttgccaaactgtcacctgacattcctagtgggtgggggtgagacctctcctgccccactcatgcctgtctaactacctgtaacaaacttacaagcaacactcagaacatgttttataggctgatgtcccaaaaactaagctgttcatcagaatgatctacaaattctcaactgccagactgtgcagggaggaacaagtcattcagtgttactagagcagaggtttaaggtaaggaagtgtggcacttgaggcttgagaattataaaggcagccatgtatgatatgttgcttttggattttattctctggttggtggagttatggatggattttaagcaggagggaggccacatggggtgtgaggtagagtcttgggccattcaaaggtatctggtttagtgccaggcacatgctggattctcagaaaatatcttttgaatgaataggatagtaaatatgtaatcattaaagacagtaagaaataaggtagatctctatgtgctgctgatatgggaagatgttcaacattactattaagtgaacaagagcaacttcagaccagtatataaagtatatttccatttgtgtttgaaaaaattacatatgtgtttatttctatgtgtgtgtggtagacagtaggcaggtggatggatgcatggatacctaatttcaactttatgtttcatataatatgcatcatttgaattacccaaattgcatgaaattttttgtgatgatgatgatgttgatgttgttgacgatgaaaaaataaagagactctccaggtaattattcaagtatatagccagattctacaatgtaacctaatgaattattatttacatttcattttgattgtgacaggataagagtcaagactaggaaaaagtgggaaagtgacactgctttttcttattgccatatccatgttgtttcttatattatcttccttatttatagttaaaactgcactaaacgtaacttgtcatataatttgctatgcagacagtcctcattgttcaacttataatttttcaactttacaatggtgtgaaagcaatatgcattcagtagaaggtgataagatactctctcaagactctgagtagcagtgcagctccaagtcagccattagggtaaatgactgatactctacagtgtactgtgctgcccgatgaatttgtccaactgcaagctaatataagtgttctgataacattcaaagtagactaggctaagttatgatgcttggtaggttaggtgtattaaatacattttgacttactcaattttcaacttttgttgggtttcttgggacataaccccatcgtaagtcacagagcctctgtattgcgataggagtttaattttttacttcattattgatcaatgaaaaatgtttcaaatatttacatttacagtgttgcagatttggtactctaatttctgatgaaatttatattacttaaagttaaaatttaacattcaacaattgttatatgacaaatccagtctcaacattatggttttatattattatatagttaccttttttattctttaagtatttcaagtgttctggctatggttcctagtacacatgggaataggcagaataatatgaaagaatatctgaacatactctaagttgtacaatagtgtatggtatagctcatctgaaaataatatttttctcctacaaaattagaaaaagaataataatccaaaatgttggcagtggacaagagaaagaggggtatttgggtttgtatggagcatgacatatacaaagtacagaaatgaaaataaaagtaaaaatcaggaaatagcaaaatcatgttatttaggaatatggaaatgtagaatccacagcagaaaaacattcattattactataaaaatgcagaacttttggtcgtaataggtgagggtgtttttttaattatactttaagttctggggtacatgtgcagaacatgcaggtttattacataggtatacacgtgccaaggtggtttgctgtacccatcaacccgtcatctacattgggtatttctcctaatgcaatcctgaccctagccccccacaccccgacaggtcctggtgtgtgatgtttcctttcctgtgtccaagtgttctcattgttcaactcccacttatgagtgagaacatgtggtgtttggttttctgtcttgtgttagtttgctgagaatgatggtttccagcttcatccatgtccctgcaaaggacatgaactcatccttttttatggctgcatagtattccatggtgtaaatgtgccacattttctttatccagtctatcatagatgggcatttgggttggttccaagtctttgctattgtgaacagtgccacaacaaacatacatgtgcatttgtctttatagtagaatgatttataatcctttgggtgtatacccagtaatgggattgctgggtcaaatggtatttctagttctagatccttgaggaatcgccacactctcttccacaatggttgaattagtttacagtcccaccaacagtgtaaaagtgttcctgtttctccacatcctctccagcacctgttgtttcctgactttttaatgatcactattctaactggtatgagatggtatctcattgtggttttgatttgcatttctctgatggccagtgatggcgagcattttttcatgtgtctgttggctgcataaatgtcttcttttgagaagtgtctgttcatatccttcgctcactttttgatggggttgttttttccttataaatttgtttaagttctttgtagattctggatattagccctttgttagatggatagattgcaaaaattttctcgcattctggaggttgcctatttactctaatgatagtttcttttgctgtgcagaagctctttagcttaattaaatcccatttgtctattttagcttttgttgtcattgcttttggtggtttagtcatgaagtctttgcccatgcctgtgtcctgaatggtattgcctaggttttcttctagggtttttatggttttaggtcttatgtttaagtctttaatccatcttgagttgatttttgtataaggtgtgaggaagggatccaaaccactgctcaaggaaataagagaggatacaaacaaatggaaaaacattccatgctcttggataggaagaatcaatatcatgaaatggctgtgctgtccaaagtaatttacagattcagtgccatcaagctaccattaactttcttcacagaattggaaaaaactactttacttatttatttattcatttatttatttatttaacttttttttttattcttttttttattattatactttaagttctagggtacatgtgcacaacgtgcaggtttttaacatgtgtatacatgtgccgtgttggtttgctgcattcattaactcatcatttacattaggtatttctcctaatgctatccctcccccattcccccaccccacgacaggccccagtgtctgatgttccctgccctgtgtccaagtgttctcattgttcaattgccacctatgagtgagaacatgcagtgtttggttttctgtccttgcaatagtttgctgagaatgatggtttccagcttcatccatgtccctacaaaggacatgaactcatccttttttatggctgcatagtattccatggtgtatatgtaccacattttcttagtccagtctatcattgatggacatttgggttggttccaagtctttgctattgtgaatagtgctgcaataaacatacgtgtgcatgtgtctttatagtagcatgatttataatcctttggttatatacctagtaatgagatcgctgggtcaaatggtatttctagttctagatccttgaggaattgccacactgtcttccacaatggttgaactagtttacaatcccaccaacagtgtaaaagcattcctatttctccacatcctctccaacatctcttgtttccggactttttaatgatcgccattctaactggtgtgagatggtatctcattgtggttttgatttccatttctctgatgaccagtgatgatgagcattttttcatgtgtctgttggctgcataaatgtcttcttttgagaagtgtccattcatatcgtttgcccactttttgatggggttgtttttttcttgtaaatttgtttaagttctttgtagattctggatattagccctttgtcagatgggtagattgcaaaaattttctcccattctgtaggttgcctgttcattctgatggtagtttcttttgctgtgcagaagctctttagtttaattagatcccatttgtcaattgtggcttttgttttcattgtttttggtgttttagtcatgaagtccttgcccatgcctatgtcctgaatggtattgccttggttttcttctagggtttttatggctttaggtctaacatttaagtctttaatccatcttgaattaatttttgtataaggtataaggaagggatccagtttcagctttctccatatggctagccagttttcccagcaccatttattaaatagaggttcctttccccatttcttgtctttgtcaggtttgtcaaaggtcagatggttgtagatgtgtgctgttatttctgaggtctctgttctgttccattggtctatatctctgttttagtaccagtaccatgctgttttggttactgtagacttgtagtatagtttgaagtcaggtagagtgatgcctccagcttaggattgtattggcaatgcgggctcttttttgattccatatgaactttaaagtagtttggaaaaaactactttaaatttagctaagtcaatcctaagcaaaaagaacaaagctggaggcatcatgctacctgacttcaaactatactacaaggctacagtagccaaaacagcatgatactggtaccaaaacagatatatagaccaatggaacagaacagaggcctcagaaataatgccacacatctacaaccatctgatctgtgacaaacctgacaaaaacaagcaatggggacaggattccctatttaataaatggtgttgtgaaaactggctagccatatacagaaagctaaaagagggtgttttttattataaacattttagacttatttttatctatgaaaaaataccgtggggatttattaaaatatattacctggaatgggttagggataatgttctaaaagaaaaaggaatatggagtagattataatgtttgataattgagaaatgtgttggactaaacaaaacaaaatagtgagaggcatggaagtaattaactaaattacacttctttgcatatgcttctgtctacctgacttaaaaagaagtactgatttgagctacagtgtgaatgaactttgagaaacattatgccaagtgaaagataccaaacacaaaagaccatgtgttgtatgattccatttataagagatgtcccaaaatgagcaattccctagagacaggaaatacattatttgttgcccaaaactgaggaaaggcagaatggggagtgattactaattggtatggagttccttttaggggtgatgaaaagattcttaaattagagagtggtgatggatacacaactctgttaagatactaaaaatcttgtgcatttaaaagggtgaatttcggccaggcacggtggctcacgcctgtaatcccaacactttgggaggccgaggcacgcggatcaccaactcaggagatcaagaccatcctggctaacacggggaaaccctgcctctactaaaaatacaaaaattagctgggcgtggtggtgagcatctgtagtcccagctactggagaggctgaggcaggagaatggcgtgaacccgggaggtggagcttgcaatgagccgagatcgctcgccactgcactccagcctgggcgacagagtaagactccgtcaaaaaaacaataaaaagaggcgaatttcgtgatatatgaattatatctcaatttaaaaaattgttttgtgactgtgtctgcccagaagaggttgtataagagaagacatgtaacctataactcaatccatgggaactgcacttgaaaaagaaagcaactcatatggtctgcgtttttcccattggctggctctgtgcctctaggtcactagataatcactcaagtgtacttgttacctaacctgggtgcaagcctgatggatagcgacaacagcaaccacaaaaatccagtgaaggagttttgcaaaactcagttcagagggtcgtgatatgtgtatgggtggagggtggtggatgagggtgagtgtgtgtgttttctttttccattaattggcacggatcttatattgcaaaaggcttgtattccagtaaatgaatgtgtagatagcagatgttgctgcttcagaatcactcaccatgaggcctgggatatatacttttatacacaacactttttgtttctaatatacaagccaagatgtgaacaagtttcttaaacaatccagagaattacatctattttccacttcactttgtccaagtagacacacataaacaatggtgagcatgggataaggaggtaataattcagtcagcctttgcaatgacagtctatgacagtgacttgctgctttggaaaatgtgtcccttagtctggttaattaaaatggtttaatataaagcaaaaaataaataatggattaactaaattggaacttttattgaagcccaggctgttctatctttattattattattattattatttatttgagacagagtctcgctttgttgcccaggctggagtgcagtggtgcaatcttggctcatttcaacctccacctcctggattcaagtgattctcctgcctcagccaccagagtagctgggactgcaggtgcctgccaccacgcccagctaatttttgtattttcagtagacgtggggtttcaccatgttggccaggctggtctcgaactcctgacctcaaatgatccacccaccttggcctctcaaagttctgggattacaggcatgagccactgcgcccagcccgtctatattttattactgaaaaatgtagccacatagtttgtatttttttttcaagggttactattcctgccctcacaataggagattctctacagggcacccaggtcgaacagactatagtttaagtttttgtgttattatagagtcctatatgctttttagttttctacttttcagatgtgtacagctcctatctgcacattctattatgatcactgcacgcattttgaggacagaaccctgcaagcctgagtgcctttaacttccaacaagatttatgtgtgtgtccctcttgtgtactatgtgcaaagttaagccagtcaattacttttctgttagtcttttgttcttgctcattctcctctggagatatactatttctgtaaaatactcttttattatcatctccacttcagtgtatcccctcaagcataagttctgggaaggaaggaaaaggttatatctcattgttctgtataacatgtgcctaaggtttactttgggctgcttgtaacctcatgctggtgttaaacagatcctaagtgtacctgttccaatacctagtttatttttaccctaaggtgcgtttgcttcagcaaattttaagaacctacttggaattggttttgatattttgaactgtacagacaccgttttctttcattatatgtaacacacatagtgtccatgattgtggaatattagtgtaatataattttactgtgcttggtaagaacatcttagaaatgaacaataatgttgaaatatgggccaaacatttgaaaaaccttccagacttaatcagtcttgtcttggggctctctgtacagtgaaattccaggtttaaaaaaatactatttcacaaaagacccttgctatttgcaaggatggtgatttgaaaccatgactcttctaaattgtaaatgacattaaaaataggtcacttaaggagcctgacaaaatagtgttgtgctgtgacccaaggtggtgcttctagttttctactgggctgctaatagagcgggctggactttcctattcttgcatattatgttctgctctttgctattcctcggtgaaatcagaaagcttagtgcatcattattccaaaatagaaaagtcattccattctttgacataaacacacagtctctcttttccacttacatttaaatgttcacaaatgaatttctttccattatagttgtttcatcttgtttgacttcttttttggattcacaaatctctccaccaagctcacagtaaacatgaaagtgctattagagaggacaaatctctccaccaagctcacagtaaacatgaaagtactattagagaggaatggaatagcttctaaaacctctcagagaaggcttttcagaggaagcaccagtagagatgtccctttaagaggtgcctgtgtcaaaataaacaggcaaagggaagtacaatctcaaagtcgatatactttactggaaagaaaactctttattaggcccacatctgagtctggtactttagtgcctggtacttgaccacggctgaacactgggatcacttggagaactttaattaatactggtcccagctctaggttatctaatttaacatattcagggaaaggtctaggtatcagaactcttaaaccttctctggtgatcttaatgggcaaagttagaagctgcatggttcccttagttgtggtttcccattctatagatgattagaaacagggtatctggctgcgtgctggacatgtggacagtacatatcctcaggtgtctctcctgcaaaaaaagtatgccagcttaaacctgaccttcctgatatatcatctcatcatctactgaaccccatccactttttaaagaaatccatgcaatcattcaaaaaatattggagaagccaccatgtctctggctccaaatctttctgtctgaactagtttccttactctgtgatgcatccctgtttaaatcccatcagaggcttcatttgcccatgggtaaagtcaaagacagcatataatccacagctacctttgtaactcttaagtctcaagtcctaccatttgctgcctaaatgggctttagtaatactgagaagtttgttgttctgtgtgcataccatgctacttcaggcttcacagaatttacctttcctatcttctatcccactagctacctttcatctggctagttcctatccacatcaaggctcagatcagccgctaacttttctgagagtaattctctgaacccccatgccactgaggatttcttgttgtataccttcagcaaagcacttttattttaaaactgtctgactccacttatgcgtctcctctggactgtaagctcataaaaggcatatcttcatcatctgcatatgcccatttcctagtactcaatgcattcacatgatggttttcttcaaatgaactgatctgggatatggcatatcaggatgcttctaattaagtgatattgaaggtcgaaggaagttagagctaacagtttggcagcaagggaagaaacagaggaactcagaagtcagcgatgggaagtgaccatgtaagagtggctgcgtgcttcagttatcacataggacacgaccatgctatgactcagcacaatcaatcactgatgtgaataataatgactccaggtcaatttgaaaaagttaaatgcacccataagatgtagtttaaaaattaaaatgagcataaatgtataaatgcatttcaaccaaatcaattaaaaaggaagaggaattctatggaaattttgcttgtgagggaaagatacatcattctgtaaatgctaggtaaattatataatgtattttattacattataatacaacagcatcaatttctatttttacatgtgtttatagccagagaaagtttctagccatagccagataaggtgatgtcactaactcagatccattatttattctcaaactttaaaaaaaaaaatgctgctcattatccctaatgtcattgatccacacagaaccaggttgtgaaatagaataagataaaatgattgaccactgggaagatttattccaacgctgttgcctgtgaatttctcctccaaatacacaggcttgaaaataattagtttccaatttaggatgttcataaatgagcatatgtagcacctgtaagaaacacctctgttttccatctcaagctttcagggaataatataattcacatatgtactttgcattttggttgccataataagtcttctgcagatgttagaaacagctaaataattaattttagttctgatccctcatctgaaaaatggagataataatgaggtttttactaaccataaacagggcttcttgcaataatctaagacaatatatatatttgaaagatctttataaattgtagagtatttgttagcaatagtaatttagtgattttacaaaacaatgcattacactgtcatgaatattagtgtttttaaaatagtgcaaaacaagcagtattttaatgtaaattctaattaattcaatttaacaaatatttggttatgcgttctaagcataaagcattgtggttgctgtagatggagatggagggtagaaatatatggactctgttctaatttgggtataagatatataaataatctctaagaacaaaaggtagaatgatagaagctgcaattatgaaaccaaagtgtgctatgttaaggatgatctttatatttggatgatcaagggataatttattagacaactggattttataagtagaaatggtagtcaaagaacattccaggatgagagagtaacagatgtgaagcccacaagggaaaaggcatccacaatacaactaaggccctgaaatggctggagtgtagagggagagggggtatttaaacagtcatggtcttaaatgtcacagcaagagatctgaatattatgccatggagaatgttgagcaatttaagtttttgagcatgagttgtaggattgcagcagtgttttgggaatcaatttctaatgatagaaatgagtacactgtaatggagattaaataaaattcaagacttcacttctctgtttgtgtctgcgtagtttttctaggatcattgttactaacctgttcttttttttctttcttagactaaggaaaactgtttgtaagattagtagaaaatcaaactgtgagcataggctttctaaagcacacttggatttaaattttatttccaaagtttacctgctgggtgctcttgggaaaattattcaacctgttcaagtttctgttttgttctggtaaaatagagatcataataaatacctcagagaatcattgtcctaattgagatatccttaacacactgtctagcttgtgataaatgttaaattgtctagcatgtgataaatgttaaattaatagcagctttttaaaatacaccattggtatataaaagtgaatatttatagttaatataaaatatttagtcatattgtattcaggaaaatcagcagaattttaattaatcatttgtatttttttaattccccctttttcattgctggaaataggaaaataaaaattcaggaatgtggtctcagcctccttgtggtcccacttaaatgcaaataagttaccactaggtaacttactagggcttccacagtaaccacgttctaaaaatctgtgatcactacacttgctgaattggacatatcttcataaagtaggtaacagcctttctgcgtgtttaaatggtaaaggtcctgtgttttctttttagtagtgtgtgtctgcagagacatcctaatgtagtctaggtgcaggagttgaaggcagcagtatggaaggaagtctttatctataaagatagttgtcagggtatcactactttgttaaatttttttatacttaggatgtgggctttatcctagcagggagagagactgggtcttatatctatacccagcattcattcagtaccccaacttttagtatactaatattacttgggatggatatatgagcccaaatgccaccttagtactttctactgagtgcaagtcatgcacacatctcgagttcagattcccttcctcttgatgtcaaagcacctgggaaggaaacactttaatgagaagattgcctggtgactattcagttaaagccaaaagaagtggcacatctaaatgcataattcattcaagtggtcaaggttgataaaacgtacctggtcaaagttgataaaacaacagcacacttctctgtggtgacaaaaaagcttataaccctcagatctgtgatttctgacttgcacacacatgttgctcctgcgtgttttctcttaaccctctctttctgggttccattgctaagcgagctattttttatggactatgtttatatcacctttttagctatttagctattcccagccttggagacagtctgtcctccagttttatgcaggttgagctactgtatttccttgagtctaccattacaactactattaccagtagtgacatgtatcctgaattcagaaactctaaagtatatgtaaagcaggagctgttgggggagggaggattatgaaagtagtgcaggagtgtttctagggcttctactaagtgggtttgcacaagtggtaaatttcatgcacgtccgtgtgaacagaccaccaaacaggctttgtgtgagcaacatggctgtttatttcacccgggtgcaggcggactgagtccgaaaagagagtcagtgaagggagataggggtggggccgttttataggatttgggtaggtaaaggaaaattacagtcaaaggggggttgttctctggcaggcagcagtgggggtcgcaaggtgctcagtgggggtgctttttgagccaggatgagccaggaaaaggactttcacaaggtaatgtcatcacttaaggcaaggactggccatttacacttcttttgtggtggaatgtcatcagttaaggtggggcagggcatattcacttcttttgtgattcttcagttacttcaggccatctgggcgtacatgtgcaaatcacaggggatgccatggcttggcttgggctcagaggcctgacattcctgccttcttacattaataagaaaaataaaacaaaatagtgttgaagtgttggggcggcaaaaatttttgggtggtggtatggagagagaatgggcgatgtttctcagggctgcttcaagcgggattaggggtgacgtgggaacctagagtgggagagattaagctgaagggaggccttgtggtaaggggtgatattgtggggatgttagaagaaacatttgtcatatagaatgattggtgatggcctagatatggatttggatgaattgagaaactaaatggaataaaggaaggagaaaaacaggtataaaaggtctaagaattgggacgactcaggatatctgattagagagtgcctaaggagattcagcatagtcctgccagcaaagattatttatttacttcaagagttaagagtggcagtttggggatagcaccaggagatatcagctgtgatggcatggaaaaacagtgtaaaccggcagtgtaaacaagagcagggcatgtatgagtagttgagaatggtgaataggagtatgactagacagaagatagtagggatgacaagttttttgcggcacagtgtaagttggtctggtgtctggaatgagactggggcctaataaaaaggagtgtctatacaggagctcaaatgcgctgtaccctgcagcattccgaggacaggcctgaattctgagaagggaaagtggtaaaagtattgtccagtcctttttaagttggtggctgagtgtgtttttaaaagacctttagtccattctacttttcttgaagacagaggaccataagggacataaaggtttcactgaatactaagagcctgaaaaactgcttggctgatttgactaataaatgcttgtctgttatcagactgtattgaggtgggaaggctaaactgaggaattatgtctgacagaagggaagaaatgactgcggtggccttctcagaccctgtaggaaaggcctctacctatccagtgaaagtatctacctagactaagaggtattttagttatctgactcagggcatgttgagtaaagctaatttgccagtcctgggtggggcaaatccttgagcttggtgtgtagggaaggaagggggcctgaataatccctgaggagtactagaatagcagatggaacactgagaagttatttccttgaggatcgatttccacgatggaaaggaaatgagaggttctaagaggcaggctagtggcttgtactatagcataacctgcctttgctggtgtgtggtgattaggcctggtggaaccgccaacaataaatcaagcgtgatcagggtgaggaagaggaaagaaggaaatttggggaaatggggtgaatgtcagatggatcagagagatacagtcatgggggtcaggtgtggtatcaggaataacgtgggaggccggattgaagtctgggccaggaacaacggtaattgtgggagactcaacaaagagtgggtacagctgaaggagccggggagcagaaagtatgtgcgtcaggtatgaggaagaaaatagattttggaagttatgagaactgtagagagtgagttgagcatagtttgtgattttgagggcctctaaaagtattaaagcagcgggagccgctgcacgcagacatgagggctaggctaaaacagtaaggtcaagttgtttggacagaaaggctacagggtgcggtcctggctcttgtgtaagaattctgaccacgctaaccatgcctaggaaggaaaggagttgttgttttgtagaaggtgcttgggtttgagagattagtcggacatgattggcagggagagcacgtgtgtttttatgagaattatgctgagataggtaacagatgaggaagaaatttgggcttgattgaagtaataggggctgtctgtgaagctttgcggcagtacagcctaggtaacttgctgagcttgatgggtgtcagggtcagtccaagtgaaagtgaagagaggctgggattaagggtgcaaaggaatagtaaagaaagcatgtttgagatctagaacagaataataggttatagaggcaggtactgaggataggagagtatatgggtttggcactacggggtggataggcaaaacaatttggttgataaggcgcagatcctgaactaacttgtaaggctcgtccggttttaggacaggtaaaatgggggaattgtaaggagagtttataggctttaaaaggccatgctgtagcaggcaagtgataacaggctttaatctttttaaagcatgctgcgggatgggatattggcgttgagtggggtaagggtgattaggttttaatgagatggtaacgggtgcatgattggtcgccaaggagggagtagaggtatcttatacttgtgggttaaggtggggggatacaagaggaggacgcaaaggaggctttggattgggaagaagggcggcaatgagatatagctgtagtccaggaatagtcagggaagcagacaatttagttaaagtgtctcagcctaataagggaactgggcaggtggggataactaaaaaggagtgcttaaaagagtattgtctaagttggcaccagagttggggagttttaagaggtttagaagcctggccgtcaatacccacaacagttatggaggcaagggaaacaggcccttgaaaagaaggtaatgtggagtgggtagcctccgtattgattaagaaggggacgggcttaccttccactgtgagagttaccggaagctcggcgtctgtgatggtctagggggcttccgaggcgatcaagcagtgtcagtcttcagccgctaagccgagaagatctgggaaggagtcagtcagccttgggccagagttccaggggctctgggagtggctgccaggtgagttgaacagtccgattttcagtggggtcccacacagatgggacacggcttaggaggaatcccgggctgcaggcattccttggcccagtggccagatttctggcacatgtagcaagctcctgtgggaggaggttctggaggagcctggccgctgcggttcaggcatttggaagttcctgtgtgctggagatgtggctggggtttgtctcacagtggaggcaaggaattgcaacatttttctattattgtacaccttgaaggcgaggttaattaaatcctgttgtggggtttgagggccggaatttaatttttggagttttatttaatgtctggagcagattgggtaataaaatgtattttgagaataagacggccttttgaccttttagggtctagggctgtaaagtgtctcagggttgctgccaaacaagtcatgaactgggctggatttttatatttgatgaaaaagagcctaaacgctatctgatttgggataaagaaaaaggagcattaaagttgactatgcctttggctccagccacctttttaagagtaaattgctgggcaggagggggagggctagtcatggaacgaaactgtaagccagaccaggtgtgaggaggggaggtgatgaaaagattatagggtggaggagcagaggctgaggaagaattgggacctagctcggcctggcgaggagcagcctggggaggaagggagaggtcagatggatctgtagaaaaggaagattagaaagactcagcgatgcttggggttggtactgaggggacaggcgggagggaaagaaggaagatttgggatgagtggcactgggcacagagactaggaagggactgatgtgtaaaagaatgcctggacgtcaggcacctcagaccatttggctattttacgacaagaattacttagatcttgcaggatggaaaaattcaaagtgccattttctggctatttggaactactgtcgagtttgtattggggtcaagcagcattgcagaagaaaataaggcatttaggttttaggtcaggtgtgagttgaagaggttttaagtttttgagaacacaggccaagggagtagaaggaggaatgaagggtggaaggttgcctatagtgaaggaagcaagcctagagaaaagagagagtagagaaactgagggaaggggttcgggggttcttaccttccagaaaagtgggaaaagaggttggggcgcagagataagaggtcggggcatggaaataagggatgaagcacagaaataaggggtaggggcacggaaataaggggtcgagcatggaaataagggattggggcacagagatataagaggttggggcgcggaaataagggattggggcacagagatacgaggttggggtacttgcccatcctctagaaaagcgggacttgccgctaagagtgaaggagaaggggttgaggggtacttgcccctcccccagaaaagcagagaaggggtagagacaaggagagaaggggttgaggtacttgcccctttcccagaaaagtgggacttgctgctaagggtgaaggaccaaggcaggcgtccctgcgtggtctgacacctttgaaacgtgggtgaataatcagagaggcgtccctgcaatgataaaacaccaggggaaggctgccttcccagtccgtgaccagcgccggagttttgggtccacggataaaaacatgtctcctttgtctctcccagaaaatgaaaggaattgaaattaagagaagggagagattgaagagtggaaagaagaaagtggttgagggacagtgagagaggttggagaagagagtaagaagaggccgcttacctgatttaaaattggtgagatgttccttgggctggtcagtctgaggacctgaggtcgtaggtggatctttctcgtggagcaaagaacaggaggacaggggattgatctcccaagggaggtcccccgatccgagtcacggcaccaaatttcatgcacgtccgtgtgaagagaccaccaaacaggctttgtgtgagcaacatggctgtttatttcacccgggtgcaggcggactgagtccgaaaagagagtcggtgaagggagataggggtggggccattttataggatctgggtaggtaaaggaaaattagtcaaaggggggttgttctctggcaggcagcagtgggggtcgcaaggtgctcagtgggggtgctttttgagccaggatgagccaggaaaaggactttcacaaggtaatgtcatcacttaaggcaaggactggccatttacacttcttttgtggtggaatgtcatcagttaaggtggggcagggcatattcacttcttttgtgattcttcagttacttcaggtcatctgggcgtacatgtgcaaatcacaggggatgcgatggcttggcttgggctcagaggcctgacagtaaacatattgaaatgctactgtaccagttagtacgtatcctctgctagtaaccctctgactgccacctcagctcattcctgaggcctctaaaccacaccataacctaggaagggacctaggaccctgtgcagcctgtgttctttctgactggttagtgcccttaaactgctacttattaaatattctgtatactatatttggtattagctctggaaaatacactaatttcactttctggggaaaaaaatccttttcttcctttgtctcctaatttttgagaagcactcaagtctcaccagtgcactgcttctgaggagttatatggcatactgcagaataaaaaagggggcaaaatcctaaatgactctaccttcagctctgaacaagactactctcagacaagcctagacagaaacaaaaaatccttaccataagaaccacatcctccaatgtgtgaggagcccttttctccctcatgtaatttaattctctctttccattctttattgacctcaagcactcaagatgccctttaaactcaatagtgccttctcaaagagaaaggttaagtgtttattttaaactcctaaagaagtaaaatattgagtaaattctacatacatttgacctgctccactatttttgctatagggttcatgagaaactgtgatcaacctgctctttttctttttgagtactggatttattttggtagaaacttcaatacatatttatacttcagatggtgactctgaaacactaaattgtgtgattccctgtaacacatttcataatctgtcggggcaaactattttcaagttctgctgaagctaattgcctttgtaaatcaaattgttaaatttgaattatagtttaattaggtggagtagaatgcttgctggtctactctataaacagttttattctgttgtcaaatgaataggtctgaaatgaactaagtttaaaatagatttttggtgttttgtgggcctgctttgatattactcttagtcgttatattatgttagtatatttgcatcagaaatctctgaaaggaaatgggaacagtttgacttcctcctttccaatttggatgacttttgttcctttcacttgctaattgctctggctaggactttcagtattgtattgaacagaagtggtgaaagtgggcatccctatcttattctggatcttggaaggaaagcttttaactttttctcgcttaagtatgatgttagctgtgagtttgtcataaatggcttttctttttttttttttttttttttgagatgggagtcttgctttgtcacccaggctggagtgttgtggcatgatcttggctcactgcaacctccacctcctgggtttaagcaattctcctgcctcagccttctgagtagctgggattacaggcgcccgccaccatgccctgcttatttttttgcatttttagtagagacgaggttttaccatgttggccaggctagttttgaactcctgacctcaagtcatctgcccacctcggcctcccaaaatgctaagattacaggtctgagtcaccacttgtactgaggtacatatcttctgtgcctaatttgtttagagtttttatcatcaaattgatgttgaattttgtcaaatgctttttctgtgtttattgaaatgatcacatggtttttatccttaattctgttaatgtgatgaatcacttttattgattgacaatgttgaaccatccctgcatcctttggatgaatcccacctgatcatggtgaattatttttaaagtgctgttgaattcagtttgctagtattttgtggagggtttttgcatctatgctcatccagaatgttggcctatagtttgtcatttttattgttgtggtcttgactggttttgctatcagagtaatgctggccttgtagaatgaacttggaagaattcccttctctccagttatctggaatggtttgaaaggaattagtatagttctttaaatgtttggtagaagtcagcagtgaagccatcaggtcccatgcttttcttagacgggagattggttatcatgatttaatcttgttagtagttattggcctgtttatatttgctattttttaatgactgaatcttcgtaagttgtatgtgtccaggaatttatacatttcttctaggttttccaattttttgatatataattattcataataatttcttgtgatcttaaatatgtaaaaccctaagagtccttcagaaattcttagaattaatgagtaaatttactaaaatttcagtatacaaaatcaatatatttaaattggtagcttttccataaattaacagtgaactatctaaaaaagaaataaagaaatctcatttatataataatagcttcacacacacaaaaattagatacctaggaataaatttaaccaaggaggtgaagcaagatctctacactaaaaactataaagcactgatgaaagaaattaaagagaacagaagtaaacagaaggatattctgtgttcatggattagaaaattaatattgttatattaaatattgttgaaatgcccatctacccaaagtgatatgcagattcaatgtactttctctcaaaatactaagggcattctttgcagaaatagaaaaatcaatactaaaaattgatatggaaccatggaagaccctgaatagccaaagcaatcttaagcaaaaagaacaaagctggaagcatcacactacctgacttcaaaatacactaacaagctatagtaaccaaaacacatggtactagcataaaaacggatacacagatgaatgaacaaaatagaaagcccagaaataaatccacatatcaacagccaactgattttcaacaaaatgccaagagcacacattggggaatgaacagtctcttcaataaatggtcctggaaaaactggatatccacatgcagaagaatgaaactagatccctatctctcaccatatgcaaaaatgaacttcaaatggattaaagacttaaacataagacccaaaactatgaaagtactagaagaacatataagggaaatgcttcattacattgatctgggcaataattttttagtaaaacctcaaaagcacaggcaacaaaagcaaaaataaacaaatgagattatgtcaaactcaaaagcttctgcccagcaggggaaacaatcaacatagtgaagagacagcctgcagaatgggagaaaatattctcaaattatacatccaactgggcattaatgtctggtctatgtaagaaactcaaacaatccaacagcaataaaaaaacaaataacttgatttaaaaatgggctaaagatctaaatagtcatttctcaaaggaagatttagaaatgggtaacaggtatataaaaaatgtttttatcactaattatcagggaaatgtgaatcagaaccatgatgagatttcacctcactccagttagaattgctgttatctaaaagataaaagaaaacaagtattagtgagtatgtggataaaaaggaatcttattctttgtaggaatgtaaactagtacatttatatggaaaacagtatggaggttcctcaaaaaattagaaatagagctgtcctatgattcagtaaattcactatggggtataaatccaaaggaaatgaaaccatgtattgaagtgatatctggacttcggtgtttattgcagcactatgaaagatatgaaatcataccttggctattgtaaatagtgctgcaatgaaggaatggattaaaaatgtggaatatatacacaatgaaatactttttagctctaaaaaataaaatcctggcatttgtgacaacatggataaatctggaggacattaagtgaaataagtcaaacataaaaagctacatactgcatgatctcacttatatgtgaaatgtaaaattttgtttcataaaaacagagagtagaatattggttaccaggagctggagagggtaggagaaagggagggatggggaaagatacaaagtgacagttagagaggaaaaataagttttggtattctatttcacattttaggtaaaaataatatatatttcaaaatagcaaaaagaggatttgcatgttgtcaccacaaagaaatgataaacatttatggtaatagactgctaattaccctgatttgaacattacacatgtatatatatgtattgaaacatcacattttacttcataaatatgtacaattatacatcaattaaaagaaaaacttaaaaaattttggaaaaaaaaaccaaggattgaaaatccattaagtaaacagtgtcattgaagagcccagttaaacatagaaaaaaaaaaaaaacccaagcatttgtggaatttcagcccaggttatccctttctttgtctgatattcagggtaaggattcagatagtccaggcagccagtgctaggtcaacagttgtctttgaatcataaactctgaaggtgttcaagaggcttaaaagataatgatgtgctctaaccaccaaagacacaaagaactcaaaaatatttgagattcaaagaaagaaaccagcagtgccagttgtacaaaagcctatgtagtcatcttgcactgtgagaagtgctaaaagttagtgtggaaaattgggtacttggatataccaaaatgtaattataagtgattgccttttgtcataatgtgggaaaggtaaggcagaagattgaggaagaagatcagagagctcaatgaggaaacagatgaactgagtcaatgtgtcatttacttaaatggagattatacattcttttaaaaacgtactagtactttctacctatgcacacctttaaaagggaaataattttaaaaacgacagaactccaatacaagtatttttattaatgataattactaagaatgatttgatgtagaagccaagatacttcattgttctgaaagtttatggcttttgtaaagaaagaaaagtatttattttatcaaagtgttgtttgttgtagtaaggaatacgttttacacttgggtctagtacacacataattatttacatgcacaaaccaaacacttttccagattatacttatcttactacatgtgctttatttgatgttttctgttctattccatttttttaaaatgctgtttgcagccctctaaatagatttcttgatacctttaatggattgcatagaacaagggacacagcagcatactcccagatggggttacagcttctcttggttccttagacaccataaaaatgcaaagctgccagtcatttctgttcatcctggtgacagttccgttatttcctttaagaagcttcatctgggtccactgcaggaaatctttaaacctttgtgtcaactccaaactgcttgagaggcagacatacagcaattctgagtctcagccagcctgttggcttagtacatttgggtgcaagtcacaaattaattttctaaattgtttacatagtaccagtacttcttgccctaggtactttcacatctattcctttcatccatgtgggagctagtaagaatcaatcccagcaccttaataaggcaaattttaattatgtgtctttgggatctgaccatacatagctggtcaggatgaggcttaggcctgtctgatattctatccccacaatatctgtcctatctagtggggatcaggctgatttatagagcaacctaagggctttaaatactaatgggtacctcagtagaaacaaggtcctgagactactatcaaggtaggtagaaatgtaatgattcaaggagaaaggaccaagcacaaatgccttgtagctagaatgcatcacaacaccagaaagagcaaggcaaagttcaaggtgaagtagtttgagaaacaatgttacaggtaagtgaggaatgtttcatccagggttgttatgacataaaggaatgtgacaagggacagctgtgtacatatagattcttagcaatggaagtgacacagactcatatttgtgcccagctgtttgtgtcttaaataatcttggtgagctaggcaagtttggtgtcttgagggacagtgatggacaggctctctatccagaagtcttagataactatacttgatgattaaaagaaaaaaaaacaattttttgtccacatttgggtttctaccaaggagtttaggttttctaggtgctctgagtcagccccagaggaatggagggacacacttcattgatgtttagagctctctttgtttgatatccacattttcactcctgggggcatgatggttcttgcagggaggagaaaggctctgactgtggttatctggaaaccatccttccttcccacagtagagtgatcctggtgaaacttttaagcagtcaaaatgcatgctgatgtttgctgagattctggttttgactctttaggatgtgtttctgtatttcttctcatccacaggacattaactagggagatctctgaattttgaatacaaagtaaggttggaagtgaactttactattgtgatttttttgtgatagaggagagaatggtaaagacattaaactttagattgttcagaggttgaaggtcactgggttaattatattggatttggagaatgacgcaataaaaataaattcatttctattttatgagttataagattcagtcactctgaccttctttttttatgtaaagtacatgcactcatcatctgagcacctttacatttgtggaggtatttgtacctttacaaacactgttctctacacatggaaagcccttcccccttcttccccatccagtgaggaatcactgcctgcctcggaaaagctttgtattatagattatttgtatactgttctatctctgtacactgaaatttccctaaaaataatcaaactaacaatttataggtatatcatgattacaatatgacagacactgtgttttgttattattaactcattcagtcctcacaacaatctgtttatggaggtatggttatattttgcagaaaagaacatggcatagggaagttaagtgactttcttagggttccagagctggatttgtaaccagggagcctgcctccagtacctgtttaatcacaatgctatgctgactctctaattgttgactgtgtcttgtgtatctttgcagcctcagtgtcaagtgcagtgtctcattcataggaggcacacataaataatgttggtttaattaattaaattaacaaaaggctgcactctcctaaccagattgtgtatctcctctgcacctgaagttcagacttggtaaagcaggattttacacattaatttgagaagatctggaggcaagtttttattctgcccaagaaatgtggggaagtgttggatgtaaataaatagagtgtcccgagtggaagatgagatgtagcgcttaaatagaaaatctctatagtatgagagatgcgtaattcctcatacataattcccgattatcccagatgtccagtaggttgggacagggtggtgatggtatgaggaaggaaaattagaaaaagtgttccaggatttatttattcttttgatatcttggttaatttgtggatgatgatatgaggaacaaaaattttcttttagaggataggaaggagagcatattaaaattatagcctgaatgaagttatctgttatccaagaaaacagttcatagcagaacaaatcctttcgacaatggtttttccatgagtgagaaatggcccatttatgacaacttttgtgcactgaaaaatattgctgcactacttctgtgatgaaatctgtggtgaccatggattggagatcagagtgagaagaacttctggtttacagatgtgatagctaactggctccagaatagattttacctaaaaccttatattccaaaccaccaaaatctaaggatagcaatggtgagaattttatgctgttatgaatagctttcagtcgttcttggcatctctagataatctaggaccagtcatatctaatggacagagctttaacaaacacaaaagtccacagtcaagaaatgtcttgctggttgcctaccttactagcatggtttttgattaatcaagctgtttgatgattcagttctacatgaaaaggtcttgcctttggagtaaatctgggatattagggagaggtaagaatttcctttgaggaactgactgattttggccccaaaaaggcagatcccaatattttaaataatgttcttcatcttaatataggactcttcttctgagatatatcttctgaaagaataaggtacaaaccatgacccaagatcatattgattaatcttaactcagcagatttccaatgattattctgtttcaaacatttattagtcatgctttagttgagatgtacatgagatatacatgtatatgtatatataaataaagcgggcatacaaaggtggtttatacttattgcagctatttttataattagtagcaattaccatagtattggtaattgcctgaattagtaattggcctgaattacatatgacctgatcattagaaaaatgtcaattatggatgatctatgctttaataaagacttaagcataactccaaacttaaatatagaggaaataatgatgtcatattttattgatgatctatgctttaataaagacttaagcataactccaaacttaaatatagaggaaaaaatgatgtaatcttgggctgaaataatttagggtgagaatttatttcagaatgatatgttgtgttttagtttatattaactgagattcaatgagagattacattagtcagaactgaaaatgaaattgctagttaaaatatggtatatttgatatcaataactatgactgtgatctaacaaaagaaaataaatcatttatattcaccaaggagtcaccatcaaggccttcaacaaccacatccagtgttgtaataagcctctgtcacgtgtcatcaaataaatatgtgtagaattttaaaatagctaaatgtacatttatatattaatgttgaattctgagaacgcaaaggcacacaatattaactagaaaagccataccttatattttagcagcaatgagaagacaggttttttaactcacaagttttagaaataaaagttcaagttattgtctttggggaaatgtattgcttaatttagacgtgctgtcaattttctttctctatctatcctcctaatctctgatttataactccgttttcttatttgaaatgaagaggtttgggctaaatctatcttcaatctagttatctttcaacaaatatatattgaatgcctattttgtgttaggcactgttcaaactgaagcaatgaatatagcataagacctccaggtaacggggggaggagtcacagatagcaagcaaaagagtaataatttcagatcataaagactgtgatagaagactcttctcgcaggaggctttgctgtggtttgcagctgtgctggttatcacgcagtcattaaagcatgcaggagcattttggcagcagcaaacctttggatagctttctactatcacagaaatacaaacagggatacaaagtgaatggggtcggagtgcacactggtaagattggccagaaaaaggctttatgaggccccagtgatgacagcaagataatgtcaaaaatcttaaggaggagtgctagagaaaggaccagttgagtgcaaagtccctagaagggatccagcatggcacatgcaagtcacagaaaaaaagccagcaagtctgaaacagaatcacaagagtgataatgggaggggaaaggatggagaagtgaataggggtcagaatacagagaattttacagaccacaataaattgtttatgattttacttgtagtaagaagccattgaaagtttttaagcaataaagtgatttcaattgatttgttatttgaaaggtcactttgatggcagtgagaaaaatagaggggatggtttggggtatgatgagtagacaagtgacagggagaccagataagaagacattgcaaaggtccaagataagattttgtcttgaacaagggaaaaaaacaatggggatagtggaagaatattgggtttagcccatgagttggaagtagaagcctttctaatagactgactgtgggcaatattaatgatggggattaaggaagactacctcatttgtgcaattagttttgagtccctactatgttccaagcacaaggttaggcactggggattttatgtgtggtgaacagaactagacacagttcttgctttcagaggagttaaaatctggtgaaaaataatcatgcaagtcaataaacaagtagaagcctagaaaagggcaatgaaatagacctgtgtggtattgtaagttcatacaatggagagaactaatttagccagaatgtgtgtgtgtgagagagagagagtgtgttcatgtgtgtgtggtggtggtggtaagggtgggtatgccaggtgagagaaggctaagatctgaaagaaaagtaggatataactagggaagcagcagtgaagtatggcagtaggagtgctcaggcctggtggtggcacagtcaaggaaccaatctcagaaggctggcagggctggagggcaaaatcgggaacagtgagaagaggttggatactatggcattgagcagacatggtctcgtaggccatgtttgagaaactggcttttatcttaataactatggaaacctttgaaaggaagctgtctaattgctaagatttcttcttactctaaattctgtttatttctttgatttaatttgaaatatgaaaatggtagagctgtaaaataaccttcaaaaaccagtgaaagtgctggcatttgattaacataattagagagcctcttaaagaatcagcatgcaagatcatcttcccctcaggtgcaattaaacgtttcagaatagcttagtcattacagtcctggtgttacgacaccataaatattatctttcccaaacctagaatgcctttggccactgttccataggttgttctgtgacccctggattttatgagctcatgcaacatggacatatgttcgttcagtgaatgcctgtgtaggtaaacagatatttatatgacaagttgagttatgaaacaccatatcagatgatattaagaagatgattagataagtttcaagaattaaatagactagactatatctggatatccccaccaaactttcaactctttaagatgaagagattaagaatataaaaaatttagagtaattgctatcagctggggacagttttgttcccaatggagtaattagcaatgtctggagatagttttgatttctgcagctggggttagggtgctactagcatctagttggaagaggctggcaactctgttaaacatcctgcagcaaaactggatgtacaggacatctccctacaataagaacgaatggcctcaaaatgtcaatagtgctgaggttaagaaccccttactttcgctcattttaatatattacaaataattttggctttctgaaagaaaataactatcacatggatagggatatgctttttaaaaggagatggatgaggggaatgagctcacataggttaagagttcttcaatttttggtgctttttatttgcatttttctactttttccaaaataattgtatattcactagtattatttgatcataatgagctgcttattctcctctttctgaggtgtttttaacctgctgaatattggtgacctctttatccttctgttggggctcaagaatcctccatggagaagctcttgggaagtcacatgtctcccagactgtgctctcacacgtatagccctgtacttatatacaggaaagcattctgcaagctggattattctggcattgttgagtgatcttgaattaggaaccaagtgagaaacaagacaaagagtaggataaatggaggcaaaacattaccattattactaataaaatctgggttacaggatgtaccttaggtatgagagccagctagtcttcccaaattgaaccctatcattgggcagaattacctgccctgtcacagaagctcagagaggggcaaacttcactattgtgaagagaagggcctttccctggagaagcagcaatgccagccctctgtgggaagctcccttccatgaggaaaagaagagaagttgggatgagcacacatagctgtttacttccaagtttatcaatcagatgagtcatgccacctctcctggtgcagagtgaggaaaggggaagagaaaggtacttagttttactaattgagcttcattcacgtggaaggaagtatcaagagtgggaaagatgttctcctctcccgcttgtcccaaagctacaactgtaactctgctactacctttgctacccaatacggtatctactatgtgtgactatttaaactttaatttattaaaattaaataaatttaaaaattcagcttctgagtcacactggtcatatttcaaatgctcagtagccccatgtgtcttgtggctaccatattagacaatacagttatagaacatttccagtggatggagctattatgagattttaccctattcatctttgtgttatcaatgcctataaaaaggcctgactctaaggccctcagaaatgtttgctggaaaggcacactggttcatgcctataatcctaagacttggggaggccaaggtgggaggatcacttgagcccaggagtttgagaccagcctgggcaacatatagggaaaacctctctctacaaaaaaaataaaataataataataataataattaaattaactaggcatggtagtgtacacctgtggtcccagctacttgggaggctgtattagttcattctcatactgttggtaaagacatccctaagactgggtaacttagaaagaaaaaggtttaatggactcaacattccacatggctggggaggcctcacaatcatggcagaaggcaaaaggcactcttacatggtggcagacaagacacaatgagagccaagccaaagaggaaaccccttataaaaccatcaggtctcatgagacttctttactaccacaagaacagtatggaagaaacggctctcatgattcaattatctcccaccaggtccctcctacaacctgtgggaattatgaaagctacaatttaagatgagatttgaggtgagaggatcacttgagcctgggaggtcaaggctgcaatgagccatgatcgggccactgcaacagaatgagcaacagagtgagaccctgtcttaaaaaggttttggttaaatgaatacatgaaagtggaccactgccattttgtttttcaaatctgcatgttgtaaaattctttccattttagtgcagcatagatatcttgttaaatgaaataaatcagttgaagaatatgcattctataatattatttttatttagaaataattatttgtattcatgtgtgtgtgcaggatgggttggtggttgttaaaagcatggaaagaaagtcttgaagtgtacatatcagactgtatatatcatctggtggttgaaactgagggaaaggaataagaaatacttttttatttaaaaatcttgttcctagaaaactgaattacttttgagtaaaaaaactagcaaattaggtagtatgttaactttctagatactctaagaaaataatggctcttttcaatgtcaagtattaatgaaaggcaattttaaggcaatcttagcactttatgtgttaagaaaaactgtattgaagcataaggacaaataacaaccatcagtctaatggatactgcatgtaaaccacgaattctgttttgttaggagtgtgcaaaataatgttttatttcccaaaaatatagcttctctgctatgctgcagagaaggatagggccagatggcacagttctcatttttctgttagaccgcttgacccagcagtatactttctccgacctctccttattgaaattacttttgttcattgcagaagtaatcttcaccctggaaacagacctagttgtggtgtccgtgtcagaatactgatatactgactgtgataatccttttgcggccttacctcactcctcatttgatagtttataagctcacagatgctggaccagaattcagtccataaaattaagatattccatttcacagggccaaatctaaactgctgaagcaagaacactaaagcatgaagtggtgccttaaaaagtaactagggtcgtctaacccacaataaaaatcaacctggtttcaaaggaagatttttacatgctgcaacaatttcttaggagaaaaaggctctaattatgagaatataaaactcaatgagaatgacaaataaaataatatagaatgagtagttctatattattaggagctctgctattttgttttatgctcagttgatgggagaaaagaatattttcatcaaacaatcgaaatgaatgaatttaaaggtatgatgtaatcacctagaaaaatgacattaaaagcagtcttgaaaatgagcattatagcacaccagcatggcacatgcatacatatgtaactaacctgcacattgtgcacatgtaccctaaaacttaaagtgtaataataataaaaaaagaaaatgagcattatagagatgatatctttgtcattattgcatacattgactaatattcattattaaatcatgatggttccaggcttggataaaattccattaggatgaatatatccctgggggttgatatttgaagaggctgagctgtttggtaacttactgcttgcttaattttttttcttattgtttctacttttcagacccactatgaaaatggagaatatattatcaggcaaggtgcaagaggggacaccttctttatcatcagcaaaggaacggtaagctttggtggcacaagacagtgatgcactaggggagcctggggttggttagtaactccagtaggaacacatgcagagtcttgtgctatatgagtttgttccattttttgacacagagaggtattagagaatggatcttacaaaaaatgatgcaggagggaaaaaaagatgtaacttggaagaccagtaagtagcctacttgctaataatcataatattagatgacactgatatatttgtgtgaatagaaagatctccataattaaaataatataataaaaaaataccggctggatgtgatggctcatgcctgtaacctcagcactttgggaggccgaggcaggtggatcactcgagctcaggagttcaagaccagcttaggcaacatgccaaaacctcatctatacaaaaaatagaaaaaattagctgggcatggtggtgcatgcctgtcatcccagctacttcggaggctgagacaggaggattgcttgagcccaggaggcagaggttgcagtgagccaagatggtgccattgcacttcagcctgggtaacagagcaagactttgcctccaaaaaaagagaaagtaaatacttaggtcacttacaaaattcatcaagtcattagaagcagtaacattgctataatgaaacatctgggctttgaaatcagatggcctaaattttaatcctgttacgaaatttagtcattttaatgcccttaggcaagttgctgaatactctgaggatgataaggatagatatacattaatgttttaagttattttcataaagaaatattgatagtaaaaactactaaaggtgataaattataaaggaaggggtaaaaatggggtagacaagggttatgaatgaaaaatcatactttatttctaaaacttttaatttttcaacaatatgaatttatttatatcttaaaactaagaaattgagtgaattggaaaatagaatttcttttagattaatgctatactattgtattactaaaataccttaaatttatttccacagtaaagctataatcatgtttgtgtttgtgtcattatatgataacctatgatttaaacttatgtttctttattatatatcattacaaggaattcatatctctgcatgtactaagtatagaaggagatggagaaggaaatgcgaatagaaaggaattgataggccagtttccgtttttataattatcactttataaatgaagcatatttatttcctctaatttaacaaaatgattgactataacttatagctcatatatagagagatttacagagctacagtgaatagaatgcagtggaagattataagtattgttgaatcacaatttaggtaattctccttggactacttttggatcaagtgtatgcatatgtcagtatttacaccagtggcatgtcacacaaaaatgaagaaaacaatatttatatttttattattcctattcttttgactgatctctgaatgcctgggatagaagtagaactcaaggctgacttcttaaaagatatcatgaaatgacatgtctgaccacggttacagttaaaattatatcttatattttccaatgttagaagataagaaaattttaatattttgtagtttataagatagattgttagagcttatcatttattgtcttattgtttagattgactaaagaatcagggaaaattgaaaatcgccatggatgtaaattatttgaaaagttgcatagggaatttgtcctgacattctagatttgttttttctttactacatggctaattcttcgctatgatgcaatgatgtgtttatcctttgagatggatttctgacagtcttttgttaccaccctgttagtgcaaattttactgcctaaaagtaatgctttgtaaccagtttcagctgaagacaggtgcattagtcatgcctttttacgagtttcatagtaagtataagtagaaaaagtgtggaaattacaccacaggaaccaattcccttggcaatatttcagagcactctggggattctgggagggaagtagtactaatatattagactctcttgacacattcaagatcttttactttaaaccagacataaatttctactaacttacttttttaggtcacacaagttagctgctatgattcttagttatgtaaattacataataattgtattaattttattcattctaatactaatatattaacaatattaattatattagttctaattctaacatattaaaatcattaagaatatgtcaccatatacaataattagaatatattaagtcttaagaagcagaaggtgaggtcagcatacttaagtcccaatggcaaagagcaggaaagagaggtgaataataagagagtaggctcagttgagcaggcaaataagttgtggaactggaattttctacaattatatgtcatatgttttgttttaggtgtacagatgtcaacttgttttcccatgcatttaaaaaatgtataaaggataaccttgggcaagatctgtttcttgctaccaccaaactggctttttcttagaaaatgctgtgagatagagagacacaataggggctgccaagctacaaatgaaattccccttgttcagttccacttatttaagtgtaaaacaatttttattcttccattaagcacattcacacaaagagagaagcattataaaataagctttgccgtacttgtttttcccccattaagcctgtgctatctgatttttctaaaacctgaggcagaatgcttgcagtgatgatggctaaaatactggtgctgccttaagtagaagctcagttagttctctacacttcaatcactccgttccagttgcctggaaacgtgagttgcttctccaacagtgaactataaagcaccgaagattcctgcatatgtccctgcagttgtgtcacatcataaaatgaactatctctttataaataaatcaaaccaaaattgaacagggaacaggatgggtaagcaaagttgcagagttctaatagtagctcaaatagattttgatttttctgattccattcaacatacctcgtatcctaccattggaaaaaaatgtgattcaaaaattcttgtctatcaaatggcatttaaaatcacatggctttgcttcataaagttaacaagtatttaaacatgccaattaaatatgttgccttaacacaatgttcagtgttttttaatataaaaagtgttccgttatggaaattttatttgcatatgtatacatatgtttatgtatacattatggtgaaacctctgagaaacattttttttaatatcaagaacaagataaagatatacattattaccaattttgtttaatgtggtactagacatcccaaatactatagtaagttaagaaaaataaataatatttggaaataaagaaacagtaattatttatacatgatatgtttttagtttcttttaggattttatatagacatatatattattaaaatttaataagagtttagcaaaatcggcattattcagttcatttttctttattaatggaactgttctatatctctacacaacccaatataatagctattggtcacacttgctatctaaagtaaaattatctgacttaactttaatgttaatttctcagtagtagtagccacattgcaatagctgctagtagtggctgtcttggacattatagaactggatattttactataaatgaatattgaaaaagccatatcattcaacatattgtaccatattaacagtctaaagaaaaaaatcacattatcatgccaaatgatgcagtgaaagggtgtgacaagtataacatccattcataataaaacttctcagcaaactgagaatataagagaatgttcttgccctgataagtggtatctacaacatgcctacagttaacgtacttaaggtgagaaacagagcaatcagtaaatgaaagtaactgacagcaaaaggaaagtcttttcaacaaatggtgatggaaccattggtaatccatggaccaaaacaggggaaccttgacctagactttataccttacataaaaattaaatgaaaattggtaatagatttaaaagtaaaacataaagctataaaactttcaagagaaatgtatgacttgcgattagataggaagagttcctaggcatgacaccaccagcacaatccataaagaaaaatgataaagtgggctttatcaaatttagaaacttttattctggaaaaacactgttcagagaatggaaagacaaattactaacagggaaaattatttgaaaagtacacgtcttgtaaggggtttgtattgatcctatcctttattgatcctatttaaaaaaacacctaaaaatcaacaaaaaacaccaaagtacccactttaaaaaacagaatgaaagacttgaacacatcagcatgcaagatacacaaatggcaaatatgcacatgaagaggtgttcaaaatgattagtcattagaaaagtgcatattgaaatcctgagatactactgcatacttaatagaatggctaactctaaaaacaaaaattaacaatatcaagtgctagtgaggatgcagagcaactggtattctcaatcactgctcctgggaatgcaaaatggtaaagccattctggaaaacaatttgcagtttctaataaagttaaataaacatttaccgtatgacacagcaattactctttgtgatatttattctagagaaatgaaaatatagctcacacaaaaaactctgcatcagtgtttgtagcatctctattcataattgccaaaactagaaataaacaaattgtgtcatattcattcaatgaaaatattagtcagcaataaaaaacataaactattgaatcttgcaacaacttggatgaatcttaaaggtctaatgctgagtaagaaaaaaaggtctgaaaaggttaaatattgtattatttcatttatatggcattctcaaaaagataaaattagtttgatgcagaacagactataagggtgaggaatgagaaggatatgactataaatacatagcgtgaaggagtttctggaggtgatgaaattgttctgtgtctaattgttctgggaattagacaaatctatccatgtgtttaagttcctacaactatattccaaaaaagaagtaaattttactatatgatagaagtaaattttactatatgataacttaaaaattcatgtatatttctaaatactgtaacatgtaactaaaatacgtttttaaaataccatttcaaaaatcaagtatctaggcatatctataacaagaaaatgttcgagtcttttaagaagaaaattgtatttaaaatagtataatgaagagcaaaacaccaacatggcagaacattagaaagaaagagaaacatattgggagttgctacagtagatatcaagacctattataaggttcaggtaatggaaaaaaatgtggacttaatttgactgaaaactggacaaatatgtcagtgtaagaatggtgagcccagataaagatccatgataatatggaaacttgatttaggatggcatggacattacaggtatcacaacaattggttatgcatagggacataaataaaattggatccttagctcacaccatacataatggcagtttcagatgtaaatgtgaaaagaaaaattaggaaaaaattaaaagataattgggataatacttctattatcttgggataagaaaggatttcttgaataagatattttaaaatgcaaacaataaaatattacacggttaagtgtaattacattaaaattaatacatgtgttcaacaggacaccataaagatgatttagacaaaccatagtcttgtgaatgaacaacaacaaaaataatcagtccaatagaaaaattggcaaaaagcatgatcagacatataatcaaaagaagcacaagtggctcagaaaataagatgataaaatctcccacatctattaataataagggaaatgccatctaatacctacctttctggaaaaaaatcagtctgacaatattaagtattgataacaatataatataatataatatgcattttcatccattgatggtaggaatgtaagattgtaccaagagtgagttaatacctagtaaaatggaagatgcatatacttaataaccttgttctttattcatagacgttggccctagtgaactcttacccatggacactagaacacatgcataagaatgttcacagtaacacagttaatagcaccataaaaacaaagtataacaaaaataaaactggaagcaacccacatttatatctacagaattagtaaattgcataatattcatataatggaatgctgtttaaacaaagaaaataaattttagcttttatatgaacatgggtgaatgaaaacctcaagaataagggcccagtaacctttattttagatcagactccctactgaagtttctgcatctataaaagcctcttcagcatgcaaattagtgtctctgtgatacagcttagtggtcacagagacacagagacacagcttagtggtaagtaaaagtgttaaaaactgaatttccatggttttgaaacactgtgtggaggagtaatcaaatggatcagtggagaataataattgaatttcctccaccttacacagaccttcttaatacttataaaaattctggtctttgacatctaatctctagattcagaaacttgaagcacagtattattaaatgtgtttaagtgtttggcattgtctcaagaaattagtttttttacttcatcacattttccgggtaggtgaattttaactaacctttctggatgacacatagacagttttgtgaatgttagtagagcttgagggagaagtgaattaacacaaaggtacaagttactctatttttgttttcattcatgcaacaaaaaacattatcacttgccttctgttaagtcacaagtcctgtgtgttctaggctatctatgttgttagtaatgacacattctgttaaaacaatttacaactatttattgagtgcttattataatttgtggagaatgccaaagaaatacaactttcttttaagggcattttatttattatagtaaaaaagggcctatatgtaatttatatatctttagaaatagaaatcctaccaaatgaagcatgtggattttgagggatatagtcagttacagccatgcaagaaatctttatgaaaatgagatgtgtcttcaaatgaaagctggattcttctcagggaaagggacaggcgtatcctagagaaactaggatatgcatatggaggcatttagaaggatgttcatttcagcagaatgaataaaagaaagaaaaaaattgaaacaatataattgccaatttataggatatgggtaagtaaatatatttacataatgaaacaaaactcatacgttaaaatgaatgaaatagatttatacctaagaacatggaataaataattaaaacaatattaagagaaaaaagtaagttgcagaatgaggaatactacctatgttattaatatattttaaaaattcatgtacataaacacatcaaaagatggacagaaatgctcaccaagttcattatagtggttgcttcataaaggcaggaaaattagaatagagatgaggagtgagatcaaatttactggtaatgtattatttctttaaaataacttgaaaggataacaaaatatttggaggtaagctcttgtggttttcctgggaatttgtgatgttgttctttggtccttttggtggtaatttaaatgctttttctttataaaaataagaaaagaaacaagaaacggaattaacttcattaattagtgttcctttgtccattgtgggtaagcagtggatctaaactttcattgtttctctttgcaggtaaatgtcactcgtgaagactcaccgagtgaagacccagtctttcttagaactttaggaaaaggagactggtttggagagaaagccttgcaggggtaagtagatcatgtgttatacaggtttttgtttgagtgctacataaatttctgtctgaaattttgagctcctagcacaataggctttttatttagtgcttatctcaatatcaaatatggacccttgatgataaatacatttttatttattttcagctggacttggaatctgtttgaatacgttgtggaataaattccttaatttctaataaatcagtgttatattaattggaaacattttcaggtttgtgtccttaattgcaatctctataacaacttcaaagagaggaattccctgctaaactttgtgcaatgattttactcagaatcattaagatagttggttgaaatttttgaaatccctaaacctgtttgtacaaacaattgttatggggtctttggggtgtcaatttcctggctggaaacctgtggctggtgggcgccttcacctgagttttgcttgggcccattgggctcattatgcccacttggcctggcaggttgcattcagttcacactaccgacctggttcccacatcttcaagggagactgcaagtcaggcgtgaagtggcaaggggcacgtgagcgagtgtggggtctggccactgcacaggcaaacaaactggctgctgccgtgaggtgggcagctccaggtgctggcatgggatctttgtaaggctgcggccgaaccaggcacaccacaagcagcttccccggctagcatcagggaatgtggtcgtgcctggaagcttagagacaccaggaactgcatagccccaaagcgggagtcacagccctggctcggggagctcccaggtctgggccccccaaagggctgcagctcttctctccttgtcttcacttacaatgtggcaagcaaggggcatgtttcagccctgtttgtattacaactcttttagcctcaccattcagtggttcccgatttcttgacctgtgaccgggaagaatgtggtacgcagacaagtggaggttgaacaggacaaagaggagctttattgaacactagaatagctcagagaaaacctgcagtgggcagcccctctccacagccaaggtgtcccaatgtgtgttcagctcttagcagagagggtagctcctctctgtaggcaggtcgtcccaatgagtgttcagttgtcaacagagagggtagctcctctctgcagctggtcatcccatcatctgcagctctcagcagagaggaggccctagagtgggtagctcctctctgcagctggtcatcccaatatctgctctgctctggttaagcctggggcttttatgggcctcagaggggcagaaatacatgctgattggttcatgagtggcaataggcaggtccagaaaaggcactgcaagttcccactcttgtccatgggactggcagcctggcctccagccttcaggccctccctggtctgaaggtggggccttaatggggatccaccacgtttctgcccaggaacctgtctgcctcctgctgccattcatgacacccaggctgtaggtgccaggggcacctgcaggccagcaccaagctgccgtcagcccaccactggattccctcctatgctcattggcacccaaagcccagaggggggtgagttgtcaggggactggcatgccagcactgccctgagcatgtgcacacctggccggactgtgacagtgcctgggctcagtcccaactttcctccaaaatcagaataggagccaaaaacagagagaagccaggcagtgggagcaggcacctctgatcctgtgagggccagggggcccttcccagacccctaagagtgcagaaatgcctgggtctagctacctccaagagggcagggatcttgtcagctcctagtcccccaacagcacaggggaggcccgggtccatggccgtgacttcgggcagctgtagctgcaccggggagaaaagggctcctgcttccccctgcctgcccatgacttgggtggctgcagccttgccctggaagacagggctcctgcctcctcccagccccaggagcacagggatgcctgggcccacagtcgtggcttaggcagctgcagtggtacccagggagctcccatcccaactcagaaggggtgggggtccctcctgtccccggctcctgctggctccatgggtgtgcagacctggccatacctccctgctgcacccagtgtgatggcagcagcagctccagatggcctgccactgccatcacaatgatcacaaggcagtgaagtatttccagggttcacttgtaggtcataattgtcatcactcttatggtggtagaggtggaagagtaggtggaggtaatgtacatctggattcactatgggataggctgtgaaggctagactagtagaggtgtacttctgtgagactgatactctatttttaaactaagacatcaagaagcaagcacttgggggttcttctcatgtatcatgaaggaaaaactgagttgactttttaccatgcattttacagaatgcatgataaaaatatttgggtatcctactctcattttccaataaccagtatatctcagttatcattaaatatagataagccttttcaacattcagtgctgtatgtatatacactacttgaataagcaacaaccaataaacatttatttttctatcgaatttcaggtacaggagtgtctcctagggagggacagcaataggacatgatttactcctagcatatgggaacagtcagttctgttttcatttcaaattgtgccttcatttaaaaaattacattatgagcctttttcttcaaagtacttctaagaagtaatttaggaagttattgttttttaagccacaatcagatgacaggttttattttctttctatttcacagcttaataagtgaaataaagatattctgataaatcatcttactcaggctatattaccttatgaaaattcagaagtaactacactcaactttccttttttctcctactgagttcattttatccttatctgatgaacatatagttgccattagatttttttcaatgtcaaagttggaaaaaatagtatttttggtgtagatatacagaagagtgaaataaacattatctttctagtataaatgtatcatctgtatcttaatcttgctttcctttgattattaaatgtgtcaaaagatggcattttatagaaatcaggtggcattttatagaaagacgccacctgatttcattggtccaagattaaatacctctgtggaaaacaatgttatttccaacagaatcaaagaaccagaaatatttacaaactgaggtcgcaagtggaatgccagaaaataaggccccactctttctcttcacatctaccccttacccccatttcctcacatctctttcttatgctgttattctcactttctcgctatggaacctggttttattagtctactctaagtgccctcttaaatgtcaccagagatttgctagttacctcatgaaatggtccttttatttttttcttcatttgacttcacttctcagccatgattttacattgttgaccaccctttctttctttaaattctccacccttcgggaccctttaaattattggcactctttagaatttatttcatttcctaaaatttgctaatattatgtcctcaactgtatttcataaaccttggtaagctcctccagatatatgattgcataatacctcaatgaaaagaagtcccaaatatttatattcttatttgaacccggtgtctggcacttatcaaatacccacatattttttaacaaatgaatgagtgaatgaatgaatagatgaacaaatgaacctctcgaatgatgtccaatcttaaagtcccttcttccattgatcacattcaggacttgaatttgcctggcagtggataggggttatgagctcgcttgaccatggggggcaggctagcgatgtaaatgactacaataggctagtaaaacaggtggcaaactgggaagtcttatgtgatgaggacggaaattactgaactccagcttgctgctgctctgtaagaatgtaacctcggctttttaagaaaagcagaaaaaaacctagattttaaaaatatgaaatgtgattttgtaatctgattttttaaaaaagctctgtaaaccaacagaccatttctgcaaactctttggcgtgtggatgccattttgtgatttctatcactcagatatgcctctttaaaacctgtcctttgcttcaaatgaaggaagcctattaactcatcttgattattttcttgttttgatgttttgacattttaacattttgatatcctatgcctgtaacttgtttttcactgtgtctaggtttttttaatcttttgtttgcatttcaatatttttcacaagaaattccaacatttcgcaaatcaaattgatttgtttcacttgtttccttctaaataacttagaaattgatataactttgatatataaaatcttttgggcaactgtgtatatcctttgggtaatagctatgcttgtttacaaactatatagtttttatacttggaataaaaattgtagagccagcattctctgtatgtacagaacagaatttcagattgtggttttctcacaaataaaatttgtgtgtactcggaattttggttttattctcttgaagttgttcagcaggcaattaaatattgataagtttctggttggagattgagtgaaatgaatatatgtttgaccattctttttaaatttgagagtgcataaatactagtactgattaagcacacagtagaaaatggaatggcattgccgaaatgtaaactcaacaccctttctccagaactcagcctcatgactactatctagttctgcctctaaaagtaacaagctttattttcttgttggatggagatagtagagtcataaattgagtcatcttataaactgtattattaacatcctttaaccaatagcatcttattattagaaaaatttgagtctctttcactttagttgacataaagcaaattgtgcagtattgtttggctcaagcatcttttttttttttctttccttgctctgataagtgtttatacacaccaaagagagggtaaaatgtttactttttacagaagtactcccttatatatatatgaaaactaaaggtgtgtttaagagcaatcacttcacgtttagttcaataactcataagtcaatccatctatactttgacttaccattgcttcaagatccctacttgaggccgggcgcagtggctcacgcctgtaatcccagcactttgggaggccgagacgggcggatcacgaggtcaggagatcgagaccatcctggctaacacggtgaaaccccgtctctactaaaaatacaaaaatcagccgggcatggtggcgcgtgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaagatccctacttgacttgaaaccatatggaatacatataaacatcagatgatggcaaattctaaaccgaatattcactttgcatctccagtgataggaaatatggtagaccaagttgtacccaaaagggatgggattaagctcccagtagccaccttcctttctttcccctaacttttgagtcttcagcatagcatatggctaagagatccagttcagagccagattgcctgctttggaacttattctgtcatttattaatgattagtcactgagaagaatttcttttatctgaaatggggattatgattacatctaactacttgggttattggaggaggaatcaaaaggatacttacaaagaatttgggtgagtgcatataatttagtttaatgcttccctaaagtgagctgtcatcatcactaccaccatcatctttatctacatcatcatcttcatcatcatcatcatatcatcataccagcactgttctgctaccacttgataaagtttagtgtactggcaaaattgacatagcattagattttgagtcaaccactcattgattgactttcagcaagccagttaagctcctgtaaactaagccaattgaactaggtgatctttaagtttcgttaggtcatagcttctggttctctgagagttggcccttttccacctggaacagacccctgaatgccaagtgcagccctgagttacctgttaaatggtggcatttaataccaaaccactgtcagcaaggaacttccctccaagaactttcccagctgttgcctctcattctgagtacctgtgccacatgccaggccctgttcatgttaatgcaaaaatgaattagccaaagtcagttgaatagacattaatattagaaatctgtatttccttatttgttttcacttcatagtctgtgatcatggaaaagttaattaacatttctgaacttgcttctttgttttatcttctgatgtatatttttttcttttaaaaaattaataaaattttgctgggcatggtggctcatgcttgtaatcccagcacgttggtaggctgaggcaggcaaaccacttgaggtcaggagtttgagaccagcctggccaacatgatgaaacactgtctctactaaaaatacaaaaattatccagttgcgatggcacaagcctgtaattccagctactcggggggctgaagtaggagaatcacttgaacccaggaggtagaggttgcagtgaatgagatcacaccactctcctccagcctgtgagcctgagtgagactccatctcaaaaacaaaaaagaaaagataaaacaataaaattatagtacagaaattaagtactggatatggattttaatatttttccatatttgaatttgattattatttatttatatagaagtaaaatgttatgaaaactattcaagctgcttttgtatcccacccgcgtacttcctctccttcccaatatcaccattctgaagcttattgtatgcatcctcattgctcatgtgtctataaatatgtctataatttattgtgtatatatgtattcatatttgtatttaaaattttacccatgtgaaatattattctgtttcattctcggtcaatatattatttttttcttttccttctattgtcataggcattgcacttatgtcattccttcgtttagaagttttaccttcttctattttaatgattataacctttatatgttaatatgtatatttaacatgtaacactaatcaatagctctattcctctcttgaataataatataatattaagtgtgttaaactccaaattaattactcctaccaatcttctaggtagttttctactggtccccaaatattaatcattattattactgtattttttcagacacaaccaaaacctaattatttaacatttatcaactcgtttacaaattcctttgcccactattgctcctgtaacccacctcatttcttttagatttattctttgaagagatgattggtttataccttctgcccttgcctacacatgagtgaattttgggttaggtgtaaatatctaggtcaaatttcatttgaagtgttattacattgtcttctgacattcatgttctgcagccagtcaaatcaccattcctttgtaggtaaactgtctctctggtagctgtttctgtctttgacattatgcatttttgctataattaatgtaggtacagatatatttatcaataaatgaagaataaaactctgtgcatctccttttgagaatgcagttttttttcaatcctagaaaattctcagcattatttctgcatatattctttcccccgctttctcttttctctcattttgtaacttttagtggcctagacctaacctcatcatcatatgtccttacctccttattcacatttgaatcttctttctctgtgtcattcggtgctacatttttaatagaagctgggcagattgtctcagatggtcatgccattctctacttcttccttcaattgtatcaagtcttcagttcaattaatacactgagtaggttccaatgactattttataaaagtaattttagaagttctacttggtgcatcaaagtgcttaggagtgtgagctctgaaatgagacttcttgggttcaaaccccagctccattgtttatgaaatgtgtgatcttgttgatgttcatctctgtttcagcttcatggtttgtaaaagtagaataatagtgcttgccacatagggtcaaggtgattaataggccaaataatgtatatagtatgtatgcatgttagaataatgtctggcatatactaagtgtttgataaatgtgaggtattattgccattattttattatttttaaatatcttttttcttttcctttatttattcatatttttaattttgattcagaaggtacatgtgcaggtttgttacatgggtgtactgtgtgatgctgaggtttaggcttctaatactcccatggcccaagtagggaacatagtacctaaaaggtagattttcaacccttgcctccatctctgcctcccctcttttcaactctctagtgtctattgttcccatgatggtgttcacatgaactcaatgttcagctcccacttataagtgaaaacatgtgtatttggctttctgtttctgcattaactggtttaggataatggcctccagctgcatcctatgttgctgcaatggacatcttaaatatcttttacattgtttcttatatcatctttttttgctgtatgtcttcagaaattatttttagaatgtcaaattctttgaaactttctgttagtttcacttttggggtgcacattcttccatttgtcacttccaccaactttccttccgtgtgtggtttagtatagctgaggtgtgcttgtcttgggtgggggtgggggtggggttttttggtgtttttattttctaccacatacccattttcagtggagttagtggactgagggattgattttcttgtgctcacgttattgaagcatctctatgtacctattttatatgtttcatatttgcctctgcaaagatacgttttagcttaatatccctgtaacttgaagataacattgaaagaattcagttcttccagttacaaggcttgggtttctgtttctctcagagaaagactcttgacatttacttgggctgacagagagagttatttatactgcgtgtgccttttgtgtcgaaatgctccagggctctggccttatgaaggactcagtcccagtcgccctctcccgtggggccatcaccaggctccttcacccagcccttatgactcctgtgcggctccagcttgtttctccagccttgggacccttctctttccagcacctgagactctcagggtttattgttttgcttttttttttttttttttttttttttacgtttttcattttagtgaatattataattaatttggtttttagtgaagattattctcgtgaggattatagtgaataatctatggaaaaagtaacacaatgtctggtgggaatttttatttctgttgttctggatttgtggctgtccaaaacaaaacaaaacaatacaaaacaaaacaaaaagatgctgtcctctcacttttctggcctgagttattctcctcttcaggatttataaagaggagattaaaataattgatgtactaggtgctataggaaaagcacagagtatcatagtaacattttttctccaccccagaactttttcctacggggcaagtcaacttagctgtcacacaagtatctcacatatcccttggacaaaagtaaactcattttctttccaactccaatcaagtctattctttttcaagtgaatattacatgtgtttatcaaaccagaaatttggacattatccttgactctttcttctcctaaaatttcctctcataataacgaatcctgtttgttctacctcttaaataactctcaacttcaactctcaatctgcttctcaccaccctcatgccactgttcctgttagtgccaccatgatctgtctaaattataggacagccacctaattggtctccctgtgtccagtcttccgcactttttatccattcccctctttgtgatgatgacaaagtatttgtattaagtttcttagtgtggccataataaattacacaaactgggtggctaaaacaatagcaatttattctttcacaggtctgtaggctagacatccaaagtcaaagtgtcaccaggccacactccctttggaagctctagggaggaatctgttccatgcctcactcctagcttttggtggttcccagcagtccttggcattttttgtcttggagctacatcactttagtttctgtcactgtcttcacatggctgttttccctctgcgtgtgcctctgtatcaaaatctttctttatgagaacaccagtcattgaatggagggcccaccctgatccagtatggcagcaccttaacttgatcatatctggaagaccttattttcaaatataattacattcacaggtttgagggctagggcttcgacatatcttttgggagggcacaaatcaactcactacattctctaaagcaaatcgcgtcatgccacttttctcctcaaaggcttgctctggcactccctgttgtgagagctgctcccatatcattgccgcagtctcatgatcagctacatcctgcttcattatctatgctgtaatcatactgagatctgttaggtcctcatcatccccatgatttatttcacttttaggtattcatttgtagtaacattttgtaattcatctgttctggcatgaaagagtggctgaacttacaacaatctccaaatgagatattagaacctggaagtccagcacagcacaggacccaaatacataggcatgtagaagctgacctgttgctctgaagatgcctggacccattatatggaccttaattaaaagatacctgtgatataatggcccattggactttgatgtcaaggaactcattacaggattaatggaaactgtatcctgattttagagaaaacataatgcataaaaaaattatacacacatgcaacctccccttcatatctcaaattattgatatttgtatgggagcgccttagcatttggactagactacttccacaataatcaagattatttaataaacaaaatttgaatccttcctctgaacttctctgaacaccttcacctgaaacatacagttagttgtacaaaaaaattattgttgctgttgtttgaatttacttaataatcttgctaatgttttagtgtgtaccttagactcaagtatgcctaaattcttgatttagctcattataataggtacaaattatcagtaactgaccagtaactaatgttaataaaatacattagttttaagtaagttgggaaattggttttttagaaagcttctgtgaaatgcaaggagatttttgaaagaggacttttcttctagaggaaagctaagggcccgcttacatgaatgactgtttatagaaaagggatcagctttttatagaagattggagaaacatcagggtgtcttagtacttttccataaaatggtttatttatctctactgtctaaaatgtaaggtcattttccgtggtggaaattgagctacttataaaaacaattcagtctctcattgttactctacaacatgtcattcagacaaataattcccttcaggtgccacaagataagaaaaaataatgtaaatttgaaaatcgcttcaaaaatggacataaaaatgtttcacttggagttaattttcttgctaatgaactcagccggtgttttgtgtctctgtcattctcattccttccaagtctaaatgattgcttcttaatttttcctttatacaattgttaataaatcatgacttgctataaatcatactttggacaggcaacaaagattttaattggctagattcactgtcattacactaatcacttctgatgcctacaaaagaaatgctttaaggtcctctaaattcttgccagaaaaaaatttgagtgtaacattactcatgtgttctgattaagactgtatcgcataaaaggagcatttgcaactgtatttggcattgcatggttcttattccttgttcatacaatgaaatggaaatgagaagtatctgagaaaagtatgctatgtgataattgccttatctcctattccaggcatttaggaaaagtgcaagattatttttagaatatttcagtaatatttaaaggactttaagtccactaacttttcctgggccatttcgaaaaatgtcaataaataatcgtataggtacttattatttaatcaagcaacaaacaattagaaattgaaattaaaaataccacttatgatagcatcaaaaactagggagtagttacagataaatttgtaaaagatgtgtaagatctcttcactgaaaattacaaaatgattccaagagaaaactgaagatattacgttcatacgttgtaagacgcagtattattctcctagatggatctatacgctcaccgcaatcccaatcaaaatgttactaagatttttttggttgaaattgacaagatgattttaaaatttatgtggacctagaatttatatggacctaaaatttatatgaacaatttagaaaaaaagaaagtttggaagactaactccatctgacttcaaagcttactttaaagctgcagtagccaaggcagtgtggtattgatatcaagttagacaaatagattgatgtagcagaatgaagagtccataaatcaaccacacatatattgccattttagttagcttagttagctttgccgttacaaaaaatactgtagattaggtggcttaaccaacagaaatttattttctcacagttttaacggctggaagtctgaggtcaagatgctaacattgtcaagttctattgattgccctctccctggcttgcagacacccttctggctttgtgctctcatagccgttcctcagtgaattcatgtagagagagaaaaaccacctgctctctggtatctcttcttgtaagggcactaattccatcatgagggccccactttcatgacctcatctaaacctaaggatctcccaaaggccctgtctctaaatactgtcacattgggggttagggcttcaatatacacatataaatttaaaggggataatttatcaattgattttcaacaaaggttcaaatgcaattcacttaagaaaggtcagattttccacaaatgatgttgaaacaattgaaaatccatcaagaaaaaaatgaacttgaatccataccttgcacgacatacaaaaattaagttaaaatggatcatggacctaaatgtgagatcaaaactacaatcttcaggaaaaaatagacaataaattttgtggactttggttagatgaagatttttacatcaaaacataatctataaaaggaaaaaaaggggccgggcccagtggctcacgcccgtagtcccagcactttggaaggccgaggcaggccaatcactggaggtcaggagttcaagaccagcctggccaacatggcgaaaccctgtctctactaaaaatgcagaaattagttgggcatggtggtgtgcacctgtgatcccagctgctcaggaggctgaggcaggagaatcgcttgaacccaggaggcagaggttgcagtgagctgagaccatgccactgcactccagcctgggcaacagagcaagactctgtcagaagaagaaggagaaggagaaggagaagattttattaaaatgaagaatttctgttttttgacaaacactatttaaagtaggaaaaggcaacccacagactgggagaaaatatttgcaaatcacatatttgaaaaagaacttgattccagaatatatacagagctctcaaatctcaataatgagaaaatgaatagcctaattttttaaaacatccaaattatttgaacagatatttcaccatgaagagaaactaatggcaaataagcaagtgaaaattgtctcaacgtgattagtcattagggaaatgaaaattaaaaccacaaggtagtgccactgcaaacatattagaatatctaaaattaaaaggattgatcatataaagtattggagaggatgtagagtataaaatagtacaacaactttggagaacagtttggcagtttttttttttttaaaacttaaacatattacctaccatctgacccagccattccattcgtaggtatttacatgaaacatgaaagcttacatgcatacaaagacttgtacaaaaatgttatagcagctttatatttaatatctccaaatttgaaacaacagaaatgtgcatcaatagatgaataggtaaacaatggtgctagagccatgcaatgaagtagtatgtagcaataaaaatagtgaaatagtgatgtactcagaaacagattagtatcaaaataattacgatgaaaacttcaaaaatatttacaatgagtgaaataagccagattaaaaaaagtacatgctgtataattctatctatctaagatatctaagatctatctaagatattatctgctttctgtcaccatagattagttgccattctatagaattttatatagagatgacagatggcaggagacagagattataaagggatactaataaacctttgtagatgatggatattttcattatattgatcatggtgacagtaattagaatgtctgcaaatgccaaaagttttcgagttgtacattttaaatgtgcagcttatttaatgtcaattatacctcagtaaatctaatatgacgttttaaaactcactagacagtcgtacccactatcactttcatggttctacacacaggaggctcagagttctctatgcttctattatcaaaacatcttttaataacattttagttctgcagtaggttttactacagtcaccaatagcagaatactttagggctcatttgggtaaatggaattagatgcccatgagtgcaataaactcactgacagtagtaatcatcttctataaaggcatggggttttgaacaagtcaagtaatggataactcgaaccatgcaagcagggataggcaaaagggtcttgtctttgagagtcaatttctgtgcttagaggtgccctcagcagcagtggatgacagttgtctgccgcccagatggccgactgccactctcactgtctactcgacgacatcgttgctgcaagcctgcttcccatatggggaaacatgttgctttgaaaggaacattttccacacacattctgtaagaagaatacaggttttctaccgcctacatccatatgcacttaattcccttagaaacatggatttgctaacctggagaaatagaatttgtttactttaagtcttttacattgtattaccaaacacaaatagtcaagaattgtaaaacatgtacttgaagttaatcttaaaattgataaaattttaaaataaccactaattatttttaaaataatcattttttaaatatatgggggaaagataaatgtatggtttttatgtttctagacctacccaagaatagtaaggatttgagattgcggaaaataataggttatagaaactttcctacaagaaactattgacatttcatatcattctaacttcctacatgtgtacactattccatacactaccatgagctaacctatgataatcatgtccctgtatgcacctgagaggtaacaaaaagattaagccagctgtcacacaccagagactaccatataccacaattatttttattgcttctcattttaactgctattcttattcaaaggaagactggataaattattctgtcactagcaacaacaatttcattaattttccatttgctaaagcagagtgagtcattacgaactggaatataaatcttacagtttctccttctagcagtgtctaaatatcctgaaaagtgctgcttaaccaaataattttatttaaagtagcaagactatatgtgtttatgagaatgggaaataatttttacaagagtgatgagatagtttgtatttacagtttttattatccctttcaatgttcagaaatggatcatggatcctgggtctcccatgagaatagagttggatgtgcctacaggcaaatatcatgggagaatagcctctactggcattttaatttctttctcaaatgcattaattgctcttcaaacagtttcctctgttaagaacacttacatttacctggtcacccaggcttgaacattaaggacaacctctgaaacagccctctgtgtcatagctctccttcttcatctttggacatcaaattttattgacagttcttccacagcatttctcccattcattcatttatctcttttaacaccttttccactgtaattcagatcttttcttgacctgtagttcattctattagatgtgcatggttttttttcatcatatcccagtatatcaaagcaccacaacactagactcaggcagtaggacccctgcccgaagcctgagctttaagttttagattccagaggccctcttctgctgtgcctcttccctaagaaaaaaagaatctttggggtcagacagatatgtccatatgaagcctgcacatctccttctagatcatcctttaggaacctgagactcgtgacttctgtttccctctgaggccagggaaagttctttcctgtgtccttcctagtaaaagttgagcacagcagttgtgtgtatcctagaggcaaggttcactgtttaactggggtgggagaagcaagtggaccatttcttatcctaccccagttggatatgtgggctactcatggtttgttagaaagcaggagatagctggtagagggggaccagggtcacctattgccatatggttatgattctggcctgcacttggaattctgaagaacaaaaaaattctggtttgaatttagtcttccagattattgagaaatatttttcaaggtaggaggatacttttacattattagatatatggtatgggggcctccatttacagtcttgctgtaggccccatacatgctaataagtgctagggcaggctgtcccatgataggtccataaagaaaagctgttctgatggtagcacagctttctccaaagcactttgttatatcccagtgcccactaaataaacaccaaatttattattttgaacttcaagtcctacgacacagctccaaatctacttctttggctttatctaccactatactagaataaaaacctaaattctcaagaaatatggattataatattaaccattcctgagaccctgacactgttctgcctctgcgtatttaaatataacattccttttgcctctgtgctatttcatgctgcatccaatatccacttataaggtcctgctcatccttcttgatttagtttgagcaacttctccatgatgtttttttcatgagtatctaaccaaaagtgatccttatccattaagagctggcccatgtcccgtctttgaatccaacaaaacaaatatgccagtacccttctaaaagttttctaaacatatgttgaattattttgttacatttttcaatgcaaaaaaaaacttcgtaaagatggtaatatttttttctcctatttttcttctcaaaatatgctaatttaggagtccatgaaatgaaggcaagcaaactgagacttagtacataaactagttcggtaaggggcttaatttggttgataagtacaaaagtaaggcctacagaatcttctggattcccactgagttgattactatctattttttaatcttaaattgctatttggtatttgttttgtgtatcatacaaaaacattgacttttattttctcctttttttattattctgttaaagtttttaaaatgaatttaatttatttaaagtctctagcatttttgagaataataataatattaatctggtgatataatagatgctgtggtatgccaccaagatcacttttaagaccatgtcattcctctagctgtccagagtgttgattactgtgagcttgattccctggcctcaattagaacaattctgcagggctatttactctaaaactcctgatagaataggctgaggcctctgttgcaattgcatcatagctcaacttctccctgtgttcagtccggcttccttcaccccaataggtgttgctgctgagcaccctcttcaacacaccacttgcaaacacatttcagagtctcagatattgtttctcaggaaacccaacgtacaatgtgtgatgtttaccttgaaattaaatttcttgtaaaatgtgtgttgaatagaaactttggagttaatgtggtacaataaaaaatactggggatcaggcaaagacacgcatgtctggatttgaatttctgatttctgattgacttgttccattatctgagctagctacttaaaccttctgactcctaatttcattattattgaaatcataatagttgcttaccatgcagggttcatataagtgttaaatgagagaagtaaaacacccatcaacattatctgatgctttgtagacagatcctgataaatgttagttactatatatctctcccctcctcacaccacctagctaaaaagtcaaatttgtgtcttcaattaaggtaggaattctataacatatcttaatttgattgattaatcataattcattcaatacttaccatatgccatgtacgatgtaggcatttgggaaatactgatggagaagcaaaacatgtttcttcatggatcttacattctgaggtaaggagtaacgagaaaaagaagctagaagatgacgagagctcaggataaaatggagcagggtaagggtgaacaaggtggtaggttggaggaatttgcaattttaagtagggtggtcggtatggtcctcattgagaaagtgatatttcagcaaagatttgaaggagataagaaagtgagccacagctatctgagagaagaatgtttcttgtcctgacaataggggtctcattaaatctacttgatattgtggataaactgaccatttaatatccgtattagtccattctcatgctgctataaagaactgcctgagattgggtaacttataaagaagagatgtttaattgactcacagttctgcgtggctagggaagcctcaggaaacttacaatcatggtgtacagggaagcaaacacatccttcttcacatgaaggcggcaagaagaagtactgagcgaaagggggaataaaaccccttttatttaataaatcacatcttgtgacaaatgactcagtatcgaaagaacagcagcacagggtaaccacccccatgattaaattacctcccattgggtccctcccgcaacatatggggattatgggaactaccattcaggatgagatttgggtggggacacagccaaaccatatcattacatcctttctcatctctgagccttggcataagttgcccactctacctagaaggccctttaacatacctattactgtgcttaaacatgtttaacagccagctctctgtaggacaggagagaaagctctggtgattgcatgtttctgtggtgtaaataaccctatcatgaccatgttaccaatgtggtggcatggaaagtgaaattggaaagagatgcaaattgtctctggcaagctggtgtgagggagctctaacacagtattgtacttgatttacttctcacagggtgtcacctgtttgaagttctctctgctgtagctcttatcccattatggtttgataccattgttctgccttccgaaagcacacacattcttttttctgtcataacactttcatattttgcctgcccatttatccaaaacacttgaccattttaagaggatgatcatttttacattaggggtatttagcgtagtttctgacatagagtaggaacatatagtatatttttaaataaccaatttcagtaggtttgtgttttaaaaattttttgcttctaataattgatgacaagaaagaattattattttagagtaataatgatatttagattatgatgttaaagaaagcttatatcttttagagatatatgctggatatttgcaggaaaaaaatacacggattatggatttgcttctgaataatcgagtggtgtggtgggtgaggggatatggaagaaaagattggccagaaattcgtcatttttgaaactgaatgacaggcacactgtcatttattctctttttttctctttagtgttatatatgtttgaaaaattccatagcacactgtaaataaattcattctaatttacttaatttgatgtttttcgtaaattgaactttgggccaggtacaacatcgttctttgcataattttactgttagaaaattacattgagcatggaatcacaattccattaattgatttttgaagtagttaatatttggtaaccactaatataattatcttgataatatatttacttttcagccctaattgccctggaaagatattgtatagttgattaaggaaaacaaacaaatgtacaaaacaaaacataacaaaacaaaaaattatgtgatccggaacactttagaacaggaccggaacataatattctatgcagtcctttcttggcttaaatagtgttacagaagtttttattcatatttacatgtttaattcctatcagttaaaaatgattagtcaggaaattattcatgtaaaattgccgctttgagttattttacaaaagtggttttctgacagacgcaagggagagatttatgagaggcaagtataaagcaaaatctattttttcagtggctgcacatacctaccctgagtgttttacctaaagagttcaaggatggatgtgaaattgcctaggaaattagatgtagatttattttatgttaaacctgagtgtaaagaatatgttttagtctagcaatattagtaaatattgctacaagtataaagaagcaaatcatgtctacaggggctggaagatcagtgggtactaaaacgaaatcttttgtggcttattctcttctatctgggcagaattttaagtaactgttttacatttcaaattcaagtttacatgaatacataataattaaatcacatttgatattgatggactataaggaactttgctaaaagaatatagacaggactctggggaatttctacaagggaaatagcggattttaatatttgctcataagatagcccaactttacaaggagttcattagaagatgattagcagtgcatttaaaatgcttgatagggtctggtttttaaaaaggagcagtaaggttttcttactgctgtaatacttaataaaatgcatttcatttacacaacacaatgaaacaaatatctgctcaactaagatgctttcaagacaaatgagatgaaagtttttgcagtttcaaatttcattatctttattcattcacttccaacaagacctgattctactaagactcaaatttgaaatatttattgccttgagatatattgccatgtttttcacaaatttgaaaaagttgcaaattaacgtagaagttgcaagattaacacaggaaactcccttatacatttactcaatttcaccggttactgacattttgctacatttgtttcatcttctctttctctaatatattgatataaacatgtgtttttataatatacagatatatacttttttcctgcagtatttgagaacaagttcaatcgttcacccttttctccctaatgtcccaatatatgtcactcaggaacaaggaagttttcttatgtaatgactatacagttaacaagttcaagaaatttgacatagatataatagtttatctagttaacagccccatgccaattttgcaagttgtctcaataatgttctttatgacaccttttttgtccagttttcaagccagtccaggatcaaatattatattcagatgttatgtcgcttaggtatcctttaatctgaaactatgcgacagctttctttgtcttggtgcagatattttttgaggaccacagagaagttatttattttacattgtcactcaatttgagtttatctgatatttcctcatgactacattgaggttatgtattctttgccagaatattatataagtgacgttgtattcttcccagggtatcaaacacattaggaaccacacgactgtctctcactggtgatattaatttagatctttcagctaggtcattgctcagagtttccactgtgtagtggagaataaccttttcccttgcaactaataaacaacctgtaaggaaactcttaaagagcatgcaaatgttctgctctgcatcaaattattctccctccctccctccctcccactttgatttagcatccattgatgaagatttcttcctttcagaagaaatatttttaacaatgactgcaaaaggacgattttctaactcatctactttcactgctggaagtccttcattcttttccttccaattaattatcaatatggactggtggattactattgtgttcaatggctgatcaattactttgattctcaaattgtcccagacttgactgggataatccgttcaaagtggctttgtgtccttttgacatgcccacatcattttttttcctcatgagcactttcttgttataataatctgtatcactctcaacttttatattttctgtctcaactttggagtcaagggctataagagccctgattctttttaatatggaatgatacttaaaaaccaatatctgtatattaaatgtgctcacggctacttgggtacaattacaattcactggaccaaatgtaggaaatttgtgtgtgtatgtgttcatcccattccctcagaattccttcttgtatcccctattttatatttgcattccccctttccctggttcctaacataaacatatttactctttttttcagtcctatattaaatgtaaaagttccagaattgtgacatgcatagcagcccaaaaatctagtaaaaaaagttaagcttcatttgcagttttttccctttacatgagattctacagtcaaagtactgggttcacatgttacctgaattactttttttctcccttttgtttgatcatgttatttatttgaaatattgctgaattcatatatttctgtctgattcacttcaggtctttttcctcttgtttaattttctgttttgaatgtgtactatgcttttaatgtcaaaattattccaaaaaaaagtttactcagagatcattccctccccatcctttccaccctgttctccttccacctcttataggaaaccagttgcattcttttccttatctttatctttcttgtatttctttttgtaaaagtgagtagatacatgtctgttttctagttacctctttcttacactaaaagtagcacactatacacttttttgaactttatttttctcagtatattttagaaattatatgagtttataggtatgatttttttttttttttttgagacagtctcgctctatcacccaggctgaagtgcagtgttgcaatcttggctcactgcaacctctgcttcccagattgaagcaattttcctgcctcagcctcctgaatagctaggattacaggagagcatcaccacacccagctaatttttgtatttttagtagagacagggtttcaccgtgttggccaggctagtctcaaactcctgacctcaagtgatctgcccaccttggccttgattttcatttttatagccctttagtgctccgttgtgtttatgtaccctaattccctcaaacaattcgctatatgtgggcatttgaacagtgtattagtctgttctcacactgcaaataaatacataccctaaactgggtaatttataaaggaaagatgtttaattgactcgcagttccgcagggctggggaaacctcaggaaacttacagtcatggcagaagaggaagcaaacatgtcctttttcacatggcagcagcaaggagaagtgccgagtaaaagggagaaaagccccttatgaaaccatcagatcttgtgagaactcactcactgtcatgagggtaaccgccccataattcaattgcctcctactgggtccttcccatgacatgtggggattataggaactacaattcaagatgatatttgggtggggacacagccaaaccatgccagatactttccaataataaaaaacaactgcatttttctccagcaacgtatgaggggatttgttccgtaaagccttgcaaatagggtatcttgtaaacttttgacattttgccaattcgatggataagaactgttatctcagtgtagtttttcaatttttatttttaattgtgaatgaaattgataatttaaaaatatattttgttaattccttggtcatgatttttgcccatttccctacaggacttttggacttcagttctacatttttaaggtttcttatctattagaaaatttatctttttttgagaaatattccacatatttttcacaatttatgatttatctttgactttgcttgtgatttttcctcatgcacaaatttgttttgatttttatttagtcatttttataaatcttgtctttaattgtatctagatttaaagtcatagtcagaaaaccttttccatgttttagagaaatttactcacattttcttacagtacttatatactttaatattttgtgctacactggttttaacacaaataatacatttttagataaatcagaataaagctacatttatgccactaaattgcatctggcaaccaagaacagagtgaatttggctattcttaggttttttttggtaggagtgtctgagaaattgtgaactgtagttaagaattctcttatttcactaaagctatttccttttcaaaatagagaaaaagcaaaacttattttttcctcaatagtaaggagacaaaataggacaccatgtttcaataaggaaactgcatgatatgcatgaaaatttcttgaaacactgagcacagtcatttcttccccactccttcatcaaggactaatgaacttagaaaactgagtggtaattctcaagtgcatcccatactcccaccctacctagggaaagtcagaaaatgtgccataagtgtttcacatcctgcttaactctaatctgtggatgggacatcattcagattaacctttatatatgcatattactttttaaggttaaacaaaaggaattatagtatacactcagttctttgccttatttttttaatttaaaaatttgaaaaacttcacatccacaaaaatgccttgttctttttaatgactaaatattatttaataaaatactatttaatgaggaaatagtttgtttacaatatcaaacagtatattatttatgtttattaatatataataaattgatattattttatatatttatatattcaatttaacttagactttcttgatgggtgctatggtttgaatgttgtgtcctcttcaaaatccatgttgaaactgaattcccaatacaacagtactacgagatagaatctttaagaggtgtgaaagggctggaggaaactagcagggactttttgccttctatctcctgtgctgtgtgtgaacacagcgttcatgtctttttcccttccatctcccagtgtgtgaggacacagtaacagggtgccatcttggaagcagatgctgggtccttaccagacactgaacttgccagcaccttgatcttggacttcccaacctctagaactgtaagaagtaaattccagtctcaggtattgtgttatggcagcagaaacagactgaaaatgagcattatttgtttctatgttattaatattacaaaaatgatgcccaatcacccttaaatattccactatgtaccatctgaaaacaaatacacgctgttgcacactgaccctcctaatcagaaaatcaataatgatgcattaccattcaatccatagatcatattacataaacaaagggtgtatggcacatgagtgattgaaactttatttcagatgtatttctgtatttaaaaaatgttatacaatgaacacgttatttttagagtcagaaaaatattttaaaatatcaagtttttttggtctctttaagccttactaaataaggagataaatgaaattatgttaaatatctggccatttaattaagtaggatcggaaccaggtggtaattccaaattatgctgagctcttagattaactgggtaacttgacttttaaaaaaggtttcacttcaaagggcagaatggaattcaacaactagcaactagcaagagtaacaaaaatcaaaccatgggtaagcatggtacccacagctgtgaaaaatgcattttataattttttgttatctaatcctgtcttcttgaattacatttggttggccattctcagcaacaaattgatgaaaaaattctcctctaagttagtagactagttagtataatttggtcattaagatgtatcaagttgagatttttattttggtcccacatccagatgtttattttatcttatatacatgtgctaatagatgagatgataatagaaagatcttacaagatatactatacctaatgagatccaggtttcttactatcagagagagaagttacaaattaagcaaggaaggaagtctggtttagaagtagagatgtcagtatgaatgcagataagtagagaaacaagttcagatatatttatatacatgggttagcaaacatattttctagttctgttcacttaagggcctagaagcagtgacaccctcatagcaaccaaccaacacatctagggcttagattattgtttctttccttcttttttttttttttttttttttttgagatggagtcttgctctgttgccaggctggagtgcagtggagtggcacaatctcggctcactgcaacctctgcctgccacgttcaagtgattctcctgcttcagcctcccgagtagctggaactacaggcatgtgccaccatgcctagctagttttcgtatttttagtagaaatggggtttcaccttgttggccaggatggtctcgatctcttgacctcgtgatccacctgccttgccctctcaaagtgttgggattacaggcgtgagccaccacacccggcctagattgttgtttctaaataccattactccataaagaaaccagaactccttggagaaatggctaattctatacctggggtaggaaattataagatgatcctggggtatcttgtagtgctagaaaggaaggaatgattttttttttaaatggctacatacaaaaaagacattggaggcaacctgaaagagctcccaatgggcaaagctaaaacaatttgtgtaacaaaataaattataatagtattggattgcaaaccatataataaaataaatgttcataagtccctacagatacaagtaatttatttataaataaataaatactgaataaataagtgagaagaggtaaatatgccttacagaataattctaattaataaatgtagaagaaataagggaaatagaaaatcatcattggatcatcacagttaataattgctgcaggcaagatccactgaaaatggttaaaattaatgagttcaaactttaaggtgaaaggggatatttgcatagccttaaactatctccctcaatatatttgttaattaccatagtccttctaacatgtgtccacataaacattttgacaagtaaatgttatttgaatgtggtaggtaactattaattagaatgcctttttccactaacttttatggcaggttatcagttttaaggtttaatcaattagcacattacataaaatgagtattgaggtataaataaatgagaaattgctgatgatcaaaccagtccatttttgccttctgctaaaatattaatgtcaacctgtgaaaattaccaagtacatttgtcaatgctttgttcttctactcttattgacatacctgtgttagttttctattgctgcataacacattaccatgagtttcgaggactgaaaacaacattcatttattgtctcacagttctgtgagtcagaagtctcagtgggcttggctgaattctctgctgagggtctcaggagtctgtaatgaaggtgccgggctcttgtctgttgtaatctctgagggaaaaatctgcttttaaggtcattccggttgttggcagaatttaattccttgaagttgtgaaattgaggccccccttttcttgtcaaatggcttcctccatctttaagctagcaaaggtgactattcccttgtttagaatctgtctttcttcccttcttctactagttagagaagactcttggttttttaaagggattgtgtaattagatcagacccacttagataatctccctatcttaagatcaactgtgccatataacgtaacccaatagtgggagggatgttgcatcaaactcatagatcctggagaatccagggaaatatatctttgaagagttatttcagaaattctgcctaccacaataacatcttgtctaatctttacagttatgtctttcattcagtcttgttcctaacatgtggacaaattaaatggagataaaagtgtcccctttgactaatatgatattttagacatttgcaaacagtatgggccatcatgttggttttcatcagtgggttaaacagtcttgggttgcgtcagatttgtttttattttgtagagatttaaatgtgagaaaactatatcaaagcagaaatgttctaaagaagacatttgaggtgtcctcattgtgaaatcaaagcatgcattaaagtggtgataggaaagtaacgaaggagcaaaccttaatgcacattcatggaattttgatattcatcctctggtgcagcaatcccaaatgtacaataatcatctttttgaaagcgaatcagatatttattgttctgtataaggaaagagtttgagaaagtagggctgacttgatgtcacggtatgactacttctgggcaaaaacttctcctggggttaccagcgtttccttcttgattgctaatgaggctgcattgtgagcatgagcacttagtatttaacttgtggttcctatattaaacccagtagattatctccattgttcttcacacctaataggcaggttggttagacttttattatgccttaattttacctgttagggaggatgactcataaggggtatgacaatacgcattttaggtaagaacatctcatatcatctcttcagatttgctccagcctatttatgtgtaaagtaacagcctaccgacatacactaaattttattttaaataaaatttcctatgctttttgttatatttgtagtgtaggtttccgtgagtactaaaatttgaaggctagtaactgaaaatagacttttgtgtgtgtaatattcctaagaacacactgaaaaaaaccccagttctgacataaagtttgattcttttccttgtgatgtggaagctgctgatattctttggtcatccttctatgtctgattacatttctgagttgtaaccttacccccttcagcatagagtcctgtggtgttaagagtttactctggcaagcactttgattgatacttgatccaacttgtgtcctctcaagggcaataaaggatctacaaaatgtagaagacttcacataaaattaagcacatcaaatacaatttaaatatgaaaatattcttgtattgtataatgctttaagttttactggttagcaaaatgatgttttaaaccaaatttctattttgtgtgtgtgttttaccattgggaagattgttaagaactcaagataaaagcagaatgttgagccaaattgtggtacacaaactgaaaaatcaatttgcatggtaagtatggttttatctgcataattattttcttgttaattgtagggtgaaacggccttagacaaaattcttagaggcctgtaaaatgtggactgtagaatcctggttttgaatcccaattattagcaatgtgagtgtgactagataaatgaaacttggttcttttcagtaaaatgggatgataatcttagtaccccatgaaatgtgattgttcaagaaaaccttggatgtagaaccactgttagggtttcctggcacttgtttaactttcattgttagaaatacatgacaaatattatattggaacataaagaagtgaagattactacgtaatagagacgttttgtttctttaggtgaaaattcaagtgactctttaagctgtcttaatagaaataagatgtttctgaaatctttttaaaaagaagtggtcaaataactgttatcctttctgagttccttgcatttttccatttgtcagagaaaataacttaaaagtgaaataaatttcatctagctctagctacttaaggaatttaggtgctctggcattaatattttatgcaaaagcaaattgttttgaaaatgtacatgtgaaagtaaagaaaaaacaccatgaaagcaagcctcaaaaacaaaatcaatgtgaacttctttacaggaaaaggaatttttcttttaacctttaaaattgcctctaataatagatggatgacaggcaattatctgatttaaagtaaaacatattaatgcctgccttgttcagatagctcttgcaaaaaattttcttctttgttttgaattatgcaaataatcacctctgtttattacttccatttgttagtgtaggtgttgccttagtctagatcacagcaaaaattgagctttttggaggcatcctaagaaacccaactgttatatatcatgtgggaagagctgtagtagagtggagcttaaccttctatagttttaaactctgaaaactatagactcttctacaaaaaataaattcccatatacagaaaattatgcacacagcggaggagcttacagacattccaaaacctgccagtgaaaaccagattaagaacccctatggttgcagaaatcaacttgctactatttcccagacaaattggagagttgttatttagcaagcaccttgagatgtatattaaagattctaaaaaagaaaatcatacaaactggggaaaatgtttgcttaggggtctatttctttaatatagaatagattaatgaaagaactgtcttgaaaatatggtaaatattcttgtagttgtattatgcttgacaaaatgatgttttaggcacagtgaaggatttgaaattcacctagatctgtataaaaacaaatttatgcaatcattcctactattactagtttagttcatacgttttcattcttcctcatttgtcaataatactgctaatacatttcctttgtcagctgctaagctaatttctttttttgatatttttatttaatcactatacattaatttgtactcatatcacttgatgctctctctctctctcttttatctctcatttatataaacccattatttcatttcttttattttatatcaccaccgttcatatatttaaacattaaaaccaaagaattctccctcatgttcattactatcttagtctgctcaagctgtcacaacaaaatactgtagcctgaatggcttaaacaagagaaatttatttcctcttgattctagagtttcaaaagtctgagatcaggatgccagcatggtaagttctggtgagacctctcttcctggcttgcagacagctgccttcttgctgtgtgctcacagggctggtgtgggacaggcatctgcacaagctctcttgtttcttctcttataaggacattaatcccatcttgaggaccctactacactcatggcctcatgtagagctaaatacctcccaagaccccatctccaaagattatcacactggcagttagggcttcaacctatgaatttgagaggtcacaattcagtcactatcaactgcatttgaattggagtgttttcttgtagggttcaaactccttgggaccatttcatgcttatcttttctcaaagactgctgctttttggccactggattctgctagcacaactcatttattcattaacagcctctaagccacctgccaggccccacactatctgcacctctgcccctgcaccagctttgttttacttctcccctctatagccacagtgggcttccttgctgattcttaaacataccaggcactctggcctttaagctttgcccctgttatttcctctgcctggcatattctttcccagtatatcttcttgatatactaaattcctcattttctttaagtcttggttcaaatatcactctctcaatgagaactactctgacaccttatttaattctgctcccttctcccacatgcccagtgcccttatccctaattattttatcctggtctctatattgtttccatagtacttatactttgatatattatgtaatatgtttatttattttagttgttcattttcacctcctaactgtgccctccctgaaccaccaaacatatgcaaaatagaatgtaagcaccatgagggttgaaggcagggatctttgtctcctttgtttattgttaggtcccaaatttctataaccatgcctaacagtagccatttaataaatatgctttaacaatattaagtgaatttatgtatttaatattgagccagttgctagatgcagaaatgaaatctacagccccatcatcctaaggagtgtgtagcctagaaacaaagacaagcaaacaaatggcatctattgattgcatatgatctgtgagtactttggagatacattgttgagcaaaacccaaggaggttatagctttcatgttgctcaaatttagctagtgatcaggtttactacgaatgtaatgtactttctaactagtgatacgttagtgatatgttagccttgatatgcaaggtgctgtgggaccatagctgtgagtggttgaagtagtcagagagtgattccccagacaggtagccctgggaagtgagcagtctgtaaggcaggcaattaagtgaggagtctgtgaacaaggagtctgggggagagcattccagagggagcaacatctgtacttagaggctgtagggtctctgtatctattcccaatttagtgccttacttcttggctcctgtcactgatacgttttgtactctctggtgctacatcttctaagaattcctctttaaacaaaggtctcagactgtaggctttagatgtgtttttgtaatcaacctaatgtttataagcgttaaaaccaaaatttaaacatctaggcacttttatataagcacatctgggttctctttaaaaatctgatgaatgggtagcactggctcacagcctgacatggcagcacctgcatgtagggaacataccctcccatttatcctggtccacaacttacccagcttctgcaggtttctgagtttttgaatcttgcactgaaacaggaaaccaacttgctccttgtaatgtgcaacttcctctgctttgttgcatttccacccttcttaagccctcttccatatattccttgggaaaatgcagtaaaaacagttggacacttgcttcgacactagcttcttcctttaagtagactgcagttagcgtcattgttccatctcaagactccctgtgactttgcattaattttctgaatccttggctctatagggatgatgatgatgttggtatgtgtgtgtgtttgtacatctatgcacgcagatttaatataatacacatataattttttgttttaaaattgagtcattttactatagtaaaattaaagtgaactcccttgggctattatttaatacctaggaaggcaaattggatttattatggattctactacaatgtaatattgtaagtttctgttgttatccttgttattattattaacttacatgtaatggctgcttgctctgggctggatacagagttaaggacttagtatgcattatctaagttaattcttaggactctggggtagatcttagttcccatattccatggattagaaagttaaaaatcagatagattaaataaaattgtcaagttatacagttaaaaatcagacagattcaataaaattgttgagttatacagcttaagatacagaattgaaatttgaacctagcttatatgacatagatccaggggtccctcccactctaggcagaaaataggcccatttttgcctatttagctactagttaataactcatttttgacttttaaagcatgccctaacatacattgtgtcatttatttgctttggaggaaaagaaggtaagaatgagttctgatgagtgtctattatctaccattttagttctatataccaattgttgaatatttgattagtaactattcagtagaatatatgggtgttgttttgcattttttattaatatatgatttattaaatgaaattactgtgttaatatttgttttaaagatttaatgattctagaatagtcttcattgataagataaccaaaatttaatctagccagtgctatatcttttcagttcagcatttgttttgttttgtttttctttgatactttgatattatactttactcatggtatttaataaactcagttcattaacatcttctgcaaactaattgattctccataagagggctttgtgttcttgtcaattatttgatgtcttcacaagattaggtatcattacatcctaaagctaattattttgcgaatggtgtggtgattttaataggcctaatatatatatatatatatatatgtacagattgctgatagctttttaaaaatcaagatgtcctttgaagatgctatgaatcattaccattaatttctgaggtacttagtcattatagggcataatgctttgtgccttagggaacaaaaatggagattgtaaaccataaaactctctaaaggtaaggttttcttatttttatttgcttagctatcaagtacattgctatatagaacatttatcatatagaatgtgaagataaaatacataaattttggtctaataaggaaaaaatttagttgagaaaaagttccatgcagttgcaaagttaaaaggaagaaaatgttacagtaggttaattcagcatgtactgaaaatactcatttaataactgaagcaataatcatttctatgtcaagaagataccacaaatgttttttattatgataattttcatttcacaaaaataatacattttgatagccctttgttccttgtaaagtcagtttctacagttccctctaattacattaatttatcatgaatcctgagtaaacatgtccctgaattactgatggaggttttataggagcgtagtgaatatttaactccctttttgagagagtcatggctgatttatagcaataacctgaatagggttgcttttacatttctctaatgtatattaagcacttttgagatccaggtactgcataaaatgtagggaaacaatacaaataaaaagcaggaaagacagatgtgtaaataggccgggcgcggtggctcacgcctgtaatcccagcacttggggaggccgagagaggtggataacgtgaggtcaggagttcgagatagatgtgtaaatagatgtataaatgtaaaattgagaatgagaagctttgagctttgaaagtgtcaaaagtaatgtgaaaatacataggagagtgcctaatccaggctggatcagaaaatgggaatttgggaagaatagctgatacctaaatgagtgttaggaggatgagtagcccttcattcccaatccctgaaaagtgagtggttatgatgagtgggtgagaaatgtgttcaaatggtctaagtatctaaataacaaacctatgagggactataattagttggttccatgaatgcctttataataaaagaatccaaatgtaaagctgtatgagcagaaggtaaaggaagcaattcactccagggagataccagagaaatttaacaacaaaaatttctaattagcttaatcttctttggctatatttcttaaacaattttagtaagggatgacatggtaagaaaagagcaggatcataaaatagctggactgttacaagttggcttctgtacagataattatggaatcccgcagttacacagaatactttcaaagataatctgtttgtaaaattacagtgtaatctcatttttttattggctttcacttgtggctacctgtagtagtggaaagttttgatatgtatcaaatggagaggaaaatggtagaacatttaaaaaaacgcttaaacactgctcttccaaagtgtcctgaaagagagttacgatgagtcattcttttacagaagtacgagatgaataatttgtaagaatcagagtctaggaagagatttttccctgtgataagtcttagaaagaccactttgtcttagcatcattctctaactatgaagacactatgtcacacagtattttgacacaggccttattgtggatcctcttttctctatggtttttctttaaaatacatgtaatcctgggaggggtaacaggtcggagtaggagagtagggtttgagatatgtgtggggaaaataaaagatggatcacagtgggttcaaagtataaattcaatctacatcacacaaaagtaaaaagtgatacagggtcatctataagatgttaccatccacagtgacttagatactgttagggttgcttttggaatcacaaacctagggtataagcctggcttgccactaaatagccacgcagtcctgagttgacttcattctgtaaggctccttttcctcattgggacaaattaagatttgggcacttgcctcctaagtcaagaactaaacaggagagtgcttgtaatgcatttggcacagtgcttggcatatggctgctgcttctgctgctttggatttcattattcttatttattttattatcgatgatgacaatgctagtattcttagagtaatctacttacaggggaataatgaagaccttccagagatttcgtaagccaaaaatgtcagtggcactttcagatttgaatcttgtcccaggattatggacagcaatgaattcagtgaggggtagggattcctgtctcatggggccattccagccttctcccagcacagtgaactcatgtaaagagactggacaggaatcccctttggtgtgaggccaaggaagggcttgctagtatattttaataattgattttgttttaatgcttctgttgtatctctagggaagcgttaagacaagtccaaaatcagcagcagtgtttgactagttttccaggagcactaatggactacgtggagttagaagcatggccacctggcctcacagtgatgaatgatgttaatttgttacatgctaaaataaattcagtgcacagtctgtacaatgaaaccgtttttatttgtttttctgccgagttagctgacctttggcaccacaccgaagggttaaatgctatagatttactgttgatcctaattcagctaagatgagcccagcccctgaggatccctattgatgatgttttaataaaccttgacaactatgcaagttttcctttatccctctgagaagaaatagaaatatctgttgccaagagactactcactttatgtgaaattatggtcaaaacgagagcctttatccaagatgaattgttaaaattgctttgttggtttcatagaatctatggtattgtcatttgtgaatcacctttacttcattttattttttccaacctcttatttatatctgctttattactaactggagttttatgaaaacaagtaaaggattaagttcctttcataaggaaacatagcttaaaggaaataatattttcaatgctgttttcagctctttctcatttgtggtgtttctgctttgttgcccagaatgtgttcattagagattgtctaaagaagttctattaaaatttctgtggccaaggcaatttgatggatatatgcaaacaatcttacaggatttggatgttcatatacctgccattcatattgatgaatctgtctccttagcttacttttaattttcagaattcatatcagcatatctctctgcatttttataatacttctgaaaaaaaatctgaaaatatgcaagcaggtttatttttctgttgaactcctgtcttattatgacaacaaaatacagctttcaaaggccactgatatatctttaacactgctagtatttcagagacaggtatccgttggccccatactttacagcctaaaaatattaaggaatacgaatttgacataattttaccataaccacattatatattttttgtgagccctatttagtccattttaaatacatggactttgtagaggcaggtcattagaatgacatttccctactcatatattgcctagggattttcttgaaatcttattcatactgcataaattcatataaacaatgaagaagcaaaggatcagttttccaggaatacagggcacttaataacaatagtaatatagtaatcaacatttaatgaattcttactgggccaagtacttatctaaataattcatgtgtattgactcatttagtcttcagaccaaccctatgaggtagatggttattttatcaataagacagctgagacccagacaggttgaaataccttggccaaggcgacctagccagtagcttccagagctagaatgaaattgacagaggttgtattagtttcctattgccagtataatgaattacaacaaatttaattggttaaagtaacatcaatatattatcttttagttctggatgatggaagcccaaaatgtccacaaaggacatttattagtaaagaagaggagtcagcaccaggacttaaggcaggaaggaatagcctaactctattttgtgcaaatgaagtcaagtttatgatcaggactgcccttctctataaagatgctaaaccctaagccttcaggtgaagggaaaagataaacatcagctgacagtcttatggatgcataacaaaaagggctaaagaacatgaaccccttttctggattggttccataatcaaaactttgtccctgaagtcaggaagtacctagccaataaacaactgcctttttacagttttttttgttttgttttttgttgtttacattggacaatgcccctgggccacccagaaccccatgagttcaacattaaaggctttcatatggtttccttgccccaaacacaacatatttaattcagcctctagaccaggagtcacatgacgtttaaggcacaaacatcacaaccatatgctgtggaaagaattgacaatgctctgaaagagaatctctgcagagggaacatcataagcatctggaaggatttcaccagtgaaaatgccgtcatccttatagaaaaatctgtgaaagccatcaagcccaaaacaacaaatttctgctggaggaaacggtctagatgttgtgcatgaattcataggatctgtgactgagccaatcacgaaaatcatgaaagagactgtggatatggcaaaaaaaagaaaaaaaaattggtgggaggtaaggggtttcaagatagggatcttggagacattcaagagctaacagacaacacaccagaggatttaacagaagatgacttgatggagatgagtactttggagccagtgtcagacaatgaggaagacatagacgcagtgccagaaaacaaattgacattagacaatctggcagaagatttccacttactaaagactgcttttgaattattttatgacatagaccattctatgatatgggcatgaaagcaaatggtgagagaactggtaccatatagctggggtccccaactcctgggccatggactgttactgatctgtggcctgttaggaaccagaccacacagcaggaggtgagcagcaggtgagtgagcattactgcttgagctccacctcctgtcagatcagagatggcattagattcttataggagcacaaaccctattttgaactgcacatgcgagggatctaggctgtgtgttccttatgagaatctaatgcctaatgatctgaggtggaacagttttatctctaaattaaccccaatcccatgccccccatcctgacccattcatggaaaaattgtcttcatgtccctggtgccaaaaagtttggggaccactgccacatagaaacatttttagagaaaggaaaaatcaaaaaagtcagacagaaattacaatgtatttccataaagttacactgtgcctgcctctcctgcctcctcttctccatcctctacctcttctagctctgccacccagagacagcattatcagcccctctccttcctccccctcagcctaatcaatgtgaagatgatgaagatgaagacctttataatgatccactttcacttaaggaattagtaactatattttcttttctttatgactttaacagcattttttctctagcttactttcttgtaagaatacagtatgtgacacatataatatatacaagaagtattaataactttgctataggtaaggcttctcatcaacagcagtctattagtagttaaattttgaggagtcaaaagatatatgtggattttctactgcacaggggattggcactccaacccctgtgttgttcagaggtcaactgtatatatatgttgttgaggagaaataataataattttaattaaggaagactaaataagcttgaaagcctcattgttttctttgtatgaaatagcagcaaaggggtaattagttttaagtcaacagttaagtcaataagatacaaatctttggatttatatatcctattagatatttctcagagtcaagaaaaacaatgaaattaaaatcagcccttaattctgtgaccaaatgagctctcttctattatgacttcatgtgtgtgtgtgtgtatatataatatatatatatatataatgagatatatatatatctcatagtttattttagcttagaattaattacatttaaaattaaatataaatcctgatttttagctgtcctatctgaacaaatgattaaatgatggctataattttatatttactttttagcatataaatcttcttattttatgtacataggaatacattaatttactgttaaacgtcattttagccaccaaatggatttcaataaagtaatagataaaatgcatttaacttactgcattctttaataatgatattttaattgttagagactatattgtaagataaaaaggaagtcatttagggcctttaaaaactgatgtggccttatttctatacaatgcttacattgaaagatgatatccagataaatgcatacccagtacctttcagtgttacttaatcctttatctggtgaaatgacagttatcatttgctgaggtcttaaatttgttctgaaaaaaaaaaattgttatcactgtggaggatagaaaaaggaagtcatgaataaggccacctctgctgaaactttcaactatttggcacataggtttacctcaaaagatggaatacatacatggtgcaaagagatggactaaatgatatataaataatctttccaagcctgaaatcctaaaagattttctgtctttaagatatagttcaagaattgaaaacatcctatttctttatgaactaagacacattatcatattaattactctattaatttatgctaccctatcagtggcacgtaacctgataaaaataaggcatatcaacctttttggaatttaactgttctacctacccatttgtgaatcttttgatttttcacaatccagccacaaatgtgtaatattttcctttactttcgtgaaagaatgcggggaaataaacatattttcaatttcatttgactagaggtgggatttgctttcttttgatctgtattaattgtagttttaaaaaattagacaataaatataatggacaactaacagaggccacgcagatgctattttaagaatcattgaaaagaagccttttctcattcatagtttcttaaaatcttaaaaggaagaacttaccgaatttatgtgcaaagtagatggttgctttattgtttggtgaaattaagagacaactgtttttttttttattaccaattggaagaaacacatatatgggtccaaattgtctccagttccagaaggaagcagaaattatatgatgtctgtaaaaatactttatgttatagtttttaggtcgctggattacttgcgttttacagttggttctttgtaaacacatctccaagaagttggtaagagataaacttgactgattttgaaacttaccctgtgttaaggaagcgataataaccctgaagggccacgtagaattaaggcatcatgttgctaaattatccttggctttgcagaatgtagtaaggtgctatgccggactgcagagggcgtgtagaatggagccctaactctccccttagtttatctttgaaatctttcggagaagtgaacttgcacttttatttattttttttcaaagttaatacctttttagttttttttaaacttttaagttcaggggtacaagtgcaggttcgttacgtaagtaaacttgtgtcatgggggtttgttgtacagattatttcatcatccaggtattaagcttagtactctttagttatttttcctgatgttgtccctcccccaactctctaccctctgaaatttgtttcttttcaatgcttcttttatttttttttatttcaatagttttttgggagacaggtggtttttggttacatggatacgttctttagtggtgatttctgagattttggtgcacccatcactcaagcagtgtacactgtaccaaatgtgtagtcttttatccccccactcccctcccactcttcccactgagtccccaaagttcattgtatccttcttatgcctttgcatcctcatagcttagctcctgcttctatgtgagaacatgtgatgtttgattttccattcccgagttacttcacttaaaataatagtctccaactccacccagaatgcttattttaaaaatagcaataaaataacagagtctccaaactgtcaattcacaagtacttaatgaaggccttccaggtgtccagcactgaattggacctgttggagatgttggaaaacaaaaccaaaaactatttggcatgacttgtttctagaccggggttgccaaatagaacataggacatccagttaaatttcaatgtcagataaacagtgaacagttttgttactgtaagtgtgtccgatgtgatatttgcaaaatctgtatttttacgtactacctctggcaaccttttcctccagaaactcacaggttggtgagaacagtaacttatgtatattaaatccttcgggaacagcatcgcacagcatgttaagcaagttactagatcatgtactttaggccagcacttcatggttttgtcctccagtgacacaaatcacagatggtcctcatgggaagcattaagacatgcagtataaatgttgagttattccgggaggtggagcttgcagtgagccgagatcgcgccactgcactccagcctgggcagcagagcgagactctgtcccaaaataataataataataataataataataataataataataataaagtaaataaataaaaatgttgagttcttgttcctgattgtttctcccatttattttcaattcaaaaaagcaaattgtaatgacacataatgagagtgcctttattatagtgatatttctcatgtgattctagtttctatatattttcagataaattattctaaagcacccttcagctatggttagtaacaaaatacttgcacagctgatcttgtcacatttatgtgtgtgtgtggttaggaagctttgctttatctttaaatgtcatgggatgtcctgatcctccatagtcagtgagaatcagaggaggcagatcaagtttcactggagagactggctatgagtgagttctcaagagcctagagtggatgcagttaaagcagcagtgtctgaccattttgtcatagaaacatgaaggaagccatttcctaaccaatagaatgaccagaacaagatgttacccagaaggggagaaatatcctctcagcttgggtaaaccaatggaagggttacctcaaaaatcctcttttgagaaagaagtacattttagacaaagacctaaaacatgggaaaagattgtagtcctctgttctgctgtattttaattgctaaacaacagtcaagaaactaaatgtataataaaatctaaattattaatttaaatattataaattcttaaatgagatcgagcatctaaggaatgacatttttatataaagcctgctgagcagtgagagtcatttgggaaactttgttcaacctccacaatgtctcaaaatatttataatatgcacaacattattacacgtttcttctgcaataatctctgtaaataatcacttgaactttaaaaatgttgcactttgtctcctgtctcaatgccctaaatagatctaaaagatcttaaaaagaagcaacagcttaactaacagatgacaatgttttcacaaattcttattatttaaggtaatgaagctcaggcccttatgtgtctatgggccatggattttcactaccaatgtgtcgctttccaatgttgccttttagtattatttttcagtccaaaaattctgctacttactgctttaattacagtttagagtcagtaaataagaaagaaggtatgattaactttgtgaaatagagtatagttggcataatcacctagcctgtgccaacatggtaaaatgtgtcatgaaataactgaattgatacaatatggcatgtttgatttctagtggttattttagaatctttccatttattttcaaattatacacacgcatgcacatatatagacattgggtaaatatttaaatatatattatcctaatttcacaaagaaatatgaaaactcagagaggttaaatgacagcctgatatctcaaaactgttttggagaggaatacaaatattgactccagtttttctgatcccatatatgttcccactcatatttcatccttctctctttaaattcttaaagaggatgtaagatgttgacatgtacatcacacagtgaaattataccaaggatgtcacaggtatgccagaagtaatggctttcaatctgtatgatagttagtgacataaccttttgagaaattcatgtctacatgtttttttcagggaactctgcctggcttccagtgatgtacaccatgatgacagggtagcaaccctgctcttgtttcatattcaaacaatgacctgtcaaagatacctaagtgtggcttgcttaggagtgagtccaagtatcactgcccaagtgaatcgcattttgctgtgtcatgtaaaatgtggcctctcatttctctttcagtatactataaataatcaaggaaaacaacacctagtttattcctcttatgatgttgttcactaaattattctaagtaaaaaatcctaacactggttcattctacagcttatattctgttattacaaaaaaacctgtcttttgaaaatgtacataatctattaacaaaattttcctcttctttgttagatagctattgcgatgatactaaaggtgtcaaaagtagaatttttattaacctgggagaacaagtattcctttttttttttttttttttgagatggagtgtcgctctgtcgcccaagttggagtgcagtggcgcaatctcagctcactgcaacctactgcctcccagattcaagtgattctcctgcctcagcctcctgagtagctgggactataggggagagccaccatacccagctaatttttgtatttttagtagagactgggtttcaccatattggccaggctggtcttgaactcctgacctcattatccacctgcctcggcctcccaaagtgctgggattacaggtgtgagccactgcgccaggccttcaacaaggatttattggcatcaccttatactctgaaagtcatcacaggtctcagcgggggagtggctaggaatataaccaagaatgtcatttagaaatatactaggcagattgctgaaaccacattattttctgaaacataaaatttggatatactttcttccccctacttaacccgcatttttctaaaagaacacatgcagcttctaggaatgtccatattaaatcaaaggcgtaaaaccagcttatttcttcatgcttattttcttggttaggaaaatacagggtttgacttctcttaactggtcaaagaaaaaaattaataaatatccaccatttatttagatgtaaaatgtttggctgggcgtggtggctcacgcctgtaatcccaacacttcgggaggccgaggtgggcagatcacctgaggtcaggagttcaagaccagcctggccaacatagtgacaccccatccctactaaaaatacaaaaattagctgggagtggtggcatgtgcctgtaatcccagctactcaggaggctgaggcaggagaatcacttgaactcagtgatgtcggcagtgagacgacatcacgccactgcactccagcctgggtgacagagccagactccatctcaaaaaaaaatcttatctcaaaaatgactttatgtgttaaaaacaataacaacaataataataatatcactgccttacataggtcatatatagcagtgtcaaagagctttacttgactttggatggtggttcctcatcttcccgggccatgtcctgtatcacaccacttcccacttctcaattcccgagctgtgagccttgacattgtaaagtcattgtaacagtgcaaagatcagggtcatgatgtaccagatgctcactgggaaggtgctactcaacactctttagaagacctgattctaggccgggcgccgtggctcacgcctgtagtaatcctagcactttgggaggccgaggcgggcggatcacgaggtcaggagattgagaccatcctggctaacatggtgaaaccccgtctctactaaaaatacaaaaaattagccaggcgtggtggcgggtgcctgtagtcccagctactcgggaggctgaggcaggagaatggcgtgcttgcagtgagcggagatcgcgccactgcactccagcctgcgtgaaagtgcgagactccatctcagaaaaaataagaaataaaaaaagatgaaaccaagacctgattccaggttgaggatgcacgtgtagatctctttttgtactctattgggaacatgcccatcacatatttttgtgtgtcttttgtttttagaaagatggaggcaggaggaagaaagatcagtaccctcagaaaaatattgagaaaatttttttctcaattgagaaattgaggcatgttgtgcagaggcagggagggaagataggaaaagagaatgagaccaataccacactcttttctgggagatccagtttgctttttagagccgagacatagtttagagctatgcttcccagcaaacagtgcaaagagagaagtgtttagttgcatgcaacatagtatccgtaaagcacaaacagcttgattgctcaatagattattcacatagttggtaccactttatgatcattcgtctgtcatagtcatagctgccgtgttgctactttgtgtgaccaactgcgtgcagaactgcatgttccagggctaggtagaatggccatcctcttaggaagggtaaattatctaagaaagaaaagtgcccaagcagaaatgtatccattggactgagaaagtacctaactaaccatggccaagaaatgttcaccaatgccaaataccagagttttcccagagatctccatttagattatctcattgaatcttatctctctacaatgtagaaattatagtcccatttttaccgataggtaaatctaggcacaatgagatcaaataatttatttatcttacttaaaaaaaggatccagaacagagtatgttggagtcctctgcccacaggcttttcatcacacaagatagaaagttgcagatggaagtggaaaaaaagtggtagggaaagtattttggagaagcaatttcacatacatcttctttaaattaaacaatctatgtacagcacatggcacagtgcctagcacatactaaatacacaaaaatgtcagctattatactaacacttcgttttaacaattttgctccattggcaatgtaatgacagcctttgttgacatttttactcagtattataggatttgtagataagaaaatgtagtacatattgtgatgtttctctactcttattaaaattgcttagcaaacatcatagctattagtgttttaaccattccattgctttgacattaacagataatttaaataaaatttgggttgttagattatgacgtatgatctggattgtgtatgtcagtgagaatgctttaatcctatctaattttagtctttctctagatataaatagtttgttcttggggatcaaggtgaaatgtttccacactgaagtttcctggagacactttgtgcagtgttgagttcactgcttataactttgtggagggttgttggtaggacattctactgaagcagacaatttacttgcttaatgaagacattatgaatcttgaggagttacttctttgggctctgtttatcatctcattgaattcctaagtgctcttcccatatctttcttcttctcgcatactacttaacattagcagaggggtcttcttaaagcttatgatagtgcctgtctttaaataaaggattaaaatattctaacatcacagccttctattctctgcctgctgaagcctgactgtagaccatctttctgactgagccttccatataccctgaagccaacctgcttccagcaaaagtgaacctctcaacacacgccatcattcaggttgcccccactatttagaataatcttccttctatcactacaaacagattctatcagtattttaaaatctggtcaatatctcctttttcacatactcactcctaaggtttctacctgaatgcagtttatgttctttccagatcccttcataaatacttagcttgtggaatttataacttttctctcttgtattataattattttgtgattcttacataaacttctggagcttcagtttcctccaactgaaaaatggagataggcatctgtagcatatacgttaatagttatactttgattgttaattacaaagcccaattcaatctagtgtgactcataaagggaccatattagatgggtaatgaggtatttcatggacccaaggttcataagatatcttgaaactctcaaaaattataatgagcaccaataaatccattgaaaacacataggattctttctctcatctcagcttttctgttaacatctctcattctttcttgttccagacctgttttctctgctttttctattcctgtgagagctttcagccaaagctctcaggttttgacttgtccttaaatacaagtgtccctgattcccagttatccctaaacagaatttgattggccagcttggtcatgacatttacctctaagcagctgtaagcataagagccttctggcaaagaataggattatcaaaggctcacctgataagcttggagtacaaaaaacattcttatgaaattatgactacggtcgtccaagaaaacactaaaaaatctatcattataggattgttgtgaggataaaatatgataatttatgctgcaagaagtgtaatttgtggtacctcgagtaagattacctgaatttgcatccatgctgtgtgccactcatcagctttatggccttggggaaattgcttaacctctgtttactgaagcttctttatctgtcaaagtgagaaagcataatagtaactaaatgatagtgttcttttgaagattcagagtttgaatgtgcaaagacctattacagaaattggcacatggtgatcactcagtacatattacttattgtttactaaaatgtgcatagttgctaatctattgttagcatgaaataaaagtttgttgctaatctctaacattgcttttattaaactataaatttcttgacagtaaaaattattcattatgtatcattgtatctgtcttagtgtttaatatggcttcttacatattttagacacagtaaatggatgaatggatggatggatggatagatgaatggatggatggataaataaaaaaagaacagaagggagggagggaaagagggagtgtaagggaaagaaaatatctgcttttcaaatgaattttgaattaggaaggcagatttggctgctttgttcgtaaagaatatcagcctacaatcttggggtagattgaagaaaatagcgcagcagatatctgatgaagtggtgtaactgactgtgtcctgttctacaggtcacaatactagacagctgtgactgtctggtagtaataggagatttctcaattgtgtgattaagagcaaagatggcaaatgatcattgtaagtctcatgctatagctgcacataattaaaatcactaggtaccttaattaagattattaagtgtttcattaagaatttaattagcaagttaggtgctttatgattttttaaaatctatcaaatggtatgatgttttattaagctacaaattgtatctattgagcactgtcttgtgagccactgtgaatgtagtttagagtctgcagaagttattgttaaatcgctaagtaattagctttagtgtagattttatttttgttactgcagagaaaatgttaattaagcacttgggcttgattagatcgtctttcttcagatacagaagcataaaatcacaagaatagaagggagtggtagaggagtgttttttgcataataatggacttggggttaggtaaatgtgagtttatgtctatgttattgctcagtttaggtggtgaagtcaaatatgacctgtagaacaataccctttgatcacagcctcagaaatatcagagacagatatgtctaaggctggggagataatatgattagtggaaggtacatggatgttgggaacaaatgtaggttcaaatctagatctgccactttttagctgtatgactcctgccagatccttgaatctctttgagcttcaatttcttcgtctattgggggagggaaacttttctgtcaagagacagatagtaggtattctagactttacatatcacatatggtctgtcacatattttagttcttttcgttcttttttttttcctttcaaacaatcctttaaaaatatgagaatcatttatggcttgagagctttatacaaacaggctgatttgagctcacaggcctaatatgctgaatatatatatatatgttttcacttttaagcagcaaatacctagcacagagaagtgcacaataattgttggttcttccaatcatcaatgaagctaaaacttttgctcaattgtgcagagattttcaaaatgaccctattttgctatcatatatgcttcctgattatcagctataaacttaaagtaacaatttatggctcttgctacctgccttctcagtgctcccaatagagtaggtgctcaattaagtattatttaatgatagtaatgggaatacatggtgcaccagcacgtcagcattcatagagaagtggctgtgaatggagcattgtaaaggaaataggaagcagatgcagttggtagtgcaggatccagaacataaaaggtaatgaaagaagttttccaaatgtctcatatctgtccattactgtcacgcacacgaaatatcatgggtgtatcgaatagaataaatgatgagagcaaatgggtggtaggaaaggaagatttattggtaatactaatattgttactattaactttatctaaatagttcgctttttacaattatcttagaaggatttaggggtttttctagcaattcactttagtctctaaggacaaaaaaagaaaacaaaataatagacccaaacaacattggccatacattatctcctggtaatcctgtttttttttaattcattctttctcccttctagagattttacataggtttaacaatgtgttaaaacaatttgctgaaattttaaaggacatttgtgtagtcgatataaagccatttagaattttttctgtcgcaaaggtgatagtcttatttctctctccttgcctatttggccctagagcttcagccattataaatttcctgctattccctatacacaatacttctcattttatttcacaggctgttcctggtgacatgaccatctcactttctctgttgattaacttctatatgcacatcagttcttatctaagacatcacctcttcccatggctttcactgatccactatcaacccattccccttcctcactccatctcatagtcagggttgggatattcccatgtgatttgttgtcactgtgctcacacctttagcctactctgatcacgctgcattataattgtcaaaaactgtgttacttactagactataaactctttgagggcaatgactttatcctttacccttctgtatacccagcaacttggactatctggctcagggtgtatattcagaaactttatttttgggtttcctggtaaaatacaggatacctggttaaatttgaattttagatattcagagaaaaactttagatgaactaaatttagcagactttatttgagcaaggaaatgattcatgaatcaggcagcgccctgaaccagtagtctcggagagctccactcagcaatatagacaggaagtatttatagacagaaaaaaaagaggtgccatgcagaaataacctgattggttacggcactgccttttccttatttggacatgttttggcagtttgcagcctgtgattggctgaaagctctgctgctatgattggctaagatttggctactagtacaaaaatgtactttcagttagaatgcagtttgtttccatattaagttaggttacagttcattatagctttaggccaaatttaaattaacacagataaacaatgtatacgtgtttagtgtaactacaaagaacacacttatactaaacaaaagtactcattatttatctgaaattcaaattaaattgcatgccctgtatttttagttgctaaatctagcaaccctactctattacatgaatgaatgagccgatgttattctattctgtattatagtaagaaataattttcattattttctgtaggtttcagactagagattaagccacagtagaaaatttcaccaacgtgatctgaaatccttgcttgcacttcgaaagaatgtttttctaataacaacagagggtcttactcactgtgaagagatgactgttaatccttgagaaactttccaaattaataaagcagtgtgacactcatgatggtttatcaacagtaaacgggagtgaacaagaatctattgggattagacatgatgtaataataatgaaataataacactgcctaatgttcattgagggcttcagtatgtcagacagtgatccaggttattttcgtgtatttactttcttattcttcccaaaattagccctgtcaaataccattattttcctcatttttttttttaaaagaaaactgataggcagagaacttaggtatctgaccctaggtcacacagctgattagtggcacatttggtattttaagcaatatagagtaactcttcagcctgcttttctaaccactatgttctactctctcattgtaaagatatcctgtgagttaatgtagtggttaatgcaccttatgtgattaaattctgaatcattatgaagagaaaatctgtttcccaattgctagtgggaatattagaaagagaatctcaaagtaagattaaatataggtattattatatgcatgcatggatatctatgtgaaatatctgtgtgtgtgtgtgtgtgtgtgtgtgtgtgtgtgtgtatgattggtagcttaatcttttaagagatccaaaatgccactctaagagttatgaagggtgttaagatgtccctgctgaaaaaataccttccttagtttatcatccagttcctatgattgttgccaaagaaactggggcaaaaggcaatgctgtaagtgacactggaggatactgtgttaaacatgttttacttgatctacctgctaaactggtatctcttcagtgtaattacactgggccagcataaattacctctagacctgatagctggggatggttttggtgtgagggttgagggatgacccaagaatgaacagcagctaataaccacacagtcaacacacagcccttcagaaagagtaagacctcagcagcctctctactcggaaattacttgtgagagttaatttctattattttgtatatcttttattaaaaaatagaatatttattttatacatgtaattcgaatatataatataaaatttaaaagctacaataataactatcccttcttcctctgtcttttaatcacacattcacttccttgaatgtaattattttttctaatgcatgcagaaaaataccatgcattttgtgtgtgtgtgcatatgtgttttacaaaaatgataaaatacatacacatggttctataccatggccttttcacttaaggtaggagattgtatacatataggggttttttagttattttcaatggttttaaaatatttccttttattattgtacaaaaaatgtattttaatcaatactacattgataggtatttaggttatttccaatcttcctatacacaacactatagtaatatgcttttaatgttatttcccaaaagtataagtacatatgtaagattaaaaattacaagaaaatacttaaataaattatgctgaattgtctctacaaaggtaatactagattgtatttatactggcattattttcacatgcttttgcatttctcttactgtgtgtgagatagttcatattttctctgtttaaaggatgtttctctttccttgtctgtgaactgactgttcatgtctttttcttactttttaatcggggtattctttatattattatcaccttgcagaaactctttagaatcaaataaatttagcttttggatatttagatatttaagctataaatacttaaggaaacttttaatgcatacatatctacatagagaaatatttaggacaatttcaatgtacatatatgtgtttatattttatatatatacaatattttaagacctttaaaatgcttatacagtgtatctctatgataggtgctgagccagtaaggcaagtttaatatgtcacaatttttggtaaaaattgatatgtttaataattcaaatgccatgtttgctttttttccctaaattaatgctattttaagttttgactgtatacagaagtttggcttttagtacttttcatttgaattggatatgaatttcttttctttacagttgtttcctctgcttttgagtcacagttaatatttagtgtgagtaaaattataccatggtagatgcactaaatgataaagtcactaaaaatttttgcttagcaagctagctctttattcagttaagatgaaataggaaatatgtgatgagcatgtaccaaaaaacttttttccaatttaactttatactataattttgcatatttcttttccttaaaataactacttaaaatctcaattttaattttcatttatgatatatggttttatacacatttattacattttcttgactttttattgtgagaatctattatttaaagtgatcgtgcttgatttctatgtgaaaatacattttaatcacctatataaagtattattatgaaaatctacatattccataatacactacttatattttcagacagtagatcacaattacaggcttataattactattctatctaaagaagtatccttggattcaagatgaatcatctcaagagcattgaagaccatgataattagaacttttaaaaagtatcgacatgcataaaatcctaacaaaccacagagtagaacagtgccatgattttgatcaacatttcacatgtgaaaaatgaaatggagaatgaatcattttctcaaggtcatataccaagttggcaatagaataataaaaaggagacactctctcctgacatgttgtctagaattctgatgagagaacacagtccagttttgaggtattttaggtaaaaatcctttgaaatatgtgaccatgcaacttaacatttttcaaatttgtatcagttgaggtttactagtttatcaatccagtcattccagtatgccttctcttactctactttcaaaataggaaaaaaagtgaataaatatttttcagccctgtgaatgaagagtaccaagaaaaataaaggaaagactaatgcattactttactctctaaagtactcataacccatgacacaacctgtcttgtcctgtcttgatctgttttgtgctgctataagtgaataccacagaccaggtatttataaagaacaggaatttattttttacagttggaagttgaaaagcctaaggttgtggccccatatcttttgagagcctttttgctgtgttatccaatggcagaaggcagaaggtggaaagggaagagagcacaggcatgagagagagacagagaaagagagggaaagagcgagacagagagacagagatagacagacagagacagagagagacagagagggaaagtgagacagagagagagagacagagagagagagacagaggcagagagacagagagagggagacagagacagagagagagagaaagagggagagagacaaagacagagagagagcacactgaacttgcttttataacaaactcactccagcaatagcaaactcactccctcagtaaggacattaattcattcatgagggcagaactctcatgaccaaatcacctcttaaagatcccaccactcaatactgttgcactggagattaagctgccaacacatgaactttgggggatacattcaaaccatcaaattctgtgcatgcctctccaaatttacatccttctcacattcaacatacatccattccatcccaatagcccccaaagttttaactagttcagcgtcaactcaaaagtccgaatcccaaagtctcatctgaatcagatatggatgagactcaaggcatgattcattttgagacaaattctctccagctgtgagcctatgaaatcaagacaggttatctatctccaaaatacaatggtggggcaggcataagatagatattttcattccaaaagggaaaaataggcaagaagaaaggggtaactgatcccaagtaagcccaaaacccagtggggcaaacaacattaaatcttcagaacaatcttctttgactccacgttccatcttctgtgcacactgggacaggagttgggctccccagacctcaggcagccccgcccctgtgtctttgctggctttagtccgccctgtcagtctgtgcctgaaactttccaaggcttacgttgcactctggcggctctacggttatggcgtcacagatgcagccccactcctatggctccactaggcattgccctagcagtggctctctgtggtgattctgcctctgtgacaagtttctgcctgggccccaagctgtccacgacatcttgtgaaatcttggtggaggctaccgtggccccataacttgcaaactatgtgcactttcagagttagttatatgtggacactgccaaggcccactgcttttgccctccaaagtggcagaccaagcagcccaagctgcacctaggcccacttaagccatatttactcctggggtggcccaggagtgctgcattgggatgaagaaacagaggtgtcctgccctggaggtggtgtaggacaacaaatcatgaggcctttagagcatctctctggaaaccttgccttcaaggtcctgctctgggcctgtgattggaggggcagtcctgaacatatctgaaatgcctagatgatctttgtcccatattcttgatgaataggatctatcttccttccatccatattactatttttagcaaacagtcgcttgaccacacggttagtattctctcccaagcatgctttattattgtttacatggccagtctgagagttttccaaatctttctattctgcttctgttttaattattaattccatcttaaaatcatttctcttctctctaattttactgtaagcagctaaaagaggccatgtagcatctggaatcctttgctgcttagctatttcttctgccagatattttagttcatcactcttaaatttcatctttaataaagccctagggcgtggacataattcagccaggttctttgccactttataataaagctgacctctactcccgtttccaataccttattcgtcatttctctctgaaacttcatcagaattgcctttagtgaccatatttctaccaacattttaatcatgaccaattaagtaatctctaagaagatttagtttctccctacagctcctgtcttctgagccctcaccagaatttcccttaacactctgttcacagcagtctcgatttttttcctgggctgctgcttgaaattctttcagcttttagtcattattccattccaaagctacttccacgttttcagatatttgttttagcaatagcccaactccttggtaccaatttcctattttaagctattttgtgcagctataacagaatacccgaagttggggaaactgtaaagaacagagattaacttgttatactttgagacactgggatgtccaaggttgaggggctcacatctggtgagggtcttcttgatgcatcattccatggtggaaggcaaaacatagaagggcaagaaagcgtgtgcacacgtgcaagagagtgcaagagggagccaaacgcacttttattacaaactcacactttcaatagcatactcactcctgacataatgacattaatccattcatgagggcaaagccctaattgacctaattacctcttaatggtccctcttctcaacactgttgcattagtgattaagtttccaagacataaattctgggggatacgttcaaaccataacacacctatcgaataattattctatttatatcttctactcaaattcaaacttatctttcacctattaccttacaaaattacatgtatcaatgtctgaaaaccaccagatttatgttaattcatattattttataaaatatggctcagagaagaagaatagatataagaggaatctactaataaaataataacaaagaacaataagctcatccttctatctgtaaattctccctggggtgacattctttaaatttgtaaggctttgccaaagagtttaatatttgaagcaaaagtacagagtaaataccatttgtaccctaacaagaaagaaactaggattcagaattcttcagaatgtcttatgccagctataatggaatgtaaagaatattatctgtaatgactagatagaaagaacaaaagccaccagtcacgttttaacatttaggggaatgaattcattcaaatgtggaatatggaagatgtacaggttactgtcgattctcagttccactgataacacaaaggaaacacaacagaaaaaaatagcaatatatatcccactgcaattactttttcttcccctttctctttcattaattctgtatattaggttgaaccatagaaaattgtcaatatttggctgtttttaacctgcacaaacaattttatttggctcagtctaataaatggctacattctttgtcactgaagaatgccatagaaagtgaagtttgtatgtcagataaaaaattcattatgctatcaacccagcagaagtaatgaaaaaaatgtgaaaattgaattcttccaacttcttcattctctatttagttattgtgttctcccgtggatatagatcgaagaggatatgcagtctctcaggaagtgaattcatataatgaatggaaatatccaatcacatgaccaggaagaataaaccttggagttggtttttggacagcacttataatttttctgcctagagaatcagtctcttttgggtcatgttacgagtccatattattgataagaaaccagagactgccttgggtaaactccagaaagaggatctgctttaaactcaagtctatgtttatcataagttgatatatattcttaataatacattgacctttatgcatttttcattgctcctttattttacattgtaggatttttaaggacagagatcatattttctgtttagaagaaattgttctgtaatatatgaattccttataaatggctgtagcaataacatttacttcaatatgtgaaaaggccatcagtataggtactccaaaattactaattcaattttcttaaaacttcattctatcatggctacaaattgtttcctctacttgagtttaagctctctaactaattttagagattttagttaacatggtaaaggaaaagaaagtgaatcttaaaaaaaaaataaatccttagaactacctccagacactgaatgatgtggccctgttttcttctctgtgttctatggtctctgccttcttttcttttactcaatctctgaattccaactttgcttatgttacaataagctctttcctaattcaagctattgtatatgttctatatgttgtgacagttgatctgataactgagatggctactaagtggctaatgggtgaggagcatctacagcatggacacactggacaaagggaggggttaagtccatggtgtgaggaagcaggacagagtaagacttaattaagctacttagaatggtgtgcaatttaaatggtgttatttaaggatagggacatattctgagaaatgcatctttaggcagtttcattatgctagcatcgtagagtctactcacacaaacctaggttgtatagcctactacatacctaagctccatggtatagcctattgctcctaggctagaaacctgtacagcatgtgactgtactgaatactgcaggcagttgtaacagtagtatttgtgtatctaaatatatctaaacatagaaaaggtaaagcaaaaatataccatgaaagattaaaaatggtacacccaaatagggcacttaccatgaatgaatcttgcaggactataagttgctgtgggtgagtcaatgagtgagtgatgagtgaatgtgaagacctaggaaattactgtacaccactgtagacactagaaacactggacacttagtctacaccaaatttataagaatagttttctttcttcaataataaattaactttagcttattgtaattttttactttataaactttttaatttcttttctaataatttctaaaatacaaacaattcatacagctgtatagaaatagtttcttctttacatattctataagattttttctatttttaatttattgtattttttacttttcgaagtttttttgttaaaaatgaagacacaaacattcacagtagtgtaggtctacacagggttgagatcatcaatatcactgtcttccacctctacgtcttgtccccttggaaggtcttcaggggcaataacacacatggagctgttatcttctataacaatgcctttttctggaatacctcctgaaagactagcctgaggctcttttatattaagcccttttcttttttttagtaagtaggagtacactctaaaataacaataaaaagcataatgtagtaaatacttaaactagtaacacagtcatttattatcattatcaagtactatgcaaggtacataatcatatgtgctatacttacatataattggcagcacagtaggtttgtttagggctatgatattactagatgaaaggagtctttcagctccattagaatcatgggactattgttgcatatgtggtctgtttgttgaccaaaatgtcattgtgtggtgcatgactatgcatgcttcctgtaacacatttctcctgactgtttatcttaaggacccaaactccaccgttgggtcttaatttctaatgtccttacaaaagttgtctgtcctaattgctgaatgagatcctccctattagttatctgattgcatgctatttgatcaatgtttccattagagtagccctcacttatctgcagggaatatatatcccaagacctccagtggataccagaaacagatgatcatatggaacccgattgccctcaattggaacacgtttctgtttgtgtcttccacccacaaatgtaatgcctttcctatcttaactaagcacttaacatgcactgtggccataacttttgcagtttgaatgcaacagcaaaactaacacaaatgtatttttccttcttcacaatttcacagatagaagatatgttttcatcatagatcttagcaacctcaccatatgacctttttttctttcttatcaagtcaataactttcacctttcatgaaagaagcactttaaggcttttctttggcatatcagaattgccagcatcactactcttgcactttgggacagtgatgtgacagttgatctggtaactgagattgctactaagtggctaatggttggggagcatatacagcatggacacactggagaaaggtaagattcaagtccacggtgtgaggaagcacgacagagtaaggcttaattaagctacttagaatggtgtgcaatttaaaacgtatgacttgtttctggaattttccatttaatatttttggactgaagttgactgcaggtacctgaagcctagggtaactgagtgaaactgtggataatggtgaggggaggtggtggtggggcaggggagggctactgggtatgtttgtgtactaatttgatatctgtctccactagactgcaaggtcaggcatacaaaatatattaacctttggcaaatatttgttaaaataattgctggtttattattattatattcatgggacatataagtacttcataataaaggtggattttctaatttaataaataaaaagagataagaagaataaagggtttgtaaggctattcaccaagatgttaatcttagttatctcctggtagatggtgttacagtactttttattttccccctttttttgtaattaatatgcaaaaatacttctttttctttctttctttgtagagttggggtgttgctacattgcccaggctggtctcagactcttgggctcaagtgatcttcctgcctcagcctttcatgtagttgggattacaagtgtgtgccgccaaacacagctctgtagaaatatttcttatgtgtaaaaattgttcttatcctttaaaaatgctactgaaggataatggaagttttatggatgaactgaaatagaaggttcttagaagagtcagctgcatgtgcacaggcatggacagaatttacagtggtcatattttgaggaaacagttatctgtcaccagtgcagcagagggtcgtcagtatagtgcctggaaaggtgatagatcagacagttggaggacctctaactatacatgaaaacattgaaacattgacatttttcttgttttctttaaaagttcttgtgcaaagagttgacatgactagatttacatttgaaaatgtatggcagagtgagataaggattagaagggggagagagtagaggcgaggggatcacttaggaggccagatcagtggtgcagggcagagatagtggtggcccacagtagatccatacctgtgggaatgtgaaggaaggatgaatatgagagatagacagagatagaaccaatatgaccaaatatacacaagagagatggggaagagttaaaaaatgaatccaatcttttgagcctaggtgagtgcaataatgctgatgccatttaccatgatagggaacccaaggaaaacagtggttttgaggttaggagaaaatgagttaggtttgaatcgcaggttgcaatgggacttccagatagaagtatgtagcaggagagaggtaaaagttagaaatgaagatttgcaagtcactcatgtaaaactaatagttgacgtcatagtgttatgtgagttttcctcaatgagagaaagcagggctagcaaaaagaaagcccaaaacagaattttgggaaaacacctatcatctatgggctagggatgaaatgtcaacaaaacaaattgagaaggtggtgtcagaaaataattgggagattaatttattatatagaaacttagggaaggggactactagagacaaagtatataaaaaggggtcacatgcttccccatgtcagagggtcctaaagtgatgatgatcgtgatgatgaccatgatcatgatgattgtcactaacatttattggttgattactctgtgcaagcatgattagaaggtatataattatttgcatgtattagctgattgttcacttaggttgtgggttttattacagtgttggaggcataaatcatggtggaagagcttcaggacttagtggaaagtggaattagtgattgacctgatatgacttttccttaaagcacatttatctgccaagggatccaattttcaaaaaagcatagtcagatttaccaccaactctacaattcttgtttataattaatttatttcattttttgtggttctttgatgcttgtcatttcctatcaattttgattatcctaccccttgtagtaagattgcttttgattttgagatgaaaagaatttgctttgtgctgtgtgaactaaacttaactggggacattaaactgctgcacatgacagagagtaaagagctctgaccccgggattgctgtaagctcataagcaactggagtagtgtcgagtttccatgaaggctggcactgagagagtgctgggactctgtggacagcagtcatgttgctccagagctgaaaagggagagcccctactctgacagctactttgtatcaactatgttctgctttggcctcatacattctgtgtttgttcccctgaggtatcaatgaacgctagagttctctcatagccatgagacacaagagaattggtttagaaccagaagagccgatgtaaattccctgtatggattattcagatactgacagtgacgccactttgggatacagcgatgatgaagattccagtgacgaagttcaaagaatatcagagtcagtgcacggaaacctatatttgcaaatattttgggatatttttcatgctctattgtttcactgaaaggaatttctaacacatctgaaaatgttagaagtggcttaaaaagaggccactactaaactgcatagctttgattgtaattactaattaatcagcagcaattttgtaaaaatacctgttaatctgccaaacagtagctacttttgcagtagtgctttttaaagtatttattaactgcacaccgaaatcaactaatacagaggcacagaactagataagcgtgagattttatttttagagacaatttgcatgttggatgtggactgttatgtggctagatatacatttatttattataaaaaagcaagtctagtgtgctgaatgttcagaggtaatgtgtgtttggtaaaagtttttaattaaataaattgaacattataaccctagttataaagttctcttgtgttcaatattttaccaaaatgtcttgtattcttctattagaaattattaaataccctgatctgtaaaaaagtacaaatgaaagtaagttcagtttttaaaaaataatgcttttctcctctctttccttgtcctgcttctaaaccgctctgacgtgaaatgcccgctaacttggtagatgttctgtgtgaaaccagtatcataacatctactgataaaaatacatttaataacccagatttattaagacctttgtattatatgaatatgtaatattacatctttaaattcaaatgatatttgctttaccatggtccttggacccataaaagatataaacatacatagtaaatcacagtgttgtcagcttctatcattgacattctctctttagaagttagaaatttctactatcactcctaaaatgagagattaatacatgtcatatactaatgtcaaggattaatatatatgttaatactaaatcagatagtattttgtctctatctctagcaggctttgagtgcacaagaacagaatttacagacaccctcttagagagctacaagcaccttaataatagaaataaaatgacaccgtcatggcaacatgagtttgccattgaatgagcttggcgatgaataattctctattgttaggcaacattattacaaagcaatatagcaggctaggacatagctatggatgggaattctaacaattttaaaatgaaaatgaccctttcatattagttttacaattggaaacccataactctattagtgctggttctattaacaagtaaatataattttcataatgatggacagtgaatacttactgctcaaaggttattcaacattttaatgaatgttgagtttaaatctgatagcaaagcatataagcagcctactgttgtggaaagaacatgactttagggacagccagatctgtgttcaaattccagaactgtaactcactagctatatctgactttgggtgcattccctaacctctattctcagagcaccaccctttgttatgtgcaacaaatgatatttgtatgaagtgtttaatgttgttcccgacatgtactatatgctcaataaatggcaaatattataatttattgtttaatatgttggtttttccccccaatgtgatgcttctttccagttttaatatatgtcactttactaggtactacacctggctttaggccatacttgttttcctttttaaaataaaattttctatttctgttaactatgtcactcttctgatctttgatattttccccaatctacatttaaaaataccaatgcatcttctttttgttgcatggaaattgcattcaactttaaaagtatatccaatttaggccagataatatgacaaaattctgaaatattgtagatttgtgatgaatacatttttaaaaatctatatgcacagaagatatcttcaaaatgaagcactattttgtatttattatatttttaaaggatgtgggcactttcttaatagtcaaatggaaatatatttcaggaaaagctaaatttagtattatattttctattttgtgatggtagtttgtttattattgttattcatttatttgtttttggctggcagcaattgatagtaacttatgctgccatgaacaactaagaaataagtcattcacataatttatgaagaacccaatgagcactacagaagtttcctgcccattatgttcatttcaccaaaaattcccactatgaaagtgataacgaattgaaaatacattgcttacatctatggagcagaaagaaaatccccactgtgtttctgaataggagtgttttataaaacaccagatagagcctccacagagacaaccatgaaggtgttggggatgaaaagaattagaaataataaacaacagaacacagttcagctgggccaggcactatgttaaacttacgtttgattatctcacttaataccacatagtgagtggctactcgtattcccattttacagatgaggaaattgaggctttcacttgtgaatggagggaatggaggtgggtttaacaccagaatagtgcaactccaaaccctgagctctgccttcctaccccagggttcagaagtatgatggatgtctgtgccataactgctttaaacactaagcatgttgtatgtgtgaggcatttgggatgaaacggggagcaaagccagctatggtcccggccctcatagggtttagtggaaggaagacagagttattaaacaaatgactacataaatacacgtattaatataaattacaaatggtgatacatgcttggatggagaggtatgtagggctacgagaacagatgcataggaaacccaacctggtcaattcatgatggcatccctgaagaagaggtacgtaggctgggattgaagagataagaaggggtgaactaagcaaaagttagagaggaacttcctaggcctatggaaagcatgttaagaactcgtggcaggagggcgatgatgtgtattaaaaggaggccagtggctgggcgcggtggctcacacttgtaatctcagcactttgggaggctgaggcgggtggatcccctgaggtcaggagttcgagaccagcctggctaacatggtgaaaccccatctctgctaaaaatacaaaaattagccaggcgtggtggtggactcctgtaatcctagctactttgaacctgggagacggaggttgcagtgagccgagtgctactgcactccagcgtgggcaacaagagcgaaactccatcaaaaaaaaaaaaaaaaaaaaaaaaaaaaaagaggccagtttggccaaaaggcagggaatgtgagggagacactgggaggattgtgctgggagttaacgagactataacaaaaattttagagttaagatgatgtagtatggtgggtggattaaaatatgtacaataattgatggcttttttaaaaaacagggcaaccagtgagaaacaaatgaaaaggaaagttactcataagaaaaacataatatgcaacatataggaatacattttttaaatatcgggacccaagtgaaagaaattatgaaattgtatttaaagatatgaaattatatctgaacaagtagaaagtcatgccatgttcttatatggaaaaagtaatatcatcagaaattccttgctttgatatcaatgaataaatattaatataatacaactctactagaatcccaaggtgggtgtttcagaagtggaagattattttaaagtctatatgaaataataaatgcttaagaatatcatcaaggaatttctcaaaaataataaatgcttaagaatatcattaagctatttctgaaaaaaggattttagtaagggagaacatgctttgccaaatattaaatacaaatagttaatttaaagcgattgtaatctaaacagcatggtatagcaacagtgaaagacacagagatcagtgaaaaatagagttcggaaatatatttcagaatgtaatgtgtttcaaaagtataaaaagtcactgggaacatctttattctcaaaactttaagagcctgttattagagatgtgatgttttttggtttatagactgtattattaatgctatatcatttcatatgtacctatctctttaatatatttcaaacatattaattattaattaacttagaaattttattgtttttggaaaaagtaaattttcaagtatagcttattttgtaatttttaaattatttttaaaaattctcatgggtacatagtaagtgtacatttttatgtgtacttaggtgtacatagtagggagtacatgagatgttttgatacaggcatgcaatgtaaaataagcacactgtggagaacggggtatccaccccctcaagtatttatcctttgagttacaaataattcaattacattaagttatttaaaaatatacaattgtgttattattgactatcgtcatcatattgtactatcaaatagttaagtcttagtcattctttctatttttttgtacccgttaaccatgttaccatgatactgatactattaatttttaactagctgaaaatgaattgtgaatgttaatttatcaaatccacctttaactactggatcaaacataagataccaggatagattttcaaaggtttaagagattgatagatacgaatgcagtaacaaattaaatgcttctaaagagacaatatttacatgtttctatcagtgtgacttaagatttgtcaaatgctcttgaagaaccataacttctgatatagatgaatgactatgtgccataaattgccaaaacattagctacataaaaacagggtctttaaagtaaggaaataatttaaacagatcaattgttctcaaggatataatgataaattcatatacaaatggatcagatactcagtttctagaagtatagcttcaaattctttaaaaacttttgcatatttatgtttgttactatcttgatcattatccaactattttattaatttccccaaagggaatgatatcaaatttgttctacttgggtgaatgaaatttcaaatttgaaaattgcaactactggattgtaactgtaggatttgtatgattaatgacaagggtaagatgattcctcaaaaaaaattttgaaacataaacaaagcttaagcctggaggtggataaatcagaagagtttatataatgtaaattttttcctgaattaatcacaatggacactgtgctttgatattaaaggttattttatttgaatgtctctatttttcacatagggaagatgtgagaacagcaaacgtaattgctgcagaagctgtaacctgccttgtgattgacagagagtaagtacattgttttattatgtgaattacacactcatatcagcaacacacatgagttcttggaattagacatcattttatggagctattaatacttgttttatatcttttcatttttaaatgaattctgtatttgtttctcattccctattcttaaaagtggctggctctgccattctagctttgtgatctttaacaaggtacttaaccactgtgagcttcggctcagctcatttgtaaactgaggtaatgaaatatcatacagatattttgaggattaatgagaacatttgagtaaagcatttgtccaagtgtcttttactcaggaggtactcaaccaatgctagttatttttgtaaatttttagaattattattccatttttgttaagaaatgggttatttttttagtagttttagttatgccctctattctcctatctccagacttccataatagaagcatttagggaagaaacttttgaagaaataatcagttctagacataggcatatatttaaggccattaaaaatttgtctgataatgtctatccctgtttcttctctcagttctggcttgctcttttcattacctggatgctttataagttaagctgcaaatgtcagattattgattctccaagagcatggttaaaatgcatatgtactttctggaagcagtggaacaggcttttcttccttgtaatgtatgtggataaattcatcgaatagccaagtacatgacccaagaataactgtaaaacatccattttagtggagccattcaaactggaataggcagtgagtaaccacatagaatgaacctgaggagccaggtatgattagcctagaatgatggagctggatgccgagctcagaggactccggatggagagaaattctacctgatttacaaacctcactttgagaggcccttctatgctggatcactagaaccagagcagagacacagttgcagaatggtagcaatatccatggatatttctgaaattgttatattttgtctggttcccaaaaacaataattaccaatttgctcttccattcaactcacattttactgagaatctcccatgtgcaaagcattgtcctggaagaagattcaaaggagcagcacagatgctggttttaagagttagcgtctaatagagatgtggcatatacaaaaataaccatgatacaaggcaaaaaaaatgagttcagaataaaattttaagggaattcagaaaagagagtgagtacttttgagaagagtcggggaggtgttaaaaagtgttaagtggatgtggaagtataggaaaagcaatataaatatgatgactagtgtaagaattactcataggaaagctatcagccatttaaactggctaaagtgagactgtgtaaaggtagttggtggaggtgctgtaacaagttcacaagcatgctggcactggttcactgagaaaattgaatgttgggataagggcagttcagaccattttatgcagcaaaaagttatcactataacaatggatttaatagactaatctgagaattcagtgtaaaacgaattagagggagaggttagagacaaaatatttggttaggagtctaaattcagttggtgattatgagaccatgggtaggaggaacccataagaaatgaagaggtaaaaccagaaggtttcacgtcttactgaatgtgaagagcaagggagaaattagggatgtagttgggatagaaaagatgtaaaaggaaagtagaaaaatcagtttggtaggtacgatgacattctactaagaatgtaatgcattgaacatacaatatcgaacactcaagaatggatggcctgtaggagacaggaaatgtgggacagaaactcttgttagaattaacttaaaattaactttagaattgcctacatgtggttagcagctgaagctatgagacaggacagaattgcatgaaagaatcgagaagaagattaaagagccaaggctagatttggggaaatcctttcatttaagcattagggaaagtaaaaccagtgaagaataatgagatgttagaaagcagagcggtgtaggagacttcagaaagcaagaggatatttcatgagaaaagagataatcacagtgttacaagctgagaggcatgcagatagagaaaagggcaataggcttagtaacctgggagaaaacagttttattaaaatgttaagaatggaatccagattacaaagtgtgactaggtaaaaaggaagtgagaacactgagcttacagtatacaagtatccaggaagttggagcaaatgaaatactaaaggggatatttgataaatgggaccccaggggagaaaatagtgggcaaatgaggaaaggttcttggagagcacatatatatgtatttttgattttctgaaaagtgaaaaagaggcaaggtagaaaatttgtagagaaatgccaggatgtagataaggatcgttgtgggaacttagatggagttaatcttgcctcttttaaagcatgaagcaaggaaatctagtgaggggaggaatgagactaaggcttttccctaatcctaattttctctccttatccaaacctaggcatatacagtgtacactgacaagtgaatggatgtggtcaaagctcaatacttgaatcttgactacaccattttacaagaatatgggtaaattacttaaattctgagtctcagttttcctgtctgaaaaattggataacattatcaaaattataaaattgatttgaaaatcaaatgatttaacataggtaaatgtccatgcacagcacaatacatgaagtaagcactaaataaatatgcccttcctcttcttacagaaggcataggattcccttggatttagctgtgtttctctctactcagcattggtttatcttcagggttatatacggagaagaaaccttgagagaggtctaccttaagcacaaatacagaaaaatcagcttgagtctaagaattcaaaaagtgcatttgtatactcttagcagagaaattgggtttctgaccaaatgttgaattcacagctgtattttttaaaaaatgaaactgtaactgaaggatcctgtcaaaagcctgctgctgatatctaatttatggccaattagaagagcaccagggcttcatcccatgcaaacagatggcagacattagcactgtcaacaaaagtagcttcctttacaaatttacaagcgaggtaccatgttccgtaagccagtgattatgctttatcattccagagggagagcaaaagaacattattgtaactaatcatgcatgtcattgacaaaccagaagatgataaacagatacatggtgtcctcaaaggcattctctaaatattggttttttgtagtctacttattatcttaataagtacctgcagtgatgtcaaaatttatgaatattgtataaaaagaatattagtctaacagaaccatccattaataaatttcttaaatatataaaaaacaattaagtacctttggtacctcttattttggaatctgtgaaaagaaataaatataaaactaagtacagtcattctttagtatccacgggggattggttcaaggaccccctttgaataccaaaatccacagatgctgaagtccctcaatataaaatggcataatatttgcatataacctatgcatgtcttccctgtactttaaaatatatctaggttacttacaatacctaataaaatctaaatgctatgtaaaaacttgttatactatattgtttaggaaattacgagaaaaaaattctatgcatattcagtaaaggtgtaaccaatgtctttttcagctaaatctttttgatctacagttagttgaatccacagatacagaatgcatgaatatggaaggctgactgtatacttttgtattctgtaatctgttatgcaatgtctgcttattcaccgttatgggaagctgtttaaactaaaagttctattaagataattgattttttgacacattgaggatcattttgacaattgttcaaagacagcaacttataattattagtaaaccttaaagagttgtatatttttccccaggaaattaagatttaaattatcagggtcctaactctatccctgattcactgtgttgcctctgagatacagccatactggttatgaaaatggaaacattttcatgctggatggtaaatagcactcgtctgagatccctgcatgtctctcccactcctcttctgccccagttgtctgattgccccctactcctaggacattctagatccttctttaatccagcaagtaaggaagtgacatctggcaaaaaccgggactattgtccatttttgttggtcagttcctgggccctactggccattaattatctttcctttcacctctgataatgtcaagctaaaatataatgtcctattatcaattgttttcatgcttttgctttaccaggcccattgtttaaataaaatcaattagaaagaaaacagaggaacttttctgtttgtcatgggagtaagactcctaaaggatccagtggtcttcattctttccctcagaatcactccaggtgattcttgaggcccttgtgggaccctagaagacactaagaatgatttatacagcacacatggctgatgatgtccctaccatcagtgacactctgtgatgttttctcataccatggggccagttttgttattgggacagtctaggaagtagagaccaagaactagcccagagtaaatgcagtgtgatagagcataaaaattatgaaattaggaggaaatgtcaagcatgagattgtagggcattgcaagtagcaatctctgaaactgagatatctctagatatcagggaagtctgggttaccatgtttcaagtttttgacctccccaaactatagtcacctgatatattcatgccatatatttaaaaatgtaccaagactctcaccataattggggagcaactcataagatcaaggttgatcccaaggtccataaataataaagtagcaaatatattactgaagaggattagacacagagaaaaacgtcactggagttggcaaactaaagactattccttgacacccagactggagcctaagtattaaaactgggtatgttttaatagatttggcattagagctagactaggcaatttttatatttatttatagagaaagataacaaggaatgtctgattcctgtgtcaggtactgggatactgagatgaacaagacacaaattcaaaataggtttgaaaactgaatatatgtatagaaccagctcaattagagacaaattggtgtctgtattaaaatggttttttgttcctttaccagtactagtaggaaaacctcagtgccttccacatgtagcctctgtttagaactcgtttgtaactctttagccacaacagcatcagtccccaaggatacagcttctgatgctggtctctatctcaatctcctcccagccgcattgcttacggtgagtttgtgtcttcctccatttcctgttactgcgtttattcagatattcaactccaagttccaggggcaaagaaacagaaatactgaatccatgctctgggataggaagatcacacagtgaaccagccatgcaggaacctgcatggccattggaacccagagtgccaaatgggatagaaatatgtggagaaaatagtatttatgtaactcttctcagggaggtgctattggtgtttctgataagcaacttgggattggggggtaaagctcaccaaggtgcatactcaaggtagaataggtgatcactaaactgcctggtaggttgcattaagtgtgggagttttatcttctgagtggggtctccaggcatgactctattatagaactacatgactcggacaaggggttggcaaactttttctgtaaagagccaaatagtaaatattttaggctcatgggacaaattacctttgttgcagctactcaactctgtctttgcagtgcaaaagtaactaaagatgatatgtaaatgaatgaagacagatgtgtttcaataaagctttatttatggacattgacatttgaatttatatcattttcttatgtcaagaagtattattcagcatttgatttagttctcatcattaaaacatgtaaaaatcattcttatctcatgaccataccgaaaataagcagctgacagaatttggcctgttggccataatttcttgacccctgacttaaacaatattagaaagtggagggctatccgtagttgtcctgctccagtttttctccatcctgtattcagctttttaaaataaagcaaatacataaaaagaactgatttgaagcgtctgatcagcactgcccatggtgtcttccagtgctgctcctcctgatgccatctgtctgtttgtcttccaaacactggcaggcatgctttactccatcccctcaatttcttcacttcactcttctgtacacatcttctgtaactctttcgcattgtatccccatcccactccactccccatgcacacacctctttttatagttgattcctgcacctcttaattccactcttgcattctctagaagtttgcttcagattttgcatcaatttggtaatagctaactaattagagattaaaatggttctctgcaatagttatttgcattatgataacatacccctgaggaatgacaaatcgtgaaaatccagaagaatctttcagaatgtcaggtgccattgggggagagaagagggaaagtagaggggagatttggggacagcaaacccttgcaggcaccactctaagatcaccaactaggtcagtctcaggaaggaacatgcacccaatggtgatttgcccaccgaggtcacctgtattcttcttcttatatagcttgtcactctgtgtccacatgataggactgtatgaactccacatgtcacatcgcccgttgtcacattgcttaactaataggatgatacacttaaaatatttcacagcctcagcctttcctacagcctaagtggattttattttggttcattttccagaataaaatctagggtgatgtgaggatattggcaggatggtcacaggaaaacaaatgtgcctttttagaatggtgtcagctgcaattatttgaacttgtctttttttacagagctgttattgactggtgtgcttctcaaaaaatgtgtattaagcaggaaagataaaatctagaggtttagaagaaagagtaacattatattcattcaatttaatgatgtgggttgaattatagcatgccctgaacaagcatgatctaactacaaaataagtacattctcattcgaaaaggagtataccctgagacaacatttgtggtttaaagtcatggaaagagacagttgagacaactcctcatgtttgcctggctttgaaatggtaatagacattcatcctatttcaagtccttatagcaatgatatacagcatgactgactgggatgcccagactgttggttcatccacccaaccagagcttactggttacctgccatatgtgaaccatccagacatctagtatttgggggtttaaaggcaaatatttaaatattatatgcttatttccatctctgttatatggatagtttccagcaataatctgttaagccacaaacttacaaaggttctctttagtaaccttttgactctgctcaaagtaaaagaagtccagtctcaatttttaatatgctggtgggccatcaatcaaaatttaacacacttaagaaattattgttaaaaaatgtatatggtaagtggataagtcagaaagtcatagaagagatttaagaaggagaagtaaaagggaacatacaaaccagagcttaccaagcgttttttagaaaaggccaaacaataaatattttcagctttgtgggccaaacagtctgtggcatgaaaactcaatgccatttcacccaagggccatagttttctaaccccttttataaataaacttatttcacagttgaagaatttgagtcccagaagtgtcaggtatactcaaatcacactgtttaataagaattaagacagatcgggtattcacattcttacactataatgcatttgttatatctcaggattttagaaaataatgagggtttgaaaaacctcttttccgaatcctttagtttaaaaatgaggaaggcgagtcccagaaggagtgtggattgtccaagctctttaatgttaagggtgggattacagcacaggcctcataacatctgtttcagtgatttttcacctaccccacattattctgtaaatgactaagatagaaaactcatacatttattaattcaataagcacatactgagagtatcaagtgggttttatgctcagtgctatgatatatagggatgtctaaaaagagtttccttcaagaatcttggagtcatgaaaatgaataaatcgtatgatagtccacctgaaaaagaggaattgatggcttatgaattgaactaaaatattttcattgaattaaatcttaatctaattacactacttctaaatatatatagatatatggatctttatagatatctctcaatatatagatcaatcgatcagtggtaaaatatttgagttccaaatgactcttcaaatggataagaacctcacgagtcacatctccatcatcctggctaaatatttggaattagaatttaaatgacaattttatcaattcagctaataaatttatttcattaaaaacatgtgggcccttactagctcactcccctcacatcccataacagctttggttcgcctgttgattttcattgtaccgtccttttacttgccataccatacatttacaacactcgtttatctgtattaacttacaaactacaagcttaaggaggacaggactatgtttatttggttcactactgtatccacaattagcacagtatcaggaaatataataagcacctactatctattgaaatgaacgaatgaatgaatggatgatgccatattagtctgaatctaatcagcatatagtaatttgagcagcaaagtgttatgataaaaaaaaatagtaactataataggggactggaataataagggattaccaagtaagaagcaaagaaagctttagaacatatagaaatagcagctataaggagtattcactaacactactcctgtgagagagagcacccagtgaagacacctcccttcttgccaccccccagccttccccattccaccctgctgaggctgagagttacaccttgttatagagcagggtccctgaagcacaccactattgacatttggggtcagatagttgttttgtgttgcgggggcggggctgtcatgtacaaagtaggatgtttggcagcatcctgacctctacccactaaatagtagtatccctcacctctccagtgtgacattcaaaagcatgccctgagcaagcattgccaaatgtctcctgtggggtgaaaatcaccccctgttaggaaggatatagtcattacttactggatgtcagtgaagtctctgtgatgccaagccaatagaacttgtgccaggaatctgcactgtagggtgcaggaaagctctgtaaagggagagctttaaaaccacctgaggggaagtccgctggggaagctgctggctgccatgtactgtagtagccagacacaagagaaacctcaagagcctaccaagaacactggaaccaggaagctgaacccttttgtccttgaagtatctccccaataccttctgccaacaaagtttcagtgccagtcaacccgatccacttttacagagcagttaaaagagtaaattttggactgagagggaataaatcaattatccatacagattccaaaccaaatcctattctgggatccagagatataaaggtgaatagcaaagtcttctccttctttggattaactcttggtccaaacagatgcattcaaaaatcagcatgagaaactgcattttgagtaagaataaaatacttggggaacattgaggatggaggaatatgtttggctggtagcatcccagaacttcctggacactataacatgagagccaagttgttaagtttgagtaggtatattacaagtgaggaaggaagggtaaagacagctactgctgagggaaggacctgtatagaagacaaggaatttagaaagacctttgtacagtaataaggggagtgtggcaataacagaggatttatgggacaaggaactggataattaggaggaaagctggaagatgtgtttggaaagaagagatggggatagatagtaaataaatatcctagtatctcaaactaaaataatctagatttattttgggggcaataagaaaccaacagagaaccattggaactgtattttgtatctgttttcgaaggaagagagtagcagattaattacaatggggaggaactcaaacaggcagacttttaagatactgctgcagtagtcctaaaggatgttcattagagcttaagagccttaactttagtctagggccaggcacagtggctcatgcctgtaatcccagcactttgggaggccaaggcaggtggatcacttgaggtcaggagttcgagaccagcctggccaacatggtgaaaccctgtctcaaccaaaaatacaaaaattagccttagcctagcatggtggcacacacctgtagtcccagctacttgggaagctgaggcaggagaattgcttgaacccaggaggtggaggttgcagtgagctgagatcgcatcactgtactccaccctgggcgaccgagcagactctggctcaagacacaaaaataaaaataaaaataaataaactttagtctaaagtagatttttattaataattaaatgtgagggatgaaagggaaatgtttctagtttaggagacttggatgtatttaataaataaagaaaaaataatagatgtatgtaatagataaagaatagaacaagacagagcaggttgagatggaagtaactggctgattcagttacggatattgcaagctcaggctgcctaagtgatatgcagatagtcagcagatgtccattggcagttagaaatgtgagttttgttttgttttactttttacaatcagatgatgaatggaaattgatgttggagttcataattattttaaaaatataataatcacagctttgattacgttaattacagttattgttttgttttgcaccaatgaataaataattcatttttttccagtaaatgcttgaaaccttactatatttctaagacttgcatttttgtccattggatgttataaaacttgttatttagaaattcacaatgtcttcggaactcataaacaagttgtatgagtgaataagaaaatataaaagatttcagtttctaaatcataaatatccatcttaatttcttcagttaaaaagataatatttgaaattttatatttgaaaatctctttaccttttttatgtacaacatttggctgtttatttgaggagacgttataatgcttcttgtgttccagaggtaaaccagggaggtggagggcaccaggatttatttctgacagaagcttagcaatcagtttaaaaattcactgtatagtcatgaagtttgagagttgaattctgctttagacatccacagcacttttttggtggagttaaatggttttgcttactttagtattcacacttgcctggtgagacagttattacaggcccagctgggtcataaagatctaagacttttcttttcttttcaatatgtctagcagttggtactcgttttggaactcatagcatggatgtatgaattggattagcatcagccacaataacagtgaaacttcattcccagacagctgtgtttacaaaggaggcctttttagaatttacttctttgcataaagtacaatgatcatattagccattgctttgctacagtcatataattgaattagttttaaatggaaagccagactagcaaaggcaaatcatgatttgcctttaataggcaagaagggtgttgtcctcctagctgcactggagacagtacattgtcatctagacaagaaacccacttgggctgaataacattttatttaattatttttcattattcccatggggttcactttaaatcttctctctttttttacctttctaatatagtctatgtcatatgattataaatgtaataactgtttgttttagaaagattggaaagcatagagacatataaatataaccctaccattcaaagggaattactgttgataatttcgtgtccttaaatagtgagataattctgcctagatatttttctcctgcgttgtctacatcctggggcagcattaataaatcacatacacacagatagagatattaatatatacacatagatgctagatgtactatagataaatagtcattaatttttctcacagcaaacttgcaaggaattcttttttttctccatttcaaaggtaaactaagcttcacatagccaaactgtcaggttgcaaaacacacagcttgtaagtaaagaaatggtatttgagtataattctattttcaaagcctattatagcacatactttaccacgttgcattagcaatttaccatgttaataaaaacacttcatgtataattgagtttctttgtcatagtttcttgactgtgcttgggcatttaagctcattttaattttttattttgtaaagaattctctgtgttaaactttacccctgttttagaaatatgcagtattagaattactgattcaaaggatatgtattttttaaattattgcctagaatcattatacagtttactctccagtgacaatatatgagaacatctgttccactgcaccctcgccagcttaagtttttggttgaaacaacatgactggggtgaatcagcccaaggcattagttacatcaccgtcctaaaagagttagtttgacatttgttcttttcttgcagttgagacatggaacttaattatggacagaatctggaagattgttcattctttagtgattgcttctttgttctggaaaagaataaacaaatctgagacttcagaaaactgggagtagaaatgagctcaaataaacttcctctgaaatgtcaaaagtaaatagtaaaggccaacaaggtacctaaagaaagggtagacaaaagaaaaatggaaattatccaagtaataacttacataggaacaaaacattatgacttgagaagatcccagtttatagatgatatagattgtggtcagtggtggaaaagaaaggaagagttcacacaagctaatttataaattttctcagcatccaaatatgatgtttttgttttaatacactcatgtcagctaatccccacaatagccccatgggaccagaaaacaaaaacagtttcagagagaaattaatgatcagaaagacccagtgacttggtcagagttacattgctgtattggaattccaggcctgtctgcactaagaccatgctctgccaattataccaactcttgcttttataccaacaaagtaagtggtaactggaaagcgtggttgtgtttggggaaagagtagggtgggagagattaaaggcagcgaaacagaggatgcttctgaagtaagaatgtcaataacctgaataaggcagtagaagtagaaaggaaaaagaggaacaaattcaagagagattgcaaaggtagaccggatgggcttgggtaaaagggaaaggtcatagataacaccaagatttctatcctgaattattggtaggtgataatgccattagaaagtcagaaaacctaacagcaagtctggatggaagctggttaatacagttatggttaggttgagcttgaggtacaggtgagacatgcatatgacactgagaaaaatgatgacaatatgtatccggagagttcaaggatacggatatagatttgaaggtcatcggcctggggatctgaactgaagtcttaaggttaaatattattttatgggaaaacttaaatcagtgtactatgtaagaactaagttctaataaaaatcagactcctgggatcaaattctagatcactttccagctatgtggtcccaggcaagtttatgtaacctctcttagccttgtcacttatgtattctcatctaggtaacattggcaatgcctggagacattttttgttgtcacaactgggtttgctactgttatcttagtgggcagggttcagggatgctgttaaccatcctacaatgcacaggacagctccctaaaacaaagaagtatcttgtccaaaatgtcagtagctctgagtttgagaaaccgtgctgtaagtattctataaagcagagataactgtacttaccttgtagagatgttgtgaggtttcaatgagatcatgaaggtaaaaaacaaaactgaacatatcttaaacaagaaatatttaagaaaacaaatttaatatattgaatagaaaaaaaaaggcaaaggacacaatttgggaaaccatttacctttaagaaatgtcagaggaagaaatgtgtgtcacatatactgaaaggtagcatagagggagaagagaagaatcgggaaagtggggcatcagtgatcagcacagagccccttagtggagtgccatgagcgtctattgcatgactgcaaccagggaagaaggcgagcaggaccctgaacctcagatagctcaccgaggatgggacctggaaagagaccactggggtgaatggttagcagagtcgtgataactttgagggaaaagttgtaataagggtgaaagaaagatgggaatagaattccaggcagcaataggctgagaattaatgaaaaatgaggataagacataggaaaagcagcttcttcacactgactatttgaccacagaggatagttttgcttttttttttttttttttttttttttaggtttggaaagaacatcctgtttagactgaaaagaaagaaaagtcaaaagggaaacaacaaaacaataagaaagattgtaattgatggagcaagagtccagaggagaaagatgaaagcctctgtgattagtagcaatgaaaaggagacttgttttagaaaaaacatggggtacttcctatggcagaaaagtacgatgataatgtcactgcacttgaagtccagggaaaaaatgcaaatctatttaataagattttcatttgtagcttttgaaaggttcataaaaagctgagttctttttatgaacctttcaaaaattacaaatgaaaatcatattaaatagcccaaatacacaagaaaatgtattgtctagactgccattggtgttccctcattagacttcctattaaggactgaattatgtccaccccaaatccatatgttgaagttctaacccccaatgtgactgtattttgagacagggcctttcaaaaggtataataattaaggttaaatgaggtcataagggtggggccctaaacctgtgggactggagtccttggaagccaggaaaagacaccaacagggcgcacatgcagaggaaaggccatgtgaggatgccgtgagtaggggcctgttagccaaaggcaggacaaaataactcaccagaaaccaaacctggtggctccttgatcgtggacttccagcctccagaatggtgggaagataaatttctgttctttaagccacccagtctgtggcattttgttatggcagcctcaggggactaattacttccctaaatggaacttttatacacataatacaataggagaaagaggtgacctattgaaataaaaattatttatcttaaggaatcttggccggctgtgatggctcatgccacttatcccagcactttgggaggccaaggtgggtggaatcacttgaggtcaggagttcaagaccagcctggccaacatggtgaaaccttgtctgtactaaaaatacaaaacttagctgggcatggtggtgggtgcctgtaatcccagcaactcaggaggctgagacaggaaaattgcttaaacccaggaggtggaggttgcagtgagccaagatcaccccactgcactccagcctgggcaacagagcaagactccatctcaaaataataataataataataataataataataataatttgattggccataagggcaggatttgagagagagagaaagcagatatttaataccaaatcttagacacaactattaactagatcacctcagatttccatattggggagataaatatggtgccaattacggctgggattgcagatgttggaaacaggttgccttggttcaaatcccagtgttgacacttactagacatgtgacctcgagcaaattacttaattttcttagccttgatcaccttacctgtaaaacagggaacatccatgtaaaatagtttgtacaatcctaatacatgctagctagtattttcatgttttatttgaaatttttatattgctaagttatataaacattaatttgtgacataaagggatgcattcattggtaagcttctaattattttttgggaaaagtatgtatttccctttctaatcatgtaatgagagcagaaataaaaagtccagtaattgattgatatttataaaaatgttaaactaatgtctttgtttcaaggagtttcacagcataaataacaaaaagtctactaaaacagataccttgggatagatttattatgccattttaggatttcactttcaagttgcttaatagaaaatcagtgactatcatagtatttgcattcccaagatatttttcttagccagagtttcccagaagcagtttttaaatagtcagttactaaaaagtggattgttgtaactgatatctactataattgatatgtctatataaactagaatatatcagctatagatttttattgtttttaataaatatggcctatttgtttttagacaattttgataggatttttttgccaattatacgaatttgtaaattttaaataatttgtaagtagaggagcctgaaatttttaaaaacatttcttttaggttttagggtacatgtgcagttttgttatataggtaaacttgtgtcatgcgggtttggtgtgtagactattttgtactcaggtactaagggcctagtacccaatagttatttttttctgctgctcaccctcctctcacctttcaccctcgggtgggccctagtgtcggttttttccttctgaaaattttttaatagataagacgctcattgttgccatagattctgctttgagaataccaaaatttggagaaaaaattcacatttgcttctacataattctatcacaaaatggtcttaaaattgagaatttacagtgttatgaaaaaattaatttagtattgatagtttgtttccattgggaaagtatattattttgatgaaattaattaaacatatgtgaaacttatcattggttttcatgtcaaaacagtgtaatctggtccagaaaagcagtgataggaagagtaatgtgtaatatctacttttgttagtatggattttatatagtaaggtaaagagagttgctaacacttaaaataattgtccagccacaaaaagtatgtccattgcatggaccatttgatttaagtatagttgagagatatttatttttaaggaaaaggaaacatatagactgggcacattagggcaatctattcttatattttcctcctaaacactgaaaaggctaagaactatcacctgagatttgattctaatttctcctgcttttaattgaaaatgaaagtcatgctacattttaaaatcctttcttccactttaattgcaattgggattcatggatataaatttcattatggtctaaaataattaccctcatttaatgtcctctatataattcaatgttaaattgctaagtgtttcaaatcactttacccgtatttataccaatgtattgctgtattaggatgctaggcattcattttaactaagcctttgtcctaagagttcatataggtggataccctaagacatacagaggacttttaactcatatatcttaaattttaaataaaactttgcttcagaaacttaagagtttgctagtcatatcctgggcacatacatatacccaaatgaataaatgagtaagtggttgagcgagtccatccagctatttattaattcattttaaatttctattacaggccaggaaatactctagttcctaaatagagatactgataaagaagctagactaggtgcctgatctcatgaaatgtacattttggcatgaggaagacagcagatatttaaacaaacaaagtgatttttagctagtggtgagtgaaaatgagttaaaatcacagagtgacattaggaaggattttgagtgaaggctactttgcatgggttggtcagtcctgtataaagaggaaacaattgagctgagacctgaatggtactgagaaaaaaccatgaaaatctagagaaagaatgttccaggcagaagacaaaggccctgaggcagatgcgtgaagtattctatggtcaaatgtagcatgggataattcagagaagttgtagaggtcagcagaagagtgacacgatctgatttatgtttttaaaagattactctgcttactgtgtaaggatgagagaggaaataaaggaaaaggcagttacagaattcttcagtgagaaaatggcagttgagacccaaagataatatagaagaggggattcatttcagattattgaagttagaatatacaggatttggtgttggattagatacagaggaaggaagaggacaatctagaacaggagtcagcaaatgtttttggaaagggccaggacattaaagagtatctgtaaacgtggacattaaatagctcagtttatagagaaggagactgaccaaaaactaacaattccagaactctgcaatatgctctgaaaagcaaccacaaggtatcagataggattcagaaagaggcatataggtgggggtgagagagaaagtgagtggtctaggacagtgcttttccaaggatctgtgcttaaggaccagttttgtttttattttcagcccatccattgtggacagatgtttttgtaaaacaaaatacaaatgaattgctagaaaaatacaagtgaaaaaaagcatagaaataaatgccactcttttttcctattatattcagcatacataaaatcctatttcaataaaaatattagaacaaacataatgccagataaaaggaaaaaaattgccccaattaatcacattgtcattgaaagcatgtgtacaagtaataaggaagataatggctattatacttgtctaccatcataacaaaaccacaatttatgagtgaaatagcaattctccattctgactgcaattggtacactttgaaagaacactgtggatttcactgtctagtctttaatgtgtcaaatgtgcctgtttcttgattgttaacttttttgatctaggttagatggatgatggaaatgccacttgcagggagtaatgtgttctttagctgttttatgttttgtttaatacactcagaatagagaaaccagtctcacagagtagaactgacgggaacagaagaagtgattttaaagtagtatcagcatactgcaaaaatttatttttatttatttatttattcattcatttattttgagatggagtttcgctcttgttgcccaggctggagtgcaatggcatgatctcggctcactgcaacctccgcctcccgggttcaagtgattctcctgcctcagcctcctgagtagctgggattacaggcatggactaccatgcctgactaattttgtatttctagtagagaagggctttatccatgttggtcaggctggtctcgaactcctgacctcaagtgatccacccgtcttggcctcccaaagtgctgggattgcaggcgtgagccactgtgcctggccttcatttttatttttattcaaaatggaacaagtgatgttctattttagttaatccttcattagtagctagttctatcaattgctcctgtaaagtatggttaaattttgattatcttttgataagataaatagattctgaatttatatactttaggttaaaattagcaaactaatcttaaaatagcacacatttaataataccctcttactcatgacttgtatgcagcttttaccaaatgtttctcaccttatggatttgacagtaacagaaatctgtaccctgttcaaaaacacaagtccactgatcttgcgcttggatgtctcagcattgtcaaattgctagaaaagttcctaaacttctgtgcttatgtctttacagactagcaacaaatagtgggccaactatactttgagtagcactactctacaaaaagattgtgaattcagtcatccttagaaaagggtgaatcatatataggaaacttgtatataaatatttaagatagaatatttataatatcaaaattgtgtgtaggaaaatctcaaaacacttctttttaaaacagtgtttctctttttacaccctttattaagatgcatatattcctttttatttcaatatttttggagtacaggtggtttttggttacatgggtaagttctttagcggtgatttctgagattttggtgcacccatcaccctaatagcgtacactgtacccagtacgtagtcttttatctcccaccccacttccacccttctcccctgagtccccaaagtgccttatgtcattcttatgcctttgcattctcatagcttagctcccaactataagtgagacatgatatttggctttcctttcctgagttacctcacttagaataatggtctttgactccatccaagttgctgtaaatgtcattatttcatttttttatggctgagtagtattccatggtgtatatataccacattttctttatccactcattggctgatggacgtttaggttggttccatatttttgcaattgtgaattgtgcggttacaaacatgcatgtgcaagtgtctttttcatataatgacctcttttcctttgggtagatatacagtactgggattgctgcactgaaatcccagtactactttaaaagttctacttttaattttttaaggaatctccatactattttccatagtggttatactagtttaccttcccactaggaatgtaagtgttcccttttcactacatccataccaaaaatatgtatatattcttaacagttaaggattaaaagtgagaaagagttaaaaataaaatcttaagctaatgtttgtcaccaatatttcaacagtagaattactagataagcaaataaacaaaaaaatcgagaagtttagtcatttcatattggatatttctatgtaaccaggcgtgtcctacatgcttgactggatagttttccacacttaaccattaagttggttatagtataagcacagacagcctaaaatcaagtaagtactaaaccaatacaatttcaactttgaaataactgaaaaaaaatcaaggaggatacatgccaaagtgttaacgtttagctcaagattgtaaaattacaatacatcttttatcccttagagttctttggtgtctttcaatttgttaacctattgccattggacacacacacacacacacacacacgtaattttaaaattcaaaactagatgatttcatttgattattataataagcctagtcaacttaacaagaccctgtcctggaaaagactgatttatatggacatattagacatggaaacttgatcaccactaagtcacttttttatttctcaaaagtgacagtaagtaaaaggagataattcctgaaattaattcttagctttttattcctttgtgcatatgccagattggatcattattttcaaatggtggtaccttttaaagcacataattataatcaggaaacagtttaaatgaagtgtttgttatttgaaatccatttttctagtgaataatccccatgatagacagggggatattattacaaagcaaagacacagacaaacatctaatactctggtgtgtgtaagtgtctcttgcaaatataaacatgtgcatgataagaaaatactaataattagttagttactcataaaaatgtaattgctttccatgaaattactatctgatatgattttgagtagatgaaattatttttatgcacgctatagccttccttctgataagcattcagctactcattacttctcacgttcgtattataagtctttgtgtcttatctgtaatataaggctctaaattcctcaaagttgtactttattccttttgcataatccacagtagcttgaattgtcccttatagatagtaggtattgtatatgtacatatgtgtgagtttggttgaatggatggactgatggatggatggatggatggatgaataaatggatggataactgggaaaatatggatgtggctggttttattttatttgggggtaattttttctccaaggaaacatatattcacatgatagttgatagtataaaccgctaagaattatgattgtcccgttataaataaaataaacaaaaaataacaaacataagaacacttgaagccacaaagtaaatcaagggattttctgcataagtgtgtcaaaacaatgaaggatccctctgaaaccttgggcttagctaagtaaaacgtctcaactactttggaacactaactttctacatttttaaataaatatttttttaaaaagatttagatgagattcaggttaacaaagcataacggtatagcctgtgaaattaagaaggcgtagccaagcattctgataatacctgacaaacattttgcttagcattattgaagtgtttgaaatagcttccaatttaagattttaccttttacactttttgacttataacatttcactattaaatgtaaaaaagaaaaaatctgttttgaatgttatgagactttctcccaccctatttttaatttgaaaatattctatttttaaaatgtttatacaaaattctaagccactatatcataataagggataggagatcatgagaattaaatcaactaactcatacactgtatatacacaccaagtatatatatatatacatgcacatatatatgttgtgtatatatacacatatatacatatatatattgtgtgtgagttagttgatatatatatatatatatatatatatatatatgtatatatatgtgatactttgtaacctgtaaagtaaactttaaatgctatgattttttagcagtggtaatgctgatctctgatgtttggactgcctttctaataatttaaaagaccatttctgtctagatgaagtctcattatatcacaactgatgaaccgaattatattctttttagacataccattgagtaatcagctcccttcagaagaatgttttgccttaataatgaaaacattttaataactaaacttattacccactgaattacggtcatccttgacttctaaaacagacacgttttctaaaatgagaaacagcctcttaactgatattcctaaggacaatttctttaaatgtcaccattcttagtgtgtaagagttatagtttcttctccctttctgtctccctttttccatccacctttcactctttccttcttcccttccttgttcttccttcttccttcctctttcctttcttttccttccccacctgacaagtatgtctaaactaccatcattaaacatgaaagggatttcccatttgctctctttcaatatctgtgtactcaactgataatattttacccatgctccttaaagtattatgtcaagacttgtaaaatcagattttctatcccaagaaaagtaacagaaaattttgaatgaaatatgtgcatgcataaaggtttgctgtggagatgccctaaactaaagccatttgctcggtaacatgtctttaatttcttccgaaattaagtttagcatgtagaaatttggtattttattttacaatgttaaaatgtaacgtgtgtatgaattgtgtttgtttaaaaagataatttaatgatttttctgtagtcacctatatttgttaaaactcataaataatattttctggtttctacttattcagttgctggagttttcacaacatctcattataatcattttcagaatagaataacaatcaaaaaaaggcattagtcaagaaatgtcataggacctgagtaactatttagaaaagcatctgatacctatagtagtacttttctgaatgtctatttgatgagggttcacacagatgtcaggtgttcctacagagtgtctgagagaaggaaaaatgaaacactaattggttcatttttgtgccaggagtgataaattctataacaccatcaattatgcttatcaagatgtcttaaattactcattgatcagtacagggatctgcagacagtggcagtcatttggaacttaataatattacttgaaaattctatattttcttaaacttccggttatgtataatggttgacttattgtttgaggagacttagaatctatcagcaagacacatttgtttaacgtttcagaaaatgtattcttttggctaggatcatcttctaagtaaagattatttattaaggacccatggttccaattccaaatgccaagattatagttctgagtatttttattttgaaaataaattctatatatttataatatagagtatgaataaagatacttgtgtaaaaggtctccaactcctccttcaactgtgtgtatttgagtatctgtgatgtattcagctactaaaatattgcttaaggagtttttcaaaataaaagtaaatacttatgctataatattaagttaaaaatcatagcgatgaagattacaagtatgaacaacaataaagctatgcaaaaaaattaaaagtaaaaggaaatatataaagatacctcctctagtcatttgtagttagagtcctatgggtgatttcttaatttctccattcagttttaatttttttataatcaaaaatcaattacatttcaaatgaaatttatagggaactgaatttaaaaatagtttttataatatttttacaggtcttttgtaggtacatattattttctcacttttgtctagtcataagaaatattaataaatattgggtcattaggacaacatagaacattcatattttaaatcaaggacacttaagaagacctgaagaaagttatacttcaaatactacttttgttcgttgttttttaatgtgatacttgtcactggatatgatattatgaggtttaaaatgtgtttttttccaatcaagctcaacttatttttaagctcattgggatgattagatggtttctacttttaaaactccatctagcataaccatatctatgcttttccatttattatattttgctaagaatttcaaagtgtattttcaaaataatattttgtggagttttaatctagcttagtaggttgaacagaatttgttaagttaaaagttttaattcttgtcaaatttatcatcagtttactctgtaattctttggtaatacgctatcctgtttaaagtgtccttaattcaaatagataatagaaggaagacaggatttttttaaaaaaaactacttgaactctcagaattactatgagttttaaatgcctaataacacaatctcttaatatattgaaatggatttgaaaaactaagttttagtaattattgctgtttggttttcctacataatattatttgattcttctctttcaataccttttcataatgttttggattttgttgtattgtaaatatccaaatataaaggacagaagcattatggaatatacattctggtggtggacgtgctgctgaattgcagtcatcttggacaaggaacttaaactgtgcttgagttttcttattatctaaaaaacccccagaaaattagccagatattatctatttataataaaagaaatattatactttatgttgtgaacgcgtctagccttaacattctctaaactcggactccctctaagtttaggtaaggaccaagacattctatgggaaagtgggaaattttaccatataaagaacaatgacaaaaataatatttgaacatatttttcaactgtgggaattatatttattatcactggtaatatacttttgaaaactttctaaagactgttgcctattatttgtctatttaacaatcatttcttttggaatgaattaatacaattaattacagaaagctttatattcttgaatatgattcttgattccccgtgtctctgtctaatcttttttggggtccctttatgtatagaaatagttcatgtattaggttcagcattctggttaccatgcactctagatgagctcactacccaagggtctgaagtaacagcttctcccttcccctccacccaccccaagaaggatgtcatgttcctctttatagtttttcaaaataaaaaagtatatgtaaaagcaattaaggaacattgcattttaaatcagcaagcaccttactatgtttcaggacctgaccatgcataacttattgtttaatactcacaacacacaaaccatttacatgtattaagctgacagaggattaaaatgaaatgtaatttcttacagtattttaaaattatctccattataattagagattataatactaactcatagtatttcaaaataaaagaattaacttttattttgaaaaacctcattggaactattaaagtatttgttattacatataaagcacttatagcaatgcctggcatatgagtaccatgtaagtgaggatctgattatcatgtgggtcctgggacttctgagtatagactttcacttttttctttccttcattccagttcagtagttgctagaatgtagtgtacagtaagagttactgtatctggttgtattcagtaattttcaagggcgattctggtatacatgtgtgtattcattttgtgttggcgctataatatttacaattttagtgacacaattgatgatgcttcactatagaagtctgaatacagttccaggtgcatagtaggatattgaatagattggatttaagcagttaaatcattcctcctgttatatgctaaagttgatttttcactcttccaaaatgagttaatttttctgtgatcttctccttttgttttcctgtattcttcatatttattttgcctgtgaaccttagtttactattttgttaagtggagataatgatgcttgtttttcagaatttgtttgagaattgtaattaatatatgttactggtaatttaaataacagtacctggcatataggaggcactccataattggtagatcttgctgtcatttcagtattttaattgactgattaactttgtggtgtatatcatttagtgtgtcacagactttattccaaacaattatttgaacatctgcttttgccagatatggttgccagatttgtttatgtgttggcaactctattggcaaataatgtagaagaggtcggtaatttcatagagtttatattctagtcaggaaaaatgtctgacatgcttcttattaatgtacttagattaagtgtttgaatttacttttctttagatgtctttagattgtttcactatatcactgactaggttgccattgctactattttgtagaagattaatcactgtgcttttttcgtctgacagctcttttaaacatttgattggagggctggatgatgtttctaataaagcatatgaagatgcagaagctaaagcaaagtaagtgacttttttccttaattttgattgcaaaatgattttgaatagaaataagatcaaatattttgttggacttgacacatcccaacactctgacaggaaacaactaattagttgagagacaaagaagcaaactcttcaagataattattacacggtatgcttacctaggagtatgtctctcttcaaacacaaaacttcaattttgtgatgaagataatctcagcaagaaaaaatgcttattttaaaatctaatataaacaattaaatgtaaacctgttgtttgtcctccagaaaatactttctgaacaaatggtggttgtgttccatagttgcttgtggaattgtatcaaaaataataaggctagaaatatttccctgtgctaatacatcattacattgaactttgatgttactaatatgagaatgatatgagatggtaaatatcccattaagtatgatgttgcataaaaatacaattccgtctacaagaataatttgattaaaacaatgttttttgacaaagatttaaagtaagttgatattagctttttctgcaaaattattatttttaaaataccagtaatctatataatcctcccctctttcccctaatgtaattagtatttaatagcatatagcatacctaaaggattaaattgacaacagttagcattaaacagatagttcagggccagaatttgatctgttgattttgtagtaacctaaaaatcaaaagaagtaaaataatgtattttgctttgagaatccatgaagattaaaaatttgtcctagaactaaaatattaagaattatattctatgttaacccaataaaattatgttattttcaaagctatatgaaaatattcacaatttctcctctgtatcctctgtataaccctgaggtcaaatgcctgcaatgcctctgctaaggtttgcttaggaagttacacaggccagttgtaacaccaggctccatgcagtcactgagactgcttatgttctggataattagtattaattgttctggtttatttcaacaggctaaaatgtacattgatattcagtttagacttcagtttctagtattaataataatcccaccgaggtgggaaagggggtcatttaaggtaccttatcagtttttaaagttgtacaatggcctttcttatggttgggttctattcctataggaatttttttggtatgtgacaaaattcattcttttataatttatgtcagcttatcttttcgtgtgtttgtgtgtgtgtgtgtgtgtgtgtattcagttaagggtctcattggtcattatatatatacatcttatatataatttacatatagtatatatgtaattttatatgtattacaatttatataattataatcatattatacaatattaaatatacatgtatatgcatatacatatataaaagatatagaacaactgatggtaatcttaaaaattcacgtacaatccagttaagcaactattaattaatagaaaaattcaagacttttgtagactaatgtatttttgctgcttccctattaaactttgaaagtttaatctcatttttcctattaaactttagaaggattttctaatgaatgtttttgtagaactcctatttattccacttaaagttgaggccgctatcatgcttcaaattgatcagtgatagggaagtgactgagttagtcataggtttctcagtgtcctatggactttataaagataactgtgtgtacatctcctaaattctggccattcatggattcacttgcacatacttcaattaaaagtagtaagtaagaaaaactgaaacaatgaaattcagatattcagacaattagaggtagatatggcaacaattcttaactttggaagaaaatcagtcaatatgaaaaacatgaacctgaatgaaggccagaagtcttgggttctgctcctggctctgtcattaccagacaagtgattttggtcatgaatattaacgcctaactctcaatctcagttttcacatttttaaaatggcgtttttgagatttaattgatggcagtgtgtaaaaatactttgtaaattataaaggttataaaaatatgtcactaggctcgtgcctgtaatcccagcactttgggaggtcaaggggggaagatcacctgaggtcaggagtttgagaccagcctggccaacatggtgaaaccctgttgctactaaaaatacaaaaattagccaggcgtggtggtgggcacctgtaatcccagctactcaggagcctgaggcaggagaatcacttgaacctgggaggtggaggttgccgtgagccaagaccgcgccattaccctccagcctgggcgaccagagcaaaactctgtctcaaaaataagtaagtaaataaataaataaataaataaataaagtatatcactagaaataactagaaatataccttagtgcatttgacatataattgaatttacagattccatgtctattatgttgatcaattttacttggacaagaagtctctaatcttatgtaagcaacatacttttacttgagaagactattatgaaattaaaccttgcctagaaaacattcataaaaatatttttaataaaacagtaacatttgattaaaagagaattcaattctaattaaagaagaaagaaaggcaatgaaatgactacttacatcaaagtagtttcaaatattgctatttgaaaccattgatttgatagattataatatagccattatgtttacactttttcccccagttttactgaggtgtaactgagaaataagaattgtatacagttaaagtgtatatgacatgatgatttgatacataggaatacattgtgaaatgattatcacaatcaaactaacacatctaccacctcacatagttacttttgggtgtgtgtggtaagaacagttaatatctactgtcttagcaaatttcaactgtacagttttgtttgaattttctgctcaattcacactaaacccaaatgaatgtatagtccatgttttttaatattcattattatttagaaaatggtaattgcttgatgaaaaagtctaaaacctttgatccaaattctagtgaggctgataatatgacctttattcctaaaaccagccaaataagtaaataagcaaataaataaataaatactggaggagttatcgttgtgtcttatacactgttagcattttatagtcttctaataaataattaatatcggaagttttctgaagtgtaaggtatctcttaattaggtgtcctgtcattcaaagaaggcaaactgtgaattattccctagagaaagctttctagttgaactatcaagtttaaaactctatttgaattagcattgttgtttctccgtattgaatttcttccccttaactactttatactttcattttgtatttaaggaatttataagggttgccaatgctgcaggggctaggaaccagctctaatttgtttaaaatctgggatatttctgttaatgcctctaaatttttataaggatcacattatcttgaccatttagaaagacaatgttaatttggctccactttgtaagctttatttgttcagggtcttcttgatgttttgcaaaacctacggaagataagattaatatttcttaaagctcgactaaaatgattatgttagttatccatgggaaatggatgtttgttatccatagtctcattgactatgcctatttgggtaagaagcgaaaaaaagtaggactgactgtaaagattgattaagttgaggcatttaaaacttaaatggtagtataatcaagctcaatcgcagaaagatttcacaaaatgtacagaccatcccagtaaaaccataccaggcattcagctcaggtagatagtctaggaagattggcttgagagaaatgttccagtagaagtggttctcaaaactcctctactgcaggataggtgccctcagtctgtctcatgagatatattttctacaaagataattgttcttggcagaaattttgcctatatggcatgcttaagcttctcttgattgttgctaattatccactgagggcttctctttttaaaataggaaattataatcacaaagacattagaagaggcaacatcagatcaaagctaaggttcactgaattttatttggagaagaaggtagcaggtgtggtgagaggtacatattttctattgataatatgtattcattcatttaataaacattagaaatttacttatggtgagtcaggcattgtgctttataacgtgcacaccaaatagaaaacaccatttccaataccaaggatcatcttacagttcagtagggaagctggtatgtaattgaatgaatactttcactatttggttctaagaataagttttaataattattatgaaataatagtatttgaatataatttttttttttttttttttttgagacggagtctcgctctgtcgcccaggctggagtgcagtggcaggatctcggctcactgcaagctccgcctcccgggttcacaccattctcctgcctcagcctcccaagtagctgggactacaggcgcccgccactatgcccggctaatttgaatataaaattttatctctatattgaagccttgccttataaaattcataatgatccagaaatataaaaaaattaaatactttgttaaatatttctgacgtgtatagcttgtatctttgatgtcttaattgctgaatactcagcagttacaggcaaaacagctatttcttcaaataaaaaagcctatatatatacatatatatatgtatatatatgtatatatatgtatatatatgtatatatatgtctatatatatatctgtatatgtgtatgtatacacacacacacacacacacacacacacacacacacatatatataagccaagatagagaaagaaaatgaaaacaatctaaaccaaacacaactgctattacctatcttggtgttttacagttgtacttatagtgcattttcaattttatatcttgctttattccatttaacatctgtgttagtctgttttgcattgctgtaaagtaatacctgaggctcagtcatttatgaagaggtttatttggcatggttctacaggctgtacaggaagcatagttctggcatctgttcttggcgaggccactggaagcttccagtcatggcagaaggcaacagggcatatcacatgaagagaaagggatcaagggagatgccaggctttcttaaaccaccagctctcactctgtgaactaagagaaggagaactcacttattatcatggggatagcaccaagccattcaaaagagatccacccctataacccaaacacctcccatcaggcccaacctccagcactatggattacattttaacatgagatttagacaggacaaatattcaaaccatatcagcatcttcatattataaacatttataatactattatatactcttcatgaaaatcattttaatagtagctgacaacccaatgaatagaaacttagacttctagactgatttgagttgtagccttgttgattcaatgtattttgcttttaaaggtgagatctcaattaccttttaaggaaaaaaaaaaaagcaccaaacaacaaaaacacctttgaatacattccatctagcgatgcttttcaaactactttgtgtcgtgacattcatagaaaatgagtacagtgttttgcaccaattagttcagctgccctaggctccatccttcagtattgaaggctaaagggattcatacctaagcccttcaatgggaagttctgacaactatatgactatagatatgtaaatgcacttagtttttatctagattgataataaccaatattgctctttattaacttcttctcttgtcaaaatctatgtgaagcctccaaatgagcatggacagatagattttcatctgtaatatcccttggtatacataaagatttaaagactccttgcaatgcctctgtagtccctcatgcaccagcatcacccatattcattcacctcttcatatgctttcatctattcaacagttattttctatgtgcctacaaaatgctgcatataaaacaatgaataaaatagataagtttcttgccttaatggagcttatggtccagtgggggactgaggcatatgttaatctttctgggaagtcttcttaggggaagtgacattttaactagatgtggcctgaattctgaagaattagctggtgctggctaggcaagaattagttggtattagttaagcaaggaggtatggagagcattctagctggcggaacaaatggaaagcattctacatagaggaacagcatggaaaaagccctcaaagtgggaagcaacattatatagtcaaggaattaaagtagcaatatgcctgagacctagaacaaaagagagaaggagatcagaaaggagagaatgacagataccaaatctcacaagactttgtaagccacattaagaaatcaggaaatcacatcagacttccaagctggcaaatgagacgagttggtttatattaaaactgggcactcttgtctctgtgattgaaggggtgtacattgaaagcagggagaataatcaaaatatttttcatgttaaagctgatagtagacaggaatagagtgaggacaatgtgatttaaaaaaaaaaaaagcatttgagagatatttaggtggcaaagccagcaggtcttcaggaaatagatataggtggtgaaggaggaaaaggtcagggaaaatgcaaagaattttgatctgaatattggagagaagtgacagaattcactaaggtagagaagcattatatggttcccaggtttggagagtagggtgatcatgaactgattttttgacagtttaaatgaggtacttttgagatatggttaggcaggtctggtgctcagacagaagattgttatcagtttgagaataacgaacatttcgatgttagatagtaattgtagctgtggatgagatagaaattagagagtgagaggagcatggcactgaggattgattcttgatgaatgttagcatttaaaggttagagaagaaagaagaatttggcaaaaattaaagaaaagaaagactgagaaggagagatgaaaggtagaaggaacaccacatgcacagaaaccaagaatagactatgtgttttagtttgttcaggctgctataacaaaatactgtaaacttagtggcttataaacagtagaaatttatttctgagttctggaggctgtgaagtccaagatcaaggcatcagcagattaaatgtctgcccatttcctggcatatagacagctgccttttcactgtaacctcacatggcagaaggaacaagagctctctggggtctcttttataagggcactaagtcccattcctgagaacttgccctcatgacccaataacctcccaaaggctcttcctcctggcaccatcacgatggggattaggtttccacacatgaatttaggtaggaggcagtgcacagtctacagcagtgtgcttcaagaatgggggaagaaacaatgatattacatgttgctaagaattctagtatgttacttaacaaattggatttagcaaaccagtgggttcagtttcatttcacaatggagtggtggggatggagcccgccttgcaaaggctacaaatgaatctaattttcagaaacaggattcaatgagcttacaccaaataataagacatttaagtaaaattgccagaaatgtgtaaatggaagattatggatcttcagtactgatagagatgtaagcatgttaaatctagtagagaagagagtttaagactgagcaagtggttctcaggtccttttaacttcatgacaaaggcagacctcttcaaaggttaagagtgagaccatctccacggataaggtttataccactttgtgatgttatttcttggttaagaaggtcattactcttcagtcttatactgagtagcattcccttagtttaaagcattaccctctctctaaagaacctataaaaataataaattatcctaagaggaataaaaaggttttcttaatattgtagtataaatttgtccataaactatttttcctgcaaggatcgcttaagccttcctctgaggacaaagaagaaagaaggacactaagaaagaaggcccaaatttgccaaaaacttaataaaaacccaccttgtaatgaccatcttgttctgttctgctctcctcatcatgcacctaaattgttcacatattctctgccttgtccccaaaaaggacattcataatagattcacataatataggaagaaaatattagaagtaaacaagaaagatgtatctatggtagtgaaccagagataaggctagtatgcaaaacaggacccttatcagtgcactgacaagagagagatgcacaaaaacattagtggctgcagggctggctctcgcttattgccactaaaaaaagaagtaccacaatcacccccctctccactccatcgacactctgcaagagctgtagggagtattgcctacctgtgtaccacccttttggctctttgatggaatagtccttaaatattttacttctatttccgtaattagtcctcattgattttcaagccctcctgtttacaaatttatttgcaaagaaacatttaagactgtctgatattttcaggattacttttggtgatgagccttcttgtttgacacaatgtgacagcaataaaagatgttctctcattacatttcattagcagagacaaccctttagtaactgattctgcctgtcacagagaggttgctcttcggcggctttcagacagaacggctgctgttgttcaggcctttgaaaatgcgctcatcaaatgcctctcaaagcacctgaggctatgtaaatcaggacctaggtctgcattgtttagtaacatcttctgaaatgcctcagggtcagctagcttctagcaaacaggaagtttctaaatgcacacttgagtacacaggggttgctgttttgaacatgctgactgaaatttggggctatcttattggtgtgttttttttttttttggttttgtttttttttttgcctgacattttcaagtgaagattctagtattcccataatcttatcaacaatttacttaagacaacttggtcttgatctaagcaattctcagggaaatgatcctggaaaattgttttcccctatggaacgaattcaagtgagcaatatcctcttccaaaatgggaacgatatgtcaattaaatagacaaaacactgagaatggcattgtgaaatagccctcaaaccagaattagaacttgctgactatctgcagggtgagtggtcagaaggcagccccattttctcagcaataaaaaatattttctattttattgcagggcaaaatataggggacgaaaatatttctgcagttggccctgaactaatatgctggctttcagtctttcaagagctgtttttgttttaaattctagtacatgtaatcagactaggcagaagtatacaatggtttctaaggccaccaatgctgatagattaatacttcagcaggatttgtgactgcagagaatatcaaaatccaatgctctttcaagtgcagtgagactgattcagttgcttttttaaaaaaaaatgattttcaggacaaaactactcggccttgaatagaagtatttttcttttatcaaaatttttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagaggcggggtttcaccttgttagccaggatggtctcgatctcctgacctcatgatccacccgcctcggcctcccaaagtgctgggattacaggcgtgagccaccgcgcccggcctatcaaaaattttaaaactctcaaaggccatttgctaatttttgctctgcagcgcttatctttgagactctctaggtaagaagactttataaatgtgaatcccagtatgtgcttgcttgcagccttttctaatcaacagagaagaggactacagataattgaaaattctagtgctgctgacttgcttggtgaaaacagacaagctacttgattgctgagtctgtttccttcttccaagaaataaagatgcttcctttccaccattgctgtattaagtaatgacaattgaaaattactttcaaaacgtcaggagctctttaaattctgtggatactttggtcctgtatggcaattaccttagcctctccagagcccccagagaacagcccgatacatgtttcttttcaatagcttgatatataaagcctatttacagtacagtactttttaaaagcagaaaagaataataccttttatatccctttgtgttctcagtagtttcatttgaaaaaataattatctctatctacaattccttttcttcttaagtgaaggcagtctctattattggagtgaatatagcatgcagcataattctaaaactgctttgcaagtaaggttgagcaactctagagataaaatgtttgaacctagtgagtgagagcaaggctagaagtgctgaagggctccccctgaggaggccacatatatttacatagtgagtagtagtagtaactgggagtttggagagcgagccttagttactgcacagccactaacttcatgtgaacttgaacaagcaccctggctccttggaccctgtttcccaaactgtaaaaatagcaatcttgaaatcctttctaatttttggctttaggcttctaagatgcttagaatgtgcacattaacaaggcattcttttggaatcgtaactcccttttatagaaacaatatttttgtctttgctgattttctaaatttataatgaggatatctctcactgtcaacagaaaataggctcttaaggatcatgaaataatttataagtctatgttgtaacaaaggttacttaagttatatgtcctcataaaatattgctgttaaggtgcttgctttattcaaaaattttttatcaaattgtgtagtattgcttgaagctcattttgataattcatagtaattaagtaagcctttagaaaaagcattttcatttttatcattatacaattttctttcgaatatggcatttagatatgataataagccctgctatctttcaataaaatgccattagaaaattatagactaccttcgaaactagaaaatgttatactaatatttcccccatgaatccttttagaaagaagtgatttgtaaataatggatttaaatggtagcataaattgttttgatacaatgaacataatatactatatgaatttagatctttaacttgctatttgaggaagatgagatgtagaagtgaagcatgactggtgctcagagacatttacatgtatcacaccattttcctctaatgcataaattgcaagcattagtcaactttataaactctattaattacttcaggcagccagcctattccctagtatatcagacatgtagagataaaagacaaaagctactgctctaatattcaaaaactgtacaaacattttagaaaacctagatacattactaattgagcatactgaagaataacaatcctcaagtccttgaaaagaggataaggcagcttcttaaaatgatgaatttaagaccgctttcaatttaaggacctggaaaagtatgagtcattgggtctttaactaattacttatcagttttactaagttttttgttgaaatgaccctgaaaatttggttcagcccagtatgcctgtgatgctagtaaaattggcttctcaaaatgtcacaatatctttcaggaagttgttttcccaaatctagttctcttgctcactatgctagtaatcaggtttttttaatttattttttattttttggtaaactccttgtaataggactcatggtttttcctctcaagccccttaactttatgatattacttaaacaattaaattaatgatgaagaacatgctttagtctttataagaattctgcatttcacatgagctccaaaaagttcccttaagtttaaagaaaaaaaaaaggccattgaagaagtaacaactttatagcagatgatgcttttttgagtgacagcaacagctaggagagtatatcagcttctttcttcaggaagttgttgacatacacattgattaatattaatattctcttctgcactgacatgagtgatcagagcaataactttatatgccaatgaatagaggggagcagggagagaatttaagaaaaaaggactataaagaagcatttaattacttatcaagatgtgattaccgtacttcaaattttaaaaaaccaaagagatagtataaaactatagcattaaaaataattgcattatatgggttgtgtctctattgctcatgtttttggctatttatttcattcataagccacactaggaaatcataaaaattaagtaaaaatgcttcctcctccaagaagcacacatattcccagcgacatgtatttccaaataatgaagcacatatattcctagataatgttcaaaaatagtatgaccaaaggcaagacatatctgctttatatgattttatttttatctacattgttatatcaatgcatctttatttttaattgatatatataactgttcatatgtacggggtatataatgatgttccaatacatataatgtatagtgatctgatcagggcgattagcatattcatcatctcaaacatttatgatttctctgtgttgggaacattcaatatcaccctttagctatttgaaactatcattaactgtgtcatcctacaatgatatagaacattagaatatattcctcctatctagctgcaattctgtgtcctttaacaactctccttgtccgccattttctcctaatttttccagctcctagtttcctttgtttgactttttaattctatgtgatcaattttgttttcagcctccacatatgagtgagaacatgcagtgtacaactttctgtttctggcttatttcacttaacataatgtccttcagttccatctatatcgccacaaacaacagaattccattttcatgactgaataatattctattttgtatatataccacattttctatatccattcatctgtttttgaatccatatcaacacccaggttgattccatatcttggctattgtgaatagtactgcaataaacatggggagacagatgtctcttcaatatactgatttccttttctttggttaaatgcccagtagtgggattgctggatcatatagtcattttctttttagtttttttcgtggaacttcatactgttctccatagtggatattctagtttacattcccaccgacggtatacaagagttccgttttctctgtatcctcacaaccatttgttattttttgtctttttgataaaagctattctaactggagtaaaaagatacctcattgtggttttgatttgcacttccctgatgattggtatgttgagcatttcttcatatatttgttggccatttgtatgtcttctgttgaaaaatatcagttcaaatcctttgcccattttttaatcccattgtttggtttttgctgttgagatgtttgagttccttgtgtattttggatagtaatgccctattggatgaatagtttgcaaatattttctctccttctttaagttatcttttcactctgttgattatttcctttactgtgcagaagcctttcagactgatataagtttatttgtttattttcacttctgttgcctgtgtttttgaggccttattcaaaaaatcttttcctaggctgatgtcttgaagcatttcctcaatattttattattgagttttgcagtttggggtcttacatttcgatctttgatcgattttgagttttttctttttctctttttttttttttttttttttgtagggtgagaggtggaagtctagtttcattctgcatattggtacccagttttcctagcaccatttattgaagggactgttctttctccagtgagtggtcttggcacctttgtgaaaaatcagttggctatagataagaggattaattttgagttctctagtctggtctatttttttctgtgtcttttattatgccagtttcatgctgttttggttactacagctttgtagtatattttgcagtctggcagtgtgatgccttcaggtccaccctaccacccaccaccaggattgctttagctactcaagattttttatggttccatacaaattttaagatttttatttatttttctgtgaagaaggttattgatattttgatagggattgcattaaatccatagattgctttggctagtatgaacattttaacagtattaattctgatccatgagtataagatgtctttcagtttgtatcttactcagtttttttcatcagtgctttggggttttcgttgtagaggactttcacctcctttgttgaatttattccaggtattttattttattgtagctattgtaaatagaattgccttctttatttctttctcagctagtttatcgtatgtgtatagaaatgttattgatttttgtatgttgattttgtatcctgcaactttactgaattcattgattaatgttaagggtttttgtggagtctgtagtttttctctatataagatcatgccctctgcaaggctgtaaacagggacagtatgatttcctcctttccagtttggatgccctttatttgtttctcttgcctaattgctctggctaggacttccagtactacgttgaaaaagattggtgaggttgagtatccttgtcttattccaggtcttaaaggaaaagcttcagattttacccattcagtatgttaggtgactgtcatatatggcctttattgtgttgaagtatgttcattctgtaactaatttattgagagtttatattatgaagggatgttgaattttctcacatgctttttctgcatctgagataatcataagttttttatccttcattctgttgatggtatgtatgacatttatttatttgcatcttttaaaccatccttgcatttctggaaaaaaatcccatttgatcatggtgtatttttgatgtattgttggattcagtttgctacacttttattgaagatgtttatgtctatgttcatcagggatatttgcctgtagattaatttcttgattgtgtccttgtctggttttgacatcagggttatgcttacttcatagaatgagttaggaagagttctctccacttccatttttggaatattttgagaataattgataataaatctttaaatgtttggtggaattcagtgataaagccctcttgtcccatacttttgttgggaaacttttattactgatttgatctcattacttgttattggtctgttaaagtttttgaaattttggggctttcaatcttgatagattttatgtgtccaggaatttatccattttctctaggttttcaaatttactggtgtatagttgcttataaaaaacccccttatgatcctttgtatttctgtggtctctattgtgatgtctcttttaccatttcttatttcatttatttggttcttttttttttccttagtctaggtaatggtgtgttgattttgcatatcttttcaaaaaaacaactttttgttttattgagttttgcattgctttttttttttggtctcaatgttatgtattactactctgatatttactatttcttcccttctactaatttggggtttggtttgttcttgcctttctagtcccttgagatgcatcattacattgtttatttgaaatatttctagtttttttgatataggcatttcttgccatcaacttgcttcttaagaatgctttgctgtgtcccataggtccataagtttggttatgttgcatttctattttcatatgttttaagaaatttttaaatttcattttacatttctttcttcagtcattggtcattcagtaggatgtggtttaatttgtacacatttttatagtttcaaatgttcctcctgttaattgatttataattttactccatgtggtcagataagatacttgatataatttaaaattttttaatattttgagaattttgtaacatatcatctatcctggggaatgttccatatactgatgaaaagaataggtattatgaaattgttggctgaaatgctctgtaatatctgttaggttcatttgctcgatggtgtactttaaatctaatgtttctttgttgattttttttttgtctagttgatctgttcaacaccgacagtgggatggatgttgaagtttccagttactgggatttatctctccctttagatctaataatatttgctctatatatctgggtgctctggcattaaatgcatatagatttacagttatattattttcctgaattgatacctttattattatataatgtccttctttgtctctgtttggagtttatgacttaaatcttgttttgtctgatgtaactatagctactcctgttggcttttgttttccatttgtgtgaagtatcttttcccatcccttccttttcagtctgtgtgtgtctttacggctcaggtgagtatcttgtagccagcatatggttgggtgttgtttttttttttctctttaatccatttagccaatctatatttttcaaatgagaaatttaatccattttaactcaaggttattattgacaggtgaagacttattcttgtcatttgattcatttttttcttgttgttttgtatatcctttgttcctttcttcctcccttgtttatttttgtggttgggtggttctctgtggtgataacatttgattcatttttctttttcctttctgtattaacgctgctggtgacttttatagtgttgcatgttttcatgattctaattattttttcattttcaaatgtgtgacttctgggagcatttcttctaaggccagtctactagtgatgaattcccttagcttttgcttgtttatgacagattttatttttccttcattactgaaggatagtttagcttgccataatattattagctgacaggtcccctcttctacttttggtactttgactatatcaccccattctttcatggtcttcagatttctgctgagaaatccacttttattctaatgggggttcccttatgtgtgacttgacacttttctcttgctgtttttagaattcattctttgttttttgcttttgacagtttggctataacgtgcctcagagaggatgtgttttggttgaatatatttggggatcttcaagcttcctagatctggatgtctatctcacagggcttgggagattttcagctattattttattagatacactttgttgttgttgctgctgttgtttttgtttgagatagagtcttgcactctcacctgggctggagtgcagtggttcaatctcagctcactacaacctgcacctcctgggttcaagcaattatcctgcctcagcctcccaagtagctgggattacaggcactgccaccacacctagctaattttttgtatttttagtagagatgggttttcactgtgttggccaggctggtctcaaactcctgatttcgtgatctgcccgctttggcatcccaaagtgctgggattacaggcgtgagccaccgtgcccagcctaaatagattttctgtaccttttgatttctctttcctttctgaaatacccataatatgaatagttgttagcttaatggtccctcataaatcgtttaggctttcttcattactttttattattttatctttttttcctctctttgtctgcctgcgttattcaaaagagctgtctccaagatcagaaattctttcttttgtttggttagtctgttgttgaagttctcaactgtgtttttaaatttattaattaaattcttgagctctaaaatctatttgattcttaatatctgtctctttgttgaatttctcattcaaatcatgaattgtttcccggatttgtttaaattgtctatctgtaatctcttatatctcactgaatttacttagaattattactttggatttttctttggacattttgaacgttcatttggacgtgtagtgttgtcttgtttttcatgtgtttgatgtgtcccagtgttgatttccattcatctggtggaacagttatctcttccaattttattgtataggttggatagggaaagattttactgatgtatgtgggtcttaggatgttggtttataggagtgtgttgacttttattgtagtttagtgcagcagtgtagtctccgtgtagtttcttcagctgtaatccatgctagtgatgttcgctagtatcttagtggcctaggctgaggatttgtgttgttggtggtgtaactttgccagacatcggcttgtcaggctgtttctcaggttaggagcatgtacatgcgcacggtgagttggccaatttgaggtccggctcacagggatttggaccatggggctgttactctggctgggggcatgggtgcacaatttcctgcccaggctgggggcatgccagccaggtgtggcccatggggctgtttcttagtcctggtacatggctgcctggcttctcagctggcctgagtgtatgtctgttggaggtgttttcccaggctttttctcaggtccatgatttgggtgtaaggctgtttggccagcctgggtgtgtgtctatcaggggcagccaataaggctatttttcagacttgggatgtgggtgcacagttgcttgtccaacctgggggcttgtctgctagtgacagccctcagggccatttctcaggaccagaatggggtttcacagctcttggttcagtccaggaatgtgtctataagtggcagcccatgggtctgtttttcaggcctagaacatgggcacatggcttcttagctaacttaggtacatgtctcctgggggtggcctgggacatgagaacacagctgctcagtcagtttgaggtcaagctgcattaatctgttttgtgttgctgtgaaggaatacttgagactgggtaatttataatgaaaagaggtttatttggctcacagctcttctttttttttttttttttttttttttaattatactttaagttttagggtacatgtgcacattgtgcaggttagttacatatgtatacatgtgccatgctggtgcactgcacccactaatgtgtcatctagcattaggtatatctcccaaagctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcatcttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcactgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttgtaggtctaacgtttaaatctttaatccatcttgaattaatttttgtataaggtgtaaggaagggatccagtttcagctttctccatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatttggctcacagctcttctacctgtacaagtatggcactagcacctgcttagcttttagtgaggcctcaggaaatttttactcatgctggaaagtaaagggggagcaagcattttatatgatgagagagggataaagagatagaggggaggaggtatcaggttcttttaaacaatcagatctcatgtaaactcatagagtgagacctaactcattaccatgaagacatcaccaagccatttatgagacatcaacctccatggcccaaacacctctcactagaccccacctccaacattggaggtcacatttcaacatatgatttggagtgtacaaaacatccagaccatatcctgtacctgcctggggcagcccacgggctgtttcctaggcccttatgaatatgggcatggggcttttgggcaggacagagtcatttatgcaagaaagtgggtacaaaggaactgtttctcaggacctgggcgtgagtatgtagtggctctccttgcctaagagcatgtcagctgttctgtggcacaaggagacctctcccatttggggaagggccacagcattttggctgtctcaagggcaggttcttcctgggtgggactgccagactgttcctccagctagaagtgtgggtggcaggagttggttttcctaccgtccagggccagagtcatagctaatcctgggcctaggctcttcacagcttgggttatggcattcagccacccatgtgggcttggtgtaatgaagatggagccccactgctggataaaagtgtagtgcctactggcacctagaggagggcatactccagatgtggctctggtctcaagatggtgccatgatgcaacagcttggcttacaaagcctgggtgggggtgagggagtgcgcatgttgtgttcctaatctagagcaatgcagccatgtgaattcatggcagctcttcaaactgagctctgggcttgcaatgactatgggattctctgtaatatgaattatccttatttgtgatggcaatgggggctgctagtgttcttccatttaccttttccctacagggggaagtccctcctgtctccaggtcaatccaatgtgtgtagaggagatgaggctgcagaggtcaggtgcctccctgctgccctcctgggcttccagtcaccatgggtgcctcactatttcagtgcattccctttgacactccaatgaaattttagctgtttgttcattgctttgtccccttcgtcaatctatattattttattttgttaaagttttgctttttaaaatgttactattcaagaaaataaaaatgaaacagttaagaaattaataaaattaactttgtattattcaagcacataatactgccaatatttgaacatttttagcctacaaaaatgacagtttcatatggttcaacctatgattttataagtaatttctgctgttgtgattactgcacagtacttaagaattaaaacactctcatccatatcatgatatattatttaatttagaggctgaatttccttctagatgtaccagtgtttatcaaattataattttaataatttcataaacatttctaaattaatctattcataggcttgttttataagcctaggccttttactattttttgtaatcttagcaatgttacagctatacataaaaataagggatttttaatctctgcactgttgacatttcaggtgtgctagaccatttttatgttactatcaagaactacctgaagctgtgtaatttatatagaaaagagatttaattggctcacaattctgcaggttcatcagggagcataatgctggcatctgctactgctgtggccctcagaaagcttccaattatggcagaaggcaaagaaggagcaggcatatcacatggcaagagcagaaacaagagagggtgggagaggtcccagacttttaaacaactagatcatgtatgaagtaacggagcaataactcacttatcacgaagaggatgatgctcaaccattcatgagggatccacccccatgatccagtcacctcctaccaggctccacctccgacactgggaaccacatatcaacattagacttggaaggaacaagcatccaaactgtattattctgctgctggccccctaaatcttatgtcctcacattgcaaaatataatcctcccctcccaatagtcccccaaagtcttacctcattccagtgtcaagtccaaagtcttaagtcttatctgagagttgtcttcttccacctatcagactgtaaaatcaaaacaagttatttacacccaagatacaatggtggtataagcattgggtaaacatgaccattccaaaagggacaaattggccaaaagaacagagctacaggccccacatcagtccaaaattcatcagggcagacattaaaccttaaagatccaaaatagtctccttggactccacatcccacatccagtgcacactagtgcaagaaatggtctcccaagcccacttgagtagctccacccctgtggctttgcagggtgtaccccctgtggcagctgtcatgggttaggatagagtgactgtggcttttctaggctcatgatgcaagctccctgtggctgtacccttctgggatatggagggtggaagtccccttcctatagctccaatagacaatgacctggtggggactctttgcaggggtggcttcaacctgatatttaccctctgtactgcccctatagaagttatctgtgagggcttcactcctgtggcagcttctgcctcggcacccagactttcttatacatcctctgaaatctaggaggaagctgccaagcctcttttactcttgcatttcgtgcacctgctgactttacaccacagggaagccaccagggattatggtggcttatgctctctaaagtggcaacttgagcaggatctggaggcttttgagccaaagatggagccagagcagccaggatgcaaagagcagtgtcccaaggctgcacagggtagcagagacctggggctggcccctgaaactattcagtcctcctacgcctttgggcctgtgatgggaggggctgtcccaaaggtctctgaaatgccttcgaggccttttgcccatttttaaatacccttatagcaatgccccactcctctgtatcaattttctgtgttaggccacttttgcattgctataaagaaataactgaagctggataatttataaagaaaagagatttaattggctcatggttctgcaggctgtacaagaagcatagtgctggcacctgcttctggtgagagccttaggaaacttccagtcatggtggaagggaaaggagaagcaggcatatcataggattatagtggtagcaagagagagagaggtggagcatcccagacttttaaacaaccaaatctcatgtgaactaactaagcaagaactcacttatcaccaagggactgttgcttggtgtgatttgcccctatgatccaatcacctcctgctattcctgaaggattttcccccaggatccaatcacctcctgctattcatgaaggattttcccccaggatccaatcacctcccaccagacctcactaccaacgctgggaatcacatttcaacatgatatttggaggggacaagcattcaaattacatcattggatgaggttattctttgttgcgttatgtatcttgtacattgtagcatgtttagtagcatcactggcctctacctactagataccagcagcatattatacatcccaactcttgagttatggccatcaaaaatgttttaagacatcactaaatacatgtggaggagccaaaatcaccctcatttgaaaaccattgctataaatagaagaaaaataaatacaaaattatttgggaaaacaacactaaaattacattagtatcaggcatggaattttatcaggtgttgaaaatgagcctcgacttactataattttatgtctaaaagaaaattttaggtgcaatgtggaagtctcacaatttgtatttgacaagacttttaagcttcacaatggcagggtttgccaaaatctgattaatacaaatgttagactaaaaccaaattttataaaataatttatgcacattcaatttagtttcataggtttatctccgatattcaagatttagaaaactttatttttactacttcaaaaaaaatcagaattttaaggattatcagacaattaattcacttggataatctggcttatcaggatgctaaaactttgatattgtttaagatgttagacttggtaaatttactgaagctgggaaaatacttcatctcagtttgcttctacacattgttgactggcatttttttacattagatgttaagtcactatagtagcctcaaatgtataatacaatgaattttctttattttcatataacccctgagttacagtagtaaaacatggcattatattaagacagaaaacacaaaagagattttaggtaaaaaaaaaatttataatagaagactgatattacactagtaatatgatacaagtgtatattgtgaaactgaatgccctatgaaaaacaatgagtaggctacaggcaaaaataagtgtttatgagaactggaagtcacaaatttgatagtctctccaaatcgcagcatttttacattacaagttctgtcaacatggtttcattaacttttaaaaataaagggcatgacattctttaaattccacctttgtggtaatcactaacaatagattctgccagcacaatgctatattgtcattctgctgctcgttgacatgataactaatccccaaatgctaccatgagccaaacactggtcaatctgacttcctgttgattgagggaagactcagaaacaattagggagacacaactatgtcagctgataaggtattgtcatctgtacatcctcaggtgcagtaagtggacatttaaaatgcagataatgttggaatttttatgcaaaagaagaaagcagagtttggaacgtgataggatgtagaattgttaaaagatctcaaggagaataataaattaaaacagtagactgctggagttattgtaaaacagtagacttttacaatggtttttaaactgtgagttacaaaccactagggagtcataaagtttatttagtggatgatgactagcatttttattacttcagagtgcatggtatgtactagtgttgctttgtgcactttttcatattcacatatataaggaatgggtatgatatctatgtatgtgtgtgtgtatatatatatgtgtatatatatacatatgtatatatatacatatatatgtgtatatatatacatatgtatatatatacatatatatgtgtatatatatatgtatatatatacatatgtatatatatacacatatatatatatatttctttttgtttgatttttttgagatggggtctcagtctgttgcccaggctagagtgtggtggcatgatcatagctcattggagcctcaactatctgaggccaagtgatcctccgacctcactcaggcttccaagtagctggaaccacaggcatgtgccaccatgcctggctaatttataaaatatatcttaatgtgcattggaataaaaaaaagtttggaaaccataatgaatgaatataaatgtctccctcccaattcatttacactattcattataattttaatttctttttaaagaaacagatgatttctattgtgtgcactgaatagttagacttacattatggctacagattgcctcctcattagccaattgattaccttaaaaatgtgtgcagttgaatccaaagagcagaagaaaataatgtaagagagacaaggtgcacatctttcaatataagcacatatcaatctagtaatgtactggtagtattatctccatattcaaagaacagtacatcattattgtgtggaattaattatgaaaacacttaaagaaattccaatatgtcagacatgtaccaggcacagagaatacgaaacccaagttctgttctctcctctttagaaacttaaaatctaataagaaatatggcatttatattgtttattgtgaggttatttaataagaaggaaaatatgcaatgttatttgagcaatagaaggggcatctatatcagtctaagagtttttgtcaatttttatcaaaatacttttctgtataaagaaaatttataggaatgtcttgagccaaggaaggatatcattcatgtagatttgtttgcaagtatctatcgattctgttacttgtagcattataagatgtgttgctgataaaattgtgataaaagtgtggtttaaaactttccttttacttcgcaatccttccccacttctcctgcaggtatatgtttgtgaactgaggaggctgataaggtcaagagttccactcattcatcccagaccaggggttcccaatcaccaggccatggactgctccatggcctgttaggcacctggacacaaagcaggaagtgagcagtagacaagcgagcattactacctgagctctgccccctgtcagatccgcggcattagattctcataggaaagcaaaccctattgtgaaatgcacatacaagggatctagcttgggcactccttatgagaatctaatgtctgataatatgaggtggtacagtttcatcctgaaaccatttatcccaccctcaatccatgggaaaattgtcttctacaaaaccagtccctgatgccaaaaaggttggggactgctgccctagacccctcatgctctggtggatttatttccattgccagttatcaaattagttgattttgaacctactacattttaaaagaatgatactgatcaggttgtaatatttgcattctgtttacagatgcaaggaaagcaaaaagtagatttatcctgccattgagggctgttgtcagctttttagagccacatctttaataatgagtattctcatttatatccttaagctgctctttagaatttgaaagcattgataatcctataatcatcacagatgctaatcaatgcaggtttatctgtgtatttattggagacatagtatctatttgctataaaatataggataagcccctgcttatgaaaactcttaaccagaaagctcaaatagtccaaattagttttgtgacagtggatactggtaacagtgaggaggaggaaaatcatcaggagcccataaatttttaagcaatagaatgaaattttatgtgtattcagtacttcattctttcaaaattgacaattgagctctacaacttttacaaaataaataccagtaattaaaatgctcaagtaattgaaatgacacaaatcccaaagaatatggaaaattcaaatgtattctgttaaaacagaatacattattattaatgaggcagacaaatgcattcaaaagcattttgttaaaggttaaaattctgttaaataaaacatagtcccattttacttacatttttaataaatatgaatatggtgataatgacaataatgggtaacacttgttgggcccttagtacgtgtcaagcatgaattacctgatttaatcctaacaactctattagaaaaatattcttattttacctgattttacagattcagaaattgaggcctatggaggtttaagtctatgtcacacaacttgtaaatggtacagtggagattaactctgactaccagatgtctattgccaaagcccatttgtgcacttttagatacttaactgtttcacatgtatgtttgcataagatacttttgtaaaccttgttattatgaaaattgtcaagcagagaaagtggtgcaatggaccccttcccttaagattcaacatttaccaaccttttgccacaactgctttgtcgagttctttaaaaaaaaatttactgatatattttaaaacaaaccagtgaaagatcatattatttcctcccaaatacatccttctatatgtatcttctaaaactactgacactttcctacataatcacaatattattatcacacttaacaaaatgagtagtcatttttcaattttcctcaattttctcaaacacctcgcttttaaagttgatttgtttgattcaggatcaaaagaatctgcatacactgtatgttggttatgtctctttaggcctcctttaatctagaggagtctccctaccctacgatagtcctattaggcattttgttttgttgagacagtctcgctctgtcgccaaggctggagtgcagtgtcctgatcatgctcactgcagcctagacctactgggctcaaggtatcattctcccacctgccgagtagctgggagggcaggaacacagcaggagtggcaggagccatgctccagctattttttttttttttttcttacagagatggggttttgccatgttgcctaggctgttttcaaacttctggtctcaagcaatccacccgccttggcctcccaaagtgctgggattacaggcatgagccactgaacatggcctgggttgttaaagaaactgaatcatttgtcctggtgtaaatccactcttccagattatcctattgctttttaatcatctacgttcctcttgatagcctttgtaaaggttcattaaacctacatgattgattagacttgttttctactttttgggcaagaagatttcgtaggaggtttattaaacttcaatattagattataataaaaggccaatagtgcttggtcatttcacttgcagctacatgaagttggatcagtgaattaagagataacaatgtaatccttttcctacaaagttttcaatcaatattttgttaaatgttttagtacacaatgatgatgattgcctgaatcagctatctcattaggtttttaatagaattattatccaatttatttttttctttgtatttattccatctattaattggaattcttctctgaaaagcttttcccatatcagttaggaatctgatatactgtttatcctcattcattcaagacaagcatgataaatgctgtttattctttcctattaattatcaattttcagagtaagtaattggagcaccaattggtgcttttggtgacaaatcagatttttaaaattttgcacatttaaattttttccacattttttggtattatgaatttgtggatttttatatattcaatatgttgagtcaatttctttctgggagcctctttaggttggttccttgtttcttcttgatacagcctgttagttgccagtaactcccttgttttctagacagtaagatgcccaaggtttttcatgtacatttcctcccctggacctaagatcagccatttctcaagtaacccttatttcttttagccagaaatggtactaagtaagtatggtcactgctattggctttctttgtttctagacatttttaggaggaagaagttcagataataattttttaaaataaatatattatttaactcacagtatgctctacctaatcttgcagtattcccattttattctaagggagtagcatattaagttacaaactacatgtatgattcttcaagaaagaatttttcatcaagcgttttagattgatattctcaatttccacctatgttcataaagtcaaagggactttttattattttaggaggaagtcaaggataagaactttgcttatgcaactaattgaattaatctttttccagatatcaataaatatcacagcctccacagaattggtaactttctaagatattaagtatttatataaaaagaaaaaaaatatatatttgtttggatgtataacttagtttgcattagaaattcctttcttatattagaatttaaggagatagaaacctcatttgtgagttttaaaaaacatagtaagctgtagatttttttttcacccaagcaatttccatgtaagacagttgaggcaaaaggctttacaatatccatgtcactctacttctattaattttcgtctttgttaagaccttaatttcattgctggggtctcttccctttggcctataatatttttagttggcaggaagtgcagtagttaagagtgactgctactgagttctcctagagcaacaaaggctctagttttctcagccatttgcccaaatctcaatcttcatagaggaaatattaaaggaaaaatatggcaccttagaaattgtccattgtgggaaaagcaacaggaagcttttttctctctgaaaacctatacattttacttaaccatttgactcaaacatcttagaactattctaaatgtcgggccgggcgcagtggttcatgcctgtaatcccagcactttgggaagcagagacgggtggatcacctgaggtcaggagtttgagaccagcctggccaaacatggtgaaactccatctctactaaaaatacaaaaaaattagccacgcatggtggcaggtgcctgtaatactagctacttgggaggctgaggcaggagaatcgcttgaacccaggaggtggaggttgcagtgagctgagattgcactagtgcactccagcctgaacaaaaagagtgagactctgtctcaaaaaaaaaaaaaacaaaaaaaaaaaacaaaaaaaaaactattccaaatgtcatttaacactgtggatttttattaactaggatctttatttcaaaggacagcctacatttcaagtaagtaataactaccttgtttaacaaacaacatcaacaaataacttaaaacatatacaaagaaagcaaaaggcaaatcttcctttttagaagcaagtactataaccagtttcctctggatcccttcagagattcaaatacaattaacttgtatttaagttaaaattggttgcttttttaaaatgtatgatttttagaggagcagaatgtgggaagtaaacaataatttggacgaaactccaagtagattttataagatttctctaaatccctttatgtgcattgaataattatttttctattttaaatgtctatctaaaaggtagctattttgtctcttatatttggtaaagatcaaaatgtatgtattaagaatgtaataaataactagttctttttaaagattttttattttgttgttttattttacatgataacagaaaattcaaacagtacaataaaaaataaagaagaaaacaaaacacccccaagactcaccaccaataactagttcttaacagaaattgctaagttctattagctggaaacataatttcctgtttttgaagatcgactattattctatatcatttattaggccactgcacatattcttatctgtctaaataattgaagctcctaataaaaaacaaccctgtcaacttagacctaaatggaggtgttttaccattttattctttctccacagtttccatggaaacatgacggttatgacaatgcaggaagggagaatgatgactgttattcaaagataaaaatgatcacagaactaaatacttaggattagtaagaacttaaaaagcaccctggaattagtatttgagttatttaagtagtgaagagaaaattaaatacatattcaccatgtaaggtaaaacacagctaatgttttctcgctaaagtttccgtttatgtggcctttgtctctggttttaacaatgtgaagctaaataccagaacagtgtttgatcaatgaagttcaatatttaaaaaatagaaagtaaatttcaatttagctatcaatgctaagaaatttgaaaaataatcttttttcctgtaatgttttacctattgacaatattaaagcacaataaaaagctatatccaggtaatgacattttcatttaaaaaatgaaatgtagcacaattaactgtcccaaagcatcagccacttgcatcaaggtaataaaacagaaccttttactatctgagctaattagtatgaaataattagggagaccacctgagggcttcccttacagtgacacttgctgtattgaattactatggtcttatccacctcaaattgaactctgagaaagtaccagtttaacacttaagttaaatgcctgagagatattttactgaaatgaatgtttagatggttttgtgatgagaaagaaatagatcacatcatttggtaaactagtgtttttggcataactcctatataaatgaaaatggaaagagagatgtatgcaaaatggaatgtccagaaaactcaaagtgagctggtttaatgccactgcttttcatgtttcctgtttttgtttttttttttctctttagctcgaataatattagtttgtttagaagacaactagcaccaaaatgaaggtgttgcttttgagcatagctacccattttatatatttattaaccaaaactatatctataatcaaagagcatgcataagatatcaaccagcattcttagtgatgttggtcctaataattttgttagttggatttttctctaagtagcagaattagaattggttgatgatccaagtctctgtctaaacttcttgatcttcttttcaacctataaatacagatagagtttatcaatgtgtgctgggttcattatattactggaagattgcaaaacacaagcgtgtttttaaaaacctgccattcttatttacaactcttcaaaattaagctaaggcttttaaatttgttaatttttatttactttagtgatcacttataagtaatacctcacatttttaagcccattcttactgacttcaaattttagagtgtccgaatgacaatcagtttttaattttaattaaatatttttatcaattttgaattaattatatttatggattaattatcctaatggaatcatttaaatcaaaaacttatagtcagatatttgccaagaacattttgtgttaaaatatatgaattggatatagtcaggaaaaagtctaaccctatgattttcatggttcaaatgagaactgaaaaaatggaaattgatcccaattagtgatgtgtgtaatggttgattaaacatgcaaaaaaatgttttttgttttttgtttttttttcctgagatggagtctcgctctgttgcccaggttggagtgcagtggcacgatctcggctcactgcaagctccgcctcctgggttcatgccattctcccacctcagccccccgagtagctgggactacaggcacccgccaccacgcctggctaattttttttggtattttttagtagagacggggtttcaccatgttagccaggatggtctcgatctcctgacctcatgatccgccctcctcagcctcccaaagtcctgggattacaggcgtgagccaccgcgccaggccaagaaattctttaaggatcatacttgagtcttgtctttgttaacaccttaattacctaaaagatgcattcaagaaatctataattcaaaatgtaggtgttattccctgggaagtattgcaaacacatgagaggaaaagaatgcacaaaatggagcaagttggaaaggaaattaattaaaacataaattagaaaagcaaggctcaccagcttgcaccgtagtcgtctgaaactcatatatttaccaacaacgaaagatactcattttggttagatgaaagcaggaggtttgggaattatctaaggagactccagggtgtgtgttagctagtaaattagaggtgaacttgctaatgcagcattatactgcagcagaagtagagctggtattattggggatttgtgggcagataggatctattagaagtagataataattatataaataaaacttccctgggtgaaggattctcaaaatattttatattataaaatccatatttcaaaacctctttgaaataagttattatgatagtgtcatgctgaataaatctactatgattgtatactaattatgatatagacattaactaaatagtagaaagtgctatttagtgtagcagtatctctaaatctgtgttcatcttagacaatactttaggcaataataataatagtagccacaatagtaatagcaaatgtgatggagatgctcactttgtgcaggttcactacaattttattaggaaaacacttgtaggtttccattttataaaggatgaagcagatacagataagtttttttttccagcttttgtctggacattcagatttttttgtgtatttcctcgtaaagttaagtaatcagtgttagatctcagagttctaaattgaaccttgcttcatgagataatctctaaagatgcaaaagaattggatcccttcatacattccaccccagcatgagaaatgagctcatgttggacttcaaacataggctggataaaaataagtaaacatgtcaactgaggacaagattataccaagtgattctactgcttgttgtttcaaagcacgttttgatataatcggaatgatatcaagagaatagaaacatttacttatgacaagtgttatgtccttgtgaagactatagaacaagcttcatctggtataagaaaaactccgaggtataggtcacaatgctgcacatgaagccaccataaaacggagacactgacatgtttattctggctgttttccttgctaaatcacagtcccacatggttagtctgtttgaaaactttgagtaagtcttcgaatagcagcgtggtcacactgggtcagtatacttcacttacacaacttcagaggtgagagagatctccaagtccagctccttcattctgtagaagaggaaactcttagttattctagagatgtggacttagtcatcttaataccagactttatggagacttaagaaatatggcttttgaatattactatattcatggatgaaatatagtacaagtacaaaacttcttcctgctagtgacaggtactctgggatgtttaatatgccttttctggtcactagggtaccatttagagcagtgaagcagttgatttacaatatggtgcacagaggaatgtctcagagctcccttttacccactgggaggacacaaagtagcattatttcattactcatggcagttcatctttgagtatgattctattcacataatgctgacagaaaaatacaaacacaatgttataaatgttcaaatagtttattatattttgcctaatgtatttgtgtgactgagcttcttcatcgttttccacatagatactcattaaaagttgaacatctgtagtatatggtttcgagaaactaaatttgaaaattgcatctcttaagggtataattacttgacttaattggcatgcagtttgataaatatttgttctgtggaaagaaataatttgtttgagaacttcattggtgactgatagacatagtttttatgacttagcatcctgtaattgagccaaagaaattgtgtttacaatggcatacgcagtgtaatctaactcaagagaaaggaaaaatagtaattttgtaatggccgagaatgacttcaggaaggaagaaacaatgagcaaatagaatcaggaaaaactataataattagaatgataataaaagtagtaatgacattatattagttttctgtgattaatgtgacaaattgccacaaaatgggtggtttaaaataacagaaatttattctctcacacgtctggagcccagaattcctacattcctgtcacagggcccaatcaagatatcagaagcacacttcttctgtaggttctggaggagaatcaagttctctcctcttcagattctggtggctactggcattccgtggtttgtggttgcgtcactccaatctttatctctgtctttacctttccttttggggtgtgagtgtgtgtgtgtgtgtgtgtgcatgtgtgtgtaagctcactctgtttccttttcttaagcatacttgagatagtatttagggtctatttacaggttccaggaattaggaccatctttggggaaccatttttcagactgccacagagaagttaactggctatgttagcactgcgtatcatggccacttttgcctttcagactgcagagaatgctactttgaacacacccaagatgacatttgatgaaggatgagattggattccaaccatccttgctctttctttttttttcccgattctgtttcaatgtaaggtttttcttcctaggctcaatgtagagagcatattctttaaagttttcaggtatctttcctcaccttctaaccctgacattttgacctaggcatttcttttaaagactactaggtacttaatgtattatcctccctatcgtattatcctccactcatagatgagtgaagattctccttgttctcttggagagaaaaagaaaaccagtagaaattgctgaactccacatccccctgaatcaaacacatcttcactcaaagatcatacttgctatgtattctaaccagacctcctaaattggctgccctgggttagaaaattccaaaaggccactgaccactctcagcattacccatggaataactgtgtttgtttatattttagggaaaattcccaaagaatgtattcactatcttctcataactattatctgcagagatcttcatgctgagacctaacgcttccataaataagaggttcagctttgccggagccctacaggaagaggttatgaaatactgggaacttctcgaatttcccaacccaaagccccctccctggatttactccgtgaccccagtgcagatatttctccctccaaataaacgtacctcacatgcataagggagattccgcaggtcctttttaaggatgcagaccttgggaagcagcaaagtatttgtgctaggacaaccagtggagcagttaccaactctttctcctacacatccctaaaagctttgtaaaatttataagatcatgaaagagtaatgtggactaatgaatataccttttcaggacaatttgttggaattgaacacttggtttgtgccaggcactgagctaagcattttatttctattctttcatttaatcccttgagttagggtctcctcattattattatcctcattttcttgtttttgttatattttgtttgtttttaacttttagttgcgggagtacatgtgcaagtttgttatgtaggtaaattggattgtgggcgtttgatgtacaaattatttcatcacccaagtaataaccatagtatctaacagacagttttgcaatcctcaccctcgtcccaccctccactatcaaacaggccctggtgtctattgttcccttcttggtgttcatgtatacttggtgtttagctgctacttataaatgataacaggcagtatttggttttctgttcctgccttagttcgcttaggataatggcctccagctctatctttgctgttgcaaaggacatgatctcattctttttatggctgcataatattccatagtgtatacataccacattttctttatccagtttaccattgacaggcatttaggttggttccatgtctttgctattgtgaatggtgctgctgtgatcatatgtgtgcatatgtctttatggtagaacaatttatattcctttgggtatatactcaataatggatttctgggttgaacagtagttctgctttaagttctttgagaaattatcagactgctttcagcaatggcttaactaattaacattcccactagcagcgtgtaagtgttcccttttcaccacaacctcaccagcatgttattttttgactttttagtaatagccattctgactcgtgtgaaatgatatctcattgtgatttagatttgcatttctctaataattaatgatgttgagcatttttttcttatgcttgttggctgcatgcatgtctcttttgaaaagtatctggtcatgtcctttgcccactgtttaatgaggttgtattttacttgttaatttgtttaaattccttatagattctagatattagctctttgttagatgtatagtttgcaaatattttcttccattctgtaggttatctgtttactctattgatagtttcttttgctttgcagaaactctttagttgaattacgtcccatttgccagcttttgtttttgttgcaattacttttggtgccttcgttatgaaatctttgccagtgcctatgtccagaatggtatttcctaggttatcttcaaaggttttcatacttccatgctttgcatttaagtatttaatccatcttgagttgatttttgtatatagtataaggaaggggtacagtttcaatcatctgcatatagctagccagttattccagcactatttattaaatatagagtcctttctccattgattgtttacattcacgttgtcgaagatcaaatgtttataggtgtgcagctttatttctgggcttttattccattctatttgtttatttgtctgtttttgtactagcaccatgctgttttggttactggatcctgtagtatagtttgaagtcaagtactgtaatgcttctaagtttgttctttttgcttaggattgatgtagctactgggctttttttggctccacatgaattttagaatagtttttttcctaatgctgtgaagaatatcattggtagtttgatagtaataataccgaatctgcaaattgctttaggcagtatggccattttaataatattaattctgcctatttatgagcatgtaatattttttcatttctttatgtcatctgtgatttctttcggcagtgttgtgtaattcactttgtagagatctttcacctccctgactagatgtattcctaggtattttattttttgtgtgggtggctactgtgaatgggattgcattcttgatttggcactcagcttgaatgttgttgttatagaaatgcaactgatatatgtgcattgattttgtgtcctgaaactttgctgaagttgtttttcagatctaggagctttcaggtagagactatgaagttttatagacgtaaaatcatattgtctgcaaacagagatagtttgacttcctctcttcctatttggatgcctttcattttttttttcttgcctgactgctctggctatgaattccagtactatgttgaataggagtggtgagaattagcatctttgtcttgttccagttctcaaggggaatgcttccaggtttggcttattctttaagatgctgtcataggtggcttttattattttgaagtatgttccttcaatgcctggtttgtcaagggtttttaacatgaagggatattgaattttatcaaaaatcctttttggcatctactgataaggtcttatggttttcgtttttaattccacttatgtgatgaatcacatttattgatttgtatatactgaactatccttgcatccccgtgataaagcctacttgatcatggtggattagctttttgatgtgctgctggtattttgttgaaaatttttacatctatgttcatcaaggatattggcctggtgatttcttttttggttgtgtctctgctagattttggtatcagaatgatgctagccccatagaatgagttagggaacagtccctcctcctcaattctttggaatagtttccacaggaatggtaccacttcttctttatatatcttatagaatttgactgtcaatccacctgggcttttttttttggttaatgggctttttattactgatttaattttggaatatattatgacctgtttagggtttcggtatcttcctcattcaatcttgagaagtggtaagtttccaagagtttatccatttcttgtagcttttctagtttgtttgcatagaggtgttataatagtctctgaggtttttgtatttttgtggagtcagtggcattgtcccctttatcatttctgattgtgtttatttggatcttctctctcttttctctagctagtggtctatcattcttatttattctttcaaagaactaacttctggttttattgatctttatatggtttttcacatctcagttttcttcagttcagctctgattttggttattccttgtcttctgctagctttggggttgctttgctcttgtttatctagttcctctagatgtgatgttaggttgttaatttgtgaccttctaactttttaatgtggccatttagtgctgtaaactctccttttaaccctgctttagctgtgtctctgtgattctggtatactgtatctttgttctcattagtttcaaataattccttgatttctgccttaatttcattgtttaacccaaagtaaatcaggagcatgttgtttaatttccatgtaattgtatggttttaagtgatcttcttagtattgatttctatttttattgcattatggtctgagagtgtggtggatataatttcatttttttaaaatttgttgagaattattttatggtcaactatgtagtcaattttagagtatgtgccatatgcagatgagactaatgtagattctgatgttttggggtgaagtgttctataggtagatgtctgttaggtttatttcgtcaagggttgagttcaggtcccgaatatctttgttagttttctgcctcaatgatctatctaacaagtggtgtgtagaagtctcccactattattgtgtggttacctgtttctttgtaggtctctaagaacttgttttatgaatctagctgctcatgcattggatgcatgtatatttaggagagttaagtcttcttattgaattgaacattttaccattatataatgcccttctttgcctttatttatcattgtcggattaaagtctgttttgtctgaagttagaatagcaacccatgcttttgttttgttttgtttttcatttacttggtagatttttctccatccctttactttgagccaatgagagtcattgcatgtgagatgggtcacttgaagacagcatacagttgggtcttgcttctgtgtgcaacctgtcgcttggtgcctcttcattgtggcatttagcctgtttacattcaaggttaatattaatatgtgtggatttgatcctgtcaccatgttgttcgctggttattattattattattattattattattattattttttgtttttgagatggactcttgctctgttgcccaggctggagtgcagtggcataatctcggcttactgcagcctccacctcccaggttccagcaattctgcctcagcctcctgggtagctgagattacaggcatgtgccacttgcctagctaattttttatttttagtagagaccatgttggccaggctggtctcaaactcctgacctcagatgatctgcccacctcggcctcccaaagtgctaggattacaggtgtgagccactgcacccaactgttagctggttgttatgcagacttgattttgtagttgctttataatgcgttgtgggaagtcagggaccccgaatggagggactggctgaagccatggcagaagaccataaattgtgaagatttcatggacatttattagtaccccaaattaatacttttataatttcttacgcctgtctttactgcagtgtctgaacataaattgtgaagatttcatggacatttatcacttccccaatcaatactcttgtgatttcctatgccggtctttactttaatctcttaatcccatcatctttgtaaactgaggatgtatgttgccttgggaccctgtgatgattgcatgcacaaattgtgcacgcaaattgtgataaactgcacaaattttttatagagcatgtgtgtttgaacaataggaaatctgggcaccttaagaacaggataacagtggttttcagggaacaagggagataaagtctggctgcccgttggctgggcaggacagagccatatttctcttattaccgaaaacgggtaagagaaatatcactgaattctctcccaaataaggaatattaataattaacagccctgggaaaagaatgcattcccagggcagggcttctaaaatggctgccctgggagtgtctgccttatgcagatgtagatagggatgaaacacgccctaatctcctgcagcgcccccaggtttgctaggattaggaaattccagcctggtgaattctagtcagactagttctctgctcttgaaccctgacaatgcgtgcacagcaggacgtggaagttcattagtgattctagtttctccctgaccttctgccttgtgatcttttgtctcccttgaagcatatgacctctgtgacccacaccctattcgtacactccctcccctttgaaaattgctaataaaaacttgctggttttatggctcagggggcatcacagaacctgccgatatgtgatgtgtcccctggacacccagttttaaaactttctctcttttactctttccctttatttctcagaccagccaacacttagggaaacagaaaagaacccacgttgaattattgggggtgagttcccccagtaataatgtcaatggtctatgtactttaaaagtgtgtttttttggtggctggtaatggtctttttttaattttagcatttccttaagaacctcttgtaaggcaggtctgctagtaacaaatttctttagcatctgctagtctgaaaaggattttatttctccttcttttatgaaggtttgtttggctagatatgaaaaatctttgttggaatttcttttctttaagaatgtttactataggtaaccagtgtcttctgaactgtgggatttctgctgaaagttctgcctttagcctgatgggattccttttgtaggtgatctgttccttctctctagctgcttaaaattttttttttctttcatgtcaaccttggagtgtctgatgactatgtgcattggggatggtcatcttgtatagtatctttcagggattctctccatttcctgaatttgaatgttgacctctctgttgaggttggagaaattgccatgaatgatttcctctaatatgccttgcaagttgcttgctttctctccctctctttcagggattccaatgagtcatagatttgatctctttacattatcccatatttgttcattctttttaattctttttttctttatttttgtttgacagttaattcagagaaccagtcttccagctctgagatatttttttgtctcagcttggtctattctgctgttaatatttgttatcgcattatgaaattcctgtagtgtgtccttcagctccatcagatcagtttgtttctttctctaaatggccatttcctctttcagctcctatattgttttattgtattccttagattccttggattgggttttgtctttctcttgaatctccatgatcttcactcctctctatattctgaattctatgtctgtcatttcagccattttagcctggttaagaaccattgcttgggaactagtgcagttgtttggaggtaagaagacattctggctttttgagttgccagagtacttgcactggttctttctcaactgtggaaggtgatgttccttaatctttgaagttgctgtcctttagatggggtgttttgcttttatattctttgatgccctcaaaccctggcatttaatcgtggtataagatggtttcagttgactggcttcatttttggaagatttcaggggccagggctcagcccaaacactcctggactgtgtgatttaatgctagagggctggtactgggccccagttctatcctgtctcccctggaggttaggaacctgctgcactggagaggctgaggagtttccattttgctggccacaacactgatgggggttgccaaccaaagtgcttcatcagaacagtggcagagttacatgtgctggcttttgcatgccagcagccacagtgcagtggcacagtgtggtgtctgcacatcagcttgggcacaatggtggtaaaagtcggttggcagtgtccatgtgtgcatttgcacagatggtggcatggtgggatgccttcatgccaacaggggcattgcaatggcattcatgcacacttaccccagtagtggcagtgtggcagactgcacatcattgggagcagggctgtggaatgtgctcatgttgcatgcacacatgtgtgccagcaggggaggggaggcgaggtctacttgcacttgcatgccctggaaaaacagtgggaaggctgtaggtgagtgcctgctagcagagcaggagcgggaggatgctgtgtggagaggctgtatgcaggctagtctgctagggctctcggatggtcaggttcagtctgctggtgagggagctatgatgagggcctccaggaagcaccctggttgggcatccaaggctacattaaaagtgggcatggccaggctggagctccagtacaggccagcagacagtcaggtactcagatcagactggccccatcccacaagtaagaccaccctgctttcttcagttctgacagtcaaccaaaggctaatgccacctagaagtacatggtgagccttgggtgataagcgtccctggctgtgctccacagcagccattcctgcaccaaaccttgaagctccacataggctgaagtactgcccctgccacctctctaagcagcaatccctgctagcttaagtgtctgtgggagttgtgggatctcctgcagctgagattccaggggtctatggcaagagcagaccactccttacctgttcaactcacctcttccccagggatctctgggggccgggagtgagccccattgctcatcagccccatgcagggttcccagcttactcccccttcagcccagtgtctgcatcctcccttctccactctcaatgccttccctctgaagatctgcctggagtgtgactgtcttcccaatgttcaagtctctcagtgggagatattcctcctggcagcatctagtagtccttcttggtcgcccttccatctcaacctctattatcctattttccaggtgaggaatctgaggctcagagagattagatgacttcacagatagctgtggagttgaaggctacactgtgaggcagcagtggagtcaagatttgaagcaatctgtctccagaatttgtctttttaaccctaagcacactgtcttgtgaccatagttatgatcttgttatagctttgcttttaatctgagaatattcttgaatcactttgaatgtgagtcttcctttcttatgttacaaatgaaaggaactcaagacaaaaaggaaaacaatccctttcaaaactgcttctgaatcttctgttggtagcttaaccatgggctatgaaacatataaactatgatattttagatcctgtcataatttaaaagcactgacaagacctattctgcaaacaattctgtatagcataaatactttttctctatcacatttatcacatcacagaagtattatggtaaaatgctttaccgtaaaatcctccagcatcatacatctgcatatttagacagctgagttcatctttaaatcagcattaccaaatccacttatgaacaactgaaacaaattcacaaccactcagagctaacactaggacacttacacgccattaatgttctactgggagtttcaagtaacactgtatccattaagagaaaggaaattgtagaaagatgatcttcaaggcaatgacaagtgaaatggcaaattatttctgccctaaaggcaataatttttccatttggtcatgaaatattggctatattattcttttaaaagcctgttctttaactattattttataatttatatattctacataatttatgttgtatataagtttatgtgtagatatattctaatgaagtttgtctacagctaaattactggcctacttcaaaacacaatactaagactttattatttagaagtctttaaaagtttgcctctaaatgttttttgtttgttttcactgaaatatttttaataatgtagaaaatatgcttaagagcgagaaaatgatttcagcacatttctaactatattatatttgggtaaaatcctaactaaagaaaaatgttattgctaagttgccattaagcttctcttactaagaggaatattgccctggagtagggggtccataaactttttctgcagtgagctttgtagtgaatattttcagccctccagacctacttagctctgttgttgtagtacagaagcagtcacaggcaatatataaacaaatggaaatggttgtgtttcaatacaactttatttatggagcctgagacctgaattacatataattttcatgtgtcagaaagtattacacttctttttatattatttccaaccatttaaaaatgtcataatcattcttagcaaactggccacacacacaaaataaaataggcccaggctggattttaccttgagttgtctattaccaattctttcaaaagaatattgtattcatgtcaagggcctcatttaatagtttttgcagggaattgatgagcaggtgaagaggagagtactgagaatatcaaaggagttttagaaccttttttcacaaaaaatattatgctcttgacatatgttttttgccagaagtcataatctcatgaggctcacactttaccaaaaccgaaatcttgattttcctcaaacctgcttctcctctaattttctctatatcacaaagcggcagcaccatccatccccttctccctcatcacccatctcaaatccatcagcaaatatgcatgcctgttccttctaggagtccctggctgccaccacctattcataccaacactctctctcacctgaaccaccacgttaattcccagttgacctcccctccctgtgaccctctcctcagcaacaatccatctttagcaacgtatcttgagtaaccatttgcaaatcagaaatctgatgattgtacacatactagctgcaatcttagccaagttaatgcggtaccttaagattccatttcctcttctgtaaatggaaggagcaattatccatgcttctgatttgatgtgaagattaaatggctaatgttaaacatttagatgatgcctattctgcaatccctatttgatgaactagggcccataagatggtagctactatcatcattagtattgtcatcatcattgtcactctcctaattaaaacggattgctgttagaataaaatcaaaacgtgtcatctcttaggtcttgcagaagctatctgcctctccttgcctgccttatgtttgaagcttgttaagtctcggccactagatcttattttagtttctcatgcactccaacctctccaggaccgtcacagctgcaccctcctattcctgtcactggattcttaatgtaaatgtcacttcctcagagaagccttccctgaccactcatttaaaaaatattttccacaaactcacaccctatgcaatcatagaattctgctcgtttcttttataacaattctcacggtaggttatttgttaatgcctttatttctatatttttattagaatatagcttccaggagaaagataagcatgcctcctccatcactgtgtgcaaatattggtcttctataaacatttatggaataaaacaaagaaaaatgaaatctcagagatatctgctaattttattcaaattctgatacagtcatttaaattcatcaaactctaagtggtcaataaggaggctcactcattcttctgtccatttatccagcaaacatgtatcaagtaccttctgagttagccctgtacaaattatagaggatcaaaagccttggtagttgctttcaaagaattcataacataattgcataagctgtcatttaaaagtacatatcaaaaatatatacatcaatgagtcaatatacttattttcttcaggtttaagttttaattttctttttcatcaaaacattcatcatataaaatagcacctctaactggcaccatcagttatatagtaaacatttactgaacatgtgtcggctactatactaagcaatgaaattctacttggatttctttttcctgctacacttcactttttaagagaaagaagcaagtatcatccaaatcagttatcggatagtctgttcttttaaagtttgtagtttttgtcttgggatctgtatacacgtatcatgttctgctttactttctgcctgggctacagtccccacaggaattcatgttgaccctgatgcactgcaaggtctttgatacaagggagagattatattttacccagtattctaactatatccagaaaatatgtagagacatagtcaagaaatttttcgcaactaattatttaaagaaaagcatttttgcccttaaaaaggttaaatcttcataatccaatgaacaaggacagcctataaccagctgtccggttgtaggttttgtttgcgagttcaaccgtcacttggttatttatttctatttaagaattatgcatgcgtttagaaattgctactatcagatggtacagtaatgatattttcctgggccaaaccaatagattttcacaatatatagttaattcagagagacagttctactgaattgtctttattacaaatgtggatattaattaaaacttctgaaatgaagtaacttaaaaaatacacaaatacctatcctggtaaaaaaaaaaaaaaaaaagaaaagtaattcaataattggttagtaaagtaacgggggtgatgaatgttactacggaaagtggaagatatgaatgcacttaaatgatctgctaataactgtgtgatctgtggcaattctacccctccagattcagtttctatacttaaaaaaaatagaaaaaaaacttgtatgaaaagatttctataaatcttatatttctaaagttacatgaattcaataccacttacctgaacattggtagtgtgttttaatgcaaattaacttttttattaggtgttaaaacatttttattactgttgttaaaagaaaaactttagacaaatttaacagaatttaattgagccaagaaagacttgcaaatcgggcaccccccagaactagaataaattcagagcaactctggggctgccacatggtcggataacatttatggactgaaaaaggaaaatgaagtacaaaaaaacagtagtgaggtacagaaacagctggattggttacagctcagcatctgctttagtcagagaaggtttgagcaatcggccaccagtgattggcctaagcgctctgactgatagaaaagtaggttacagtctgtttacacctcattaggttacagttcactgtatggagaaacctttagggtgaacttaaaataggaaaggaggcagctttaggctaaccttaatttaacactggtaattcacttgcctcctaaactgttaatgtaactaccatcacaaactttaacacctccaagaagagaatttttcttccctgttccttgattttttaaaaaagagagaattaaaaagataacatatactttctcatctcatatactgtagcttttctatcttttcatccatatggctgttggggggagaggggtggtgtaggggagagagagagagagagattaaaaaaaaagagaaatactagttacaaggcagaattatctttctgattgcatgaaacccatagatcattttctctccaacagaaatcttttcagtaacctcaatccacgttttggcttcattttttattatgctttaactggattatggaataaaaccaagtttcgatttggtttctgttagatattgtttttcgcaaagggattgtagctttttcctattaaaaagtcaaatttaccttcagtgaaaacactaaaagaaaattgaacaggaatttcaacatagagtgattttgtcataacaagttagatatacatgggaaagttcagcaactctcaaagtgctttatatcagtggtcctgataaccactgcgtacatgaatgtttacacactaagaaattgacttttgcacttaaagcaaataaactttcaagtagttatatattaattcggctctgaatataagtcagtcactatgttatgacacaaagaaatagaagtttagtcctggccttaaaacttaaaagtataataaaaaaaataaaaataaaaataaaactcttacaaaacaggaaaaaatgaaaaaaagaagttcagttgacttttgatagctttacaaactgagttggcaacaaatgtgttcaaatgtgaagaaaatcaggaaacatctcacctgaatctgtttggtaaaaaatttgttatgggtttatttaagactcgtcatggaaacgtcataccttatttatgacactatgtcctaacatgcagactcaatgcaaatcttagcttctttttagtgaagctcaaggaaaaagtcttggtgaccaacataaggaagagtccattttaacatagcagcaatgcattcatgaaatcctagctggaaccagttcagacagggacataggatgtgctttgttgctcattagggaaaaaagagccatttatctcactggacttgtggggattgggagcaggaagctgggttcaactaagtagcttagtagagccatccggcttccaggaatgggatagtcactacagagatggagcaggactctgactcagcagtgggagagactggaagagaggcagtggctactgtgaaagaacacaccaaccacagagcagagacaaatcctttaggtagctgtcttttgaaattcactttgtattctacctctatgtaaatgtaaatgttaagtgcctccattataaataacttataaataatactaacgtaacacatccttgatatttacaaataacactgcctagaaatcttaaaaggaaaaccaaacatacatttaatacatctacaagaaatacctttttagaaaataaaatgtatatgtttcaaaatttgatgagcatttacgatgtggaataagcctacttttttcacagtctggcaaatgggagagtcctcatttacagatcccatccaatatgtcagccattctcctgggttattaagacactgagatgaatatacaccctccccaaactctaggatcccctactctacaaaggagtgtgaatacataagtatccaacttgctgacacccaaaagtgcaacagtagcatagaggaagtaagggttctgcttggaagaaaagaaagtaataagatttcagattacccaccaggatataacttgggtgcacatctctcactgttctcatttagcccaaaatccacagcagcatgaaaatatgcaaacagagaacagtatgctggtgtcatttagatgcacaaactttgatatcacacatacagtgacatctaaggaatcatcaccgcactaacattcaatttccttacctataagatggaggtcatagataaacacatctcagactttggagcgagattgagagtatgtatgtatagcactttgtgtagtagctagcatgcagtaagtacaattactcttggaaattatttttattttctaaagaaatagtagctatggcttcacaaacaaaccatttaaggattctttaatagccctatgagactagagcatgaagtttgaaaggagtggctgtgaagaaagaggccagataaagattacacagcgaagttccattaatgccccccaaaggaattccaacttgatacaaatgtaatgaggaaagcccagctaacatgactatgtgctttggaaagttaaatctagagacaataggaagaagatatggagcaggtaaccaatcaggaggcctttcactgagggaacagtttctgctatgaaagcagtaggccggttttataatttgtgggtcattttgaatattgtcacggttatttattatgtaactttaatatgcattttaagagtttctgcaataattcacatgattttttatgttaaaataatgataaaagttttttcaaaaaaaaaaaaaaatgccagcatgaagatgccattttggagagatgtattattctaaatacaaagtctattttgggccaggcatggtggctcatgcctgtaatccctacactttgggaggtggaggcaggcagatcacctgaggtcaggagtttgagaccagcctggccaatgtggtgaaaccccatctctactaaaatacaaaaattagccgggcatggtggtgggcacctgtaatcccagctacttgggaggctgaggcaggtgaatttcttgaacctggaaggtggaggttgcagtgagtcaagatcaggccattgcactccagcctgggcgacaagagcaaaactccatctcaaaaaaaaaaaaaaaaagtatattttgaagctgacttgctataagcattctatgctataaagcgagatatacaggcatttagatagttaaagcaacaagaaaataaaagtattttcttttgtgcatctcaggtcagtgtacttttcaatatcacctcaatattttctcttttccccatgggaagatgtctgaatacactttggtggtattcatacattcatacatgtttcaaagtgaaacaatttccttgtgaaaatttcaaatcatgaatttggatggataactttaaaatatgaaaggtgaaaggaatgaaaatatattaatatacatttttataatagtaatgttagaaacataacttttggttttgatctcattcagaatataactgacaagaggtagatgataaggtagatatttactagttgtgctctaaaagtgaaaatgtcatatctaattgaatatcttaagcatagattatgtttcacatgaagaacaaaaccacaaaggcctaacttgaaggcaaacattgtacttttgtgccctccagtggccatctggagaatatactcatcctcatagaattgttcaagaaacataaagtggctaaggagacaatggcaaaggaaacaagcaaactgtacacccagagaccctgaggctattactttctcataaatttactgaagtaagaagagagctagcagacttgggagattcttcagactgcttccaagaatgcaaaggagctattggtttggactacagatggttcttttgatcattcttgaatatactcttcttagacacttcttaaacaaggattgccaagcacagcatggaagcttaaattttcatttcaatcaaaaaaattatgcatggaacacaagtgacactaagcttctcactctgggagaggtatcacttcagtcaacaggctcctgggctggggatcttttgggaaaccagcagatagctaccggaatgccagggaaataattgcacatggattttgcaagagactcaaaatcaaatcacactggcagagcaaagagttttgacaataagactttaattgaatagtcagagttagatggaacatccaaaatagaaaaatacctgtttattaaaatggacattacctattttctcatctttaccttttagtattagcttagccccagaattagatgcagttaatacagccaggtctgcagagcattgtagatagattttgattcctattttaaatgtggctggaatttctgatgccatttcttgcatggtcctagagggaatagagcctttggtttttatacagtcataggttttggtgcggttttttaagatcagtttgttatctttttctgagaattaaatggatcaaaatgtctctaaattttaaaaataagttttgtttaaacccagtgactgcttaactatttgcataatacttctgaaaactttttagtttttcacaaatggaagctttcttttactaggcagacaattctgtttaataagtgagttcagctcctgcaccaccgtgaatttaatagcctggagatcctgtttcactttctgagagaacagatcctataaattgcattctatgtgccattccacttcctgtctgatggtgatgcggaaaaacagctgttgtgtgggaactgttcagagctgtgtttctcaaaccacaggtcatggaagggtggttaagtaggccctgtttccctttcttccaaaatagcacccaaggctcttctgaccttgcctccttccacctcttagttgtaagcctactaaggagtaagtttatcctacttccttttgttgtgtttatttttaattggggaggaataagtacatatcctgggagaggctagagttatcctgagagatgtgcggggtaaatatacatatacacacacacgtacacatttatatatctatctatctatatatatatatacacatatacacacacacacacttatatatgtataagtagagttctctcttttttagattagtgtcaaatgaatctcatagtctaggaactaaagcaaaccacatcactctaattttagtacaccctaccgtcaaacaatattttcaccctgtcttcaaatggtacatagagagatttagatttaattattcaatatggaataatagaaactacaagcaagcattaacccaggtttacagttactcaaatagcaaggattaaacaatatacaatgggttgacaaatgtgctgtctcctactggataggagacaatggaaacaagtttcattggtggcttgggcaactgatgcaaatgtactagctgggagataaatcagacctcagccctgttggtagtatagacatcatcacaaaggatattttaataatgacactgtggctagcctttcttttccttcctccgttactctctacttataatttgcataataaatgaaactcctattttatctctcattccaatggcttctcttaggaaattaatggtttagaaaaatagcttacagctgggagccgtggctcacacctgtaatctcagcactttgggaggccgaggcaggtggttcacaaggtcaggagttcaagaccagcctgaccaacatggtgaaaccctgtctctactaaaaatacaaaaattagctgggcgtggtggcacacgtctgtaatcccagctactcaggaggctgaggcaggaaaatcacctgaacctgggaggcagaggttacagtgagcctagatcacccactgcacgctagcctgggtgacaaagcgagactccatctcaaaaaaaaaaaaaaaagaaaaataggttacagttttttttttggttttgggggagtgggtaaaaacagaatgaactaaggcgtcttaacagctgacatccatcaaaggggctgctcttttgcctggcattgaggtagcaagcacaaggccatatagagagacagaatccaagaaattctcataaaaagcaattagatgacaacagaagggacaagcagaaattattaaatgtttttaggcttctggttaaaaaagatattttaaaaccttatcaagtatgacccaatttctttttgattcaacataaacttacccaactgtatgaatagtcgcaatacaaaattttggttcacaacagccaaggcagtattctccaacctgaatagaagtcttaacttctaaacaatttagacttttaaaaattatataaattctacactcattactttagaaaattgtgttgcaaaaatcagtgtttattctggattcttaaattaaaaatttatagggattaggatactttttcaaggtaaatttcccttttgataccttcaaagtgtttgatgagcaaaagagccattaatgttttcagggcctcccatgaaatgaaattagtgtttatgagtcttatcttcattaattaatattttaaactaaactgtttaaccataatataatgttaataatttttctgaaacaaaatataagagaatattatgaccagtttctgtgttgaaccaaagctaaattcaacagtagttagataagctgaagataaaaggcaaatgatagcatatttatttaaaaatgaaacacaatttaaaaaggaaaaacaaagaaagaagtacattcccttgtgggacttttttgttttcatggtgagcacttctgtaaggaatacttttttcctatgttcacactagatgtaagtgggtcataaaacatttacgtactaggatgaatagattttgagctgggaggctttaattagtcatgtgcaactatttacaagcttatgagaattagaaaagtcataggaaaataaaataaagaaattagctgaaaagaatgacaataatttagctaattagaaaatgtaattatagtgtattttccttcagattacaaactctctgcataagagtccagtaatcctttgagtctaagatgccttcactgataatctagaataggatcaggcagaaccaatgaggtaggatataaatattaataacaaacaatcccaacatctcactttgcatattcatttattattctcctccaataagcttttatccatggttgctaacaaactactaaaccgactgattttttctcagtgcctaataacaaacaacaaagtgcctcaagtaaactgttggaaagaaggagatgtagttgggaagaaattaaataacccccatactggctaacaatgtgttgaataactaacaattagctgacaatcactcatcctcttgttatttattgttaatcacccaagtgaatttacatataaatactgagggcaaaataataattccttcttaccctttttgctaccaaacactgggcatatttataattatcctgccaagagcaaactatgccataggcctttaaatattgcaaatgaaagaggtggggagaaaaaataaacatacatttctcatttatttttctaaagtaatttaataaattcttttagaaagaaagattaaaagttggtaggtcattcatcttgaggtttctgtgaacatcatatttgcctctgtaaataaataagcaaaacacactccattttaatgagatcctttccaatatcccatatttttaaaaagtgacattactttcccttaactgtagaacaaagtcaagaagcctctgtctagtcttcagggtctcctagagtgtggccccagtgacattcagaatacagtgagtaggattgaagtatgacaactgaggctacattatgaagatgttgtgtcctctgccttattccctgaggttgtttgctttctgggaaagccagtcaccctatcatgaagacacttaggcaaattaaggaaaagttcacatggggaggaagtgggcccttctcctaacaactagcaccagcttgccaactatgtgagtgggacatcttggaactgcagcttcaattctagtcaggcttcatatctgcagagatgacatcttttatatatatatatatatgtaagttcaggggtgcatgtgcagatttgtatataggtaaacttgtgtcatgggggtatgtcgtacagattattttgtcacccagatattaagcataataccccattagttctttttcctgattctctccctctccctaccctccaccctccaataggccccagtgtgtgttgttcccctctatgtgtctatgtattctcatcatttagctcccacttataagtgagaacatgcagtatttggctttctgtttctgtgtgagtttgctaaggataatggcctccacctccacccatgttcctgcagaggacaggatttcattatttttatgaccgtatagtattccatggtatatatataccacattttctttatccagtataccgttgatgggcatttaggttggttccatgtctttgctattgcgaatagtgctgcaatgaacatctgtatacatgtgtctttataatacaatgatttacattcctttgggtgttgctggattgaatgatatttctgtttttaggtgtttgaggaatcaccacactgctttcctcaatggctgaactaatttacactcccaccaacagtgtataagcattcctgtttctccacaaccccacccgcatctgttatttttttgactttttaaaaatagccattctgactggtatgagtatctcattgtggttatgatttgcatttctctaatcatcaataatgctgagcttttttttcatatgattgttggccgcatgtacagaaatgtcatcttgatgggctaagacagaactgcccagctgaattactcccgattcttgcctcacagaagccataacataataaatgtttattgttgttttaaggcaatatatcttgagataatttgttatgcagccttagatcaataatatataacctctgttaaaatttaatgtagaaaatgagctgaataaatgttacaatgagttttattttaaaaactaagtcaacacgtctttttaaaaacttagggtttttttactacttaatatgaaagttaagaatatttgcacactccatatttcatggtacttaattttttgcatatgaagcctcaaatataaactttattaatgttatttttaaaagaaaaccagaatatgaactaggtgttaagtcatatttattttaaagtaatccaagaattcatatgaatattcactgtcagtgaaaaaattaaatcaataaatgaggagctataacatcagatattttttacttgttttacatacacaaacaagatgataagttgatctaaaacaagacttagaaatcaactgcatgtgtgctacaggcttaatatttctaaatattgtaacaaatgcaaaataagacagtttcttaatgcaaggtgcttttagccttatttgttagtaaaaagctagcaaacactaaaaattaagggagatatttgggctattggattaagtgctttcagaaaactgaagaaataaaactgaagcagaggtggttaggtgttgatgaaaaaggtttgcatagatgatgggtaaatatcattgatttatgttgggctttggagtcggtaagggtggagatgagtgtattaggtcaccagctgctcctccttctcccagagtcaggggaattgggtgagtgggtaaggaggccttgcttccggtaaacactccttgatgttcccttagagtcatccctttgaagactcccgtccctttgatgacaccagcaggggtgaccccttttaagccatcagagtagttcacccatgggagcacgtgtgaaacattagcctgcttctgcccctctcctgctgtttgctgctgcacaagtatattctgagcagaatgggggtccagagagggatggtttttagtcttccaataatgcatgggaaccaaaaagtcaatctgtaattgatccctaaactccaagcctactataatgacatgaatttctgcctagattcatggtattttgtattttacagtctttcattttctgatgaatgtttctcaatgcaattcttcaccattggaaaccccaaccaggagtgagaatatgggattttctagatagatatgtagatgaatgtataaagagatggataggtgagaatcagattgtggtttagcacaggtttcagagtcagtctgcctgcatataaaacccagtacaactccttacaaatcatgtgaccttggaaagttagtaaattgtctgtgactcagttttcccctgggggatgtagtcatttcttgtaacaattaaatgacaataagtataaaaaacttagaataatgcctaccacatattatgcagtcgttagataaaacagctgtttgtgtttggtggtgctgttgataggaaaacatattgccttgtagtaatacttgatgttatcccaactttgccttacctttatatcatcccaggtgtataaaaactcttacctgtcctataggctaacccagtttgtcattcttttggaacatttgacttttactgatagccatattggcttatcactggtttgacctacactaacatttcactgtgtaccagctcatatcccctttctcttacttcagggcatcaccctagaaattcttttctcttttatgtgaatattttcctcgctccaatctttaaaaaccaacctaccaaccaaacaaacaaaaacactttatctccatatccctgctttgactgctaatccagttctttgttcccatttaagaaaatttcttgaaatacatataaacatagcatttccaattcctcacctcccatcctctcccggagcttttatccatactgctctaccaaggtcactagtgacctccgacttctgaaattcaagttttgattatcacgtcttacttgaactatctgtaattattgacacagttgaccactcttcctccttgagacattttcttcacttgggtactagaaccccatattctcctagttttctttctttcccattagctgttccatctctgctactttggttggttggtcctgagcacttccaatagttctatgtcggcatgcttcacaactcaatccttgatctcctctcttctctatctatcctttcatccttggtgatcttcaggtagtctcacagctttcgatacgctctacatgctgacaaattccagatttacgtttccagcctggatttatcttttcaacttcagacatctagcaacctatttgaaaaatccacttggacaaatcatacacatcaccctaaaatatcaaaactgaactactttttctctaagcctgttcctcttacaattttccctattttactaaaaagaactccatccttcccattcatgaggctcaaaatttcagaatcatccttttcttttttctttcactcacatcgtatcttggtccaacagcaaatcacattaattctaccttaaaaatgtatccaaaaccaacctcttggcattaacactgcagtctaggccacatcttttgcctggattattgcaatgacttctgacttatcttcatatttctgcctttgccttcctattgcctgttttcaaccttgcaggtattttataatataaattagaggacaaaaccaactgctcagagctctccagaggctcctttttcagaataaaaggcaaatctttacaatggtctacaaggccccagacaacttgcacccctttctccaccttgcgtcccatctcattgcttcctcttctcctctgccttcagaggagactgttccagccactataactgtcttgctaattgtaacacatatcagacagacttctgctccagagcaactgcagtttctgttttctctacccagaatactccatcctcagatcccacagggctcactcgtccatctccttctcaattggaccttctctaatctcttaaactaaaattgcagccctctggtttttgttcccacactccctagtaccctttatttgtttaattttatatatatttttaatttttccataggttactgaggttcaggtggtatttggttacataagtaagttttttagtggtgatttgtgagattttggtgtacccatcacccaagcagtatacacttcaccatatttgtagtctatccttcgccccacctccgactcttccccccaagtccccaaagtccattgtatcattcttatgcctttgtgtcctcatagcttagctcccacatatcagtgagaacatatgatgtttgattttccattcctgagttacttcacttacaataatagcctccaatctcatccaggttactacaaatgctgttaagtcactcctttttatggctgcatagtattccatcatatatatatatatatatatatatatatatacatacatacatacatatctcacagtttctttatccactcattgattgatgggcatttgggttggttccattattttgcaattatgaattgtgctgctataaacatgtgtgtgtaagtatctttttcaagtaatgacttcttttcctctggttagatatccagtagttggattgctggaacaaattgtagttctacttttagttctttaaggaatctccaccctgttttccatagtggccgtactagtctacattcccaccaacagtgtaagtgtcccctgttcagcacatccatgccaacatctactgttttttgatttttttgattatggctattcttgcaggagtaaggtggtattgcattgtggttttgatttgcatttccctgatcattagtgatgttgagtatgttttcatatgtttgttgcccatttgtatatcttcttttgagaattgtgtattcatattcttagcccactttttgataggcttgttcgttttatttcttactgatgtgtttgagtttgttgtagattctggatattagtcctttgtcagatgtatagattttgaagattttctcccactctgtaggttatctgtttactctgctgactgttccttttgccatgcaaaaatgatctttagtttaattaggtctcagctatttatctttgtttttattgcatttgcttttgggtccttggccatgaaatccttgcctaagccaatgtctagaagggtttttccaatgtttcttctagaatttcagtagtttcaggtcttaggtttaagcccttaatccatcttgagttgatttttgtttaaggtgagagatgaggatctagtttcattctcctacatgtggctagccaatcatcccagcaccatttgttgaaaaggatgtcctttccccactttatctttttgtttgctttcttgaagatcagttgaatgtaagaatttgggtttatttctgggctctccattctgttccattggtctatgtgcctttttttgtgccagtaccacactgttttggtcactgtggccttataatgtagtttgaaatcaggcctagtaccactttcttgcctaatttttctccacagcacttaccacatttaatatactatatttaatttgtttctttgtctcctccactagcatgtaagtcatgagggttgatttttttttttttttttggtctgttttgtccactgttccatcctcagccagcatctataacagtgcctggcatatgcttatttttattggcaatttgctaaaagtacttcatgatatcataaaactgcctgattctgctgaaaacatagacaatttgaatactgttttgattacaaaactcagattacttaaaatgttcaaaataatttcaagggtttttattttaccttgtcttagttggttcaagttatttaccacagtctatgaaatgcctgttagcataactgacttgcatgatttaccagtctcaagagagttagttagattgataaacactaaaaagattacagaagttccctggaatcatagtttgtccctcacagcaggattattctgttattaagctgagaataattgctgtcacctttagccacttggtttttattataaaacatgcagagcaaaggtgatgttttaccaactttgaaaatgtactttgttgttttagtcaattaaaatcgtatttccatgctgaaaaataatggctgaaaaatgtgtgtcataaccagacatacaataggccaaacctgccccaagcatcctcagggctgtgagtcatttgcagagatggctgagctcctgatcacaagatgcacagtgaatgccattttcatttcccagagactccagagtaggaaaaatctttatattccttcaggactattaggtatcttgtatatatcacaaaggaacaggtcaaaatccatggaaaaaaaaatatggaaaacttttgtgaatagggtcaacatgtcagtcataatcaccaaaggaacctaagatttattcctgaattcctttgaaaatgtgcagatgctattaaatatccatagattccatccaatattacagtgaaataggcaaatagaaaatcctaaattgcaagagatcttatattctgtcaatgacacatgttatcagtggaataaaaatgtaattggagaattttaacatctggtccttgaagcagttcaacaggaatgaggtgttgtttgatgtattttaattaatgaattatcataatcaaagcaagacagtatatgaaagcagcataaagatagaagaagctatttccaaattcccatcacattatttttaaggtttttagttctatctctggaaaaataaggaaatgttgcttacctgactaacagtggcaccatctaagattatttttttcttgaggtgatgcatttcataatgtgctattttattacaaagaataaaaatatagtcaatcccctgtatccttgggttccacatcattggattcaaccaaccacaaataaaaaatattagaaaaagttgcatttgtgctgaacatgtacatacttttctttctattattccctaaacaacgcaatgtaacaactatttacgttgtaaataaagcatttacattgtatctgttattataagtaatctagagataatttaaagtgtatgggaggatgtgctcaggctatatgcaaatactacaccattttatatcagggacttgaggatctgtggattttggtatccacaggagatcctggaactagtcccccatgattaccaagggatgactgtatgttctattcagaaatgagaacccactgcatttagtaaaatataaagacatgaataatagaaacatcttctataagcagcacaaaaaccatagcatagcattgcaatgatagattaacaacaaaacatagaactttacattttctacttctgggtgaagttgcactgcacatgtgcccagttatattattattgtcgttctctgggtaatgcgtgagaaatcattttgtaagcaatgaaaacgtggtaatttccttgttacttcttaatttgtgtttctaatttcagatctctttccctttccagaggaagttagcgatgccatagctttaatgtctgttttagctgtaaaactctaatgttcactttctcttagaaaatctaaagcaggtgatacataatttctcacgatttggaatttttaaaaggcaagtaaatttgaaggtcgagtgtgggtaggttaaggggaagtcagaacactggtgatgttttcttgaataaaaagaaaacctttcatcgtaatgcaattgtcaactgcatcaccaccataatcattatagtctcactttcattcactttgtttaaaatccaaaaatattctgatttggattttcaacaggaagtaaaaagaaaaaaaaaaaaagaaatgaagaggtcgcagctaatccagggatttaagccactgcgttgctggtctcagaaggaatctggtctggaaggaggagacctgaactaaaggagagggggttcttgctcttaaactcttagagaaaatcttttcacttggaaacctacttttttccattcatccccactgggtaaactgatgaaatttagcctgggaatgagaggcctatattacaagtttttcgcagtggttcttaatgctcttctatgcgtttcctgtttcattttacctgagcaaacatctgctcccctttaccaaatgaaattatatgaaaggatatggcacagtgccaggcacgtaagtagctgctcagttttagtggagcacatggacctgtaataataataacaatagtatcatacacacagtgcaaagctttttctgacaagtcttagcttgctcttgtgtgcccatatctagagtactgaagacacaagtcagaatctgtgcaaaacagaccaggatcctcaggtctgcatcactgggcagaagtgggtggttgataatatttgctggaataaatagcaatgaaacacctgcactaagtgaattccaatggcttatcatgtcagttcgtctcagaaacattagcctttttatgagtttttattccactgacatagcatatcctcaagttatattaattgcatattaacagcatagctaataaactcacatgacatgatgaaatgttgcaaatatgctttgatggagcctaaagattagatcttttatgtactatttttttttctgttgtcatttgtcagtaaaagtgataaagaagggatttactctcttttctatttattttattttcaaaatttacctctgagaatgtccccccaataaacattactcaaaggggtaaagacattataaaagacctttttatcaaaagagtattcaaaatgatttgccaaaggcaagaaagtagaaaatctgagatttagctttccccttctgaaaggtacacttacaaatttctggtcagcatgagatacccatagctttcacctgcatattactgaagaaaccaatgatatcctctgtacctctggaacatggccaggtcttttcccatttcccaatgaaccaccctcatgatggctttgaggaggtgagtcatactgagtaagccccaggaaaatggaagaggggtctatctacaggatggagtccctgagtggcttcttggcaactctgattttggcaacagttggtcctcagagaggacatctcagactttgtgaatgcctctcaggaatcattttcagccatttccagcctttggattatgatgcctgttgcctgattctgtatctattgcctgactgtggcttagagcatattgatgtatcatctgtctcctacaagctcagggaatagttgaaggtaagcgtcttgtgctgaagcagcatgaggactttatgctttactttagtctatgtgatgactcgtaaattccatatttactgagaggacagtagaattgtgaaaagtatattaaatttaaatttcaaaaagggagccttcacctacccttcttttaataaagagtctagaatagattgtagaaatcccatgcttccttcattatatattccatcatttttagtttggtccttttattcgctggtacctgattgtatacaatatggttcagaaattaaaccgtgaaaaaaagcataaattgcaatatacagcaaagtacaaagagttaacaaagtttaccaggaccaacataaaaacaccaattagaacatttcaaatgaagaaactgagtattagggaaagggtcaaaccccaacattatggcatgtttggatattcatatgtgcctacattaactttatatagtaacaccttacttatctctagtttgcttgccaagcaactctcatacctagatcccagccaaggggtgagggaagtggaaacttagatcagccaaaaattcatggacagaaaatcaggcaattagtattaacaaaacagtacatggcactagcaaaaactccatgaaaaataatgatcatcttttattattattactaatgattgcttatagctttgtttcacatgcattctctcatttattaatatttatgataacccactgaagttggtttgttgatcatacccattaaacagttgaagaaaactgaggcagatgaattaagtagcttgtttaggtggccagtgagtaatggaattgggatttgtctgaagaagactggctccagaggttatgcttcagttgttgtatattactgcctcctttatgcatcttcatgccaggcactcatcgctcacatggatatagtatagggacaattctcataaaattggctatctggctttatagcttatagaaaacaagtatattttggtcagagatggggagttaagacaggttccttgaccctatcaaaagataatgcttaaagtctgatcaactaataatgcaaaccatagaagttttattggagtcatcttaaatagaggtaacatcacagtgattgtttattcaaatgttgaccaggcatcatcctctgaatgttctgctacatagattatgccttaattggttggaagaaaacaactatcctagaaatactgattatctaattttttaatggggcaagagaaatctatgtggtcattagaagggataaacttcaataatttgaattatgtgcttcttcatggagcaccccatttttgatggtgttaggtaattaggtgttactattaaaggcgtatttatattttggctgggtgtggtggctcacacttgtaatctcagcactttgagaggctgaggcaggaagatcacttgagcccaggaatttgaaatcagcctgggcaacatggtgaaacctggtctctacaaaaaattcaaaaaattttggccagacatggtggagggtgcctgtggtcccagctactcaggaggctgaggcaggagaactgcttgagcccaggagatcaaggctgcagtgaatcattatctcaccactgcactccagcttgggcaatagagctggatcttgtctaggaagaaagaaagagagaaagagagagagagagagagaaagagagagagagaatatttatcaatatgtttaaaagattccagatctagaaagtatcccattcagcttactttccgtaatacttagggcttagattaatgactgaagagtcttttgcttattaagcaaacttttgattcaccattacgctaggtaacaaatttcattccttatattacctaagaaaggtcttatctctgaacaaatactctagactgttggatttaagaatagatagatagtaatagaactccacttcctgtatacaaatgtatttcctaaacgcacatgagaatatatgttagcagcctgaaacctaagattgcagtgattcttattgctgctcatttctgtttaaatctttgtttcctaatcagcaagtaacactctagaaattaacaataacatttatgaaactatttcaagtcctttctcttattggaaacagatttgaaccttttctagcttcatgcataggatggaacaaaatttagggggaaaaaagttaacagtgcaagccaaataactcagtcatatcagggtcattttgttttctttgctggtgctttgattcttcagactttagcaagaaagacctgtaagaatgttgtttctacactttgggaggctgaggctggcggatcacctgaggttgggagttcgagaccagcctggccaatatggtgaaaccccatctctactaaaaatacaaaaattatccgggcatgatggtgggcgcctgtagtcccagctgccaaggaggctgagccaggagaattgctcgaacccgggaggtggaggatgcagtgagccgagatcacgccattacactccagcctgggcgacagagctagactccatctcacagaaaacaaacaaaaaaacaaaaaacaaaaaaaaaagaatgttgtttctaaaacaattctcaatatagcagtggaatttttggctccagaacatcaatgtatcttttttatataaaacaaaactccactgataattatctattttgtattatgtatcttaagtggtatctttgtgcaaatagtatatgctattgaataatttctttactaccagaatatcctttatagttcagtaaaaacagaacaattactgctaaaaatagattctctcaatttgcaattgtttgccccatatttcatatatttacattaaggttggttcatattttgtttttcttgtgagtggccaaatatcacaagtactacagaaatgaagataccgtgtgactacttctgcttctgttcaggagggacaacccctccctatggcttcacacactaagtccctcaacttcctcctagcatacttcactggacactgctccaagtgccaacactcaggacaagtttctaaggcttccacctccagttcagcaatttcctgttatgatgaggtcaaagaaaggttttctgtccctgtgaatctgcaagttctactatgtctgtttataactgcaaagttaaaggatggtaaataagaccgagaatccaatcagatactgtctgttctttgaaaacattaagtggacattgaacatccccattgttaagactgggaaagagaggcaacaagtcaaggtagtgctcctatcactttatatagtttcttctattatcaaaaagccttgcaaaacccaattaattcacataggccacgtgaatttggtagttattaactcttgagacaaaacttaataacttaggtgaggaaaagggagccaaaaaaaaaaaaagagagagagagagagtagtgagaatagcatgtggccaaatattcaactctgtatctgaaaactatgtgggaaaaaggaagtcaaatatgaaaaaaaatctccagctgttaaatggcataaagaattgtcataatagctccggtctacagctcccagcgtgagcgacgcagaagacgggtgatttctgcatttccatctgaggtaccgggttcatctcactagggagtgccagacagtgggcgcaggccagtgggtgcgtgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaaaaaacggcgcaccacgagactatatcccacacctggctcggagggtcctatgcccacggaatctcgctgattgctagcacagcagtctgagatcaaactgcaaggcggcagcgaggctgggggaggggcgcccgccattgcccaggcttgcttaggtaaacaaagcagccgggaagctcgaactgggtggagcccaccacagctccaggaggcctgcctgccactgtaggctccacctctgggggcagggcacagacaaacaaaaagacagcagtaacctctgcagacttaaatgtccctgcctgacagctttgaagagagcagtggttctcccagcacgcagctggagatctgagaaccggcagactgcctcctcaagtgggtccctgacccctgacccccgagcagtctaactgggaggcaccccccagcagaggcacactgacacctcacacagcagggtattccaacagacctgcagctgagggtcctgtctgttagaaggaaaactaacagacagaaaggacatccacaccaaaaacccatctgtacatcaccatcatcaaagaccaaaagtagataaaaccacaaagatggggaaaaaaacagaacagaaaaactggaaactctaaaacgcagagtgtctctcctcctccaaaggaacgcagttcctcaccagcaacggaacaaagctggatggagaatgactttgatgagctgagagaagaaggcttcagacgatcaaattactctgagctacgggaggacattcaaaccaaaggcaaagcagttgaaaactttgaaaaaaatttagaagcatgtataactagaataaccaatacagagaagtgcttaaaggagctgatggagctgaaaaccaaggctcgagaactacgtgaagaatgcagaagcctgaggagccgatgcgatcaactggaagaaagggtatcagcaatggaagatgaaatgaatgaaatgaagcgagaagggaagtttagagaaaaaagaataaaaataaatgagcaaagcctccaagaaatatgggactatgtgaaaagaccaaatctacgtctgattggtgtacctgaaagtgacggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctttcggcagaaaccctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccgtcgagactaggaagaaactgcatcaactaacgagcaaaataaccagcaaacatcataatgacaggatcaaattcacacataacactattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggagaacaaaaaaaggcaggggttgcaatcctagtttctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctgcagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactatatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagaacaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacacaaataaactagaaaatctagaagaaatggataaattcctcgacacatacactctcccaagactaaaccaggaagaagttgaatctctgaatagaccaataacaggagctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagctgcagaaaaaagcctttgacaaaattcaacaacccttcatgctaaaaactctcaataaattaggtattgatgggacgtatttcaaaataataagagctatctatgacaaatccacagccaatatcatactgaatgggcaaaaactggaagcattccctttgaaaactggcacaagacagggatgccctctctcaccactcctattcaacacagtgttggaagttatggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacgattgcttcaaagagaataaaatacctaggaatccaacttacaaaggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagtttatatggaaccaaaaaagagcccgcatcgccaagtcaatcctaagccaaaagaacaaagctggaggcatcacactacctgacttcaaactatactgcaaggctacagtaaccaaaacagcatggtactggtaccaaaacagagatatagatcaatggaacagaacagagccctcagaaataacgccacatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacagtgaactcaaacaaatttacaagaaagaaacaaacaaccccatcaaaaagtgggtgaaggacatgaacagacacttctcaaaagaagacatttatgcagccaaaaaacacatgaaaaaatgctcatcatcactagccatcagagaaatgcaaatcaaaaccactatgaaataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagagctagaaataccatttgacccagccatcccattactgggtatatacccaaatgactataaatcatgctgctataaagacacatgcacacatatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacaagttagtgggtgcagcgcaccggcatggcacatgtatacatatgtaactaacctgcacaatgtgcacatgtaccctaaaacttaaagtataataaaaaaaaataaataaataaaattaaaaaaaaaaaagagattcctttttttgagaataaattttaattggttatggtttttactgaaatgagttgattagatgtgtagagaaactgctataatttttcatgtttaagggaaagccaataaaatatatatgaggaaaaaaataaaaataaaaataaaaatttctacagtgtaaaaaaaaaaaaaaaaaaaaaaaagaattgtcataataggcctgaatgccccctcccagtttctttcattttactcaattatttaccaacaattaaaaaatggggaaaattatttagggctgttcaactagatatatacaagtgtagagtgaggagctttaagacatgaatgtcagctgaagtgttacagcagcattcatttgaactggcatatggctaaagtgaaatctgattgtggtttttttcccaaacttctgtaacgagtgatggatatgctcagagaagcaattattataataattttgtatacatatagaaaagacaagacattgagttgttcccccttcaccattgtctcttcactcctgtgatttgtgggaaaatgtatggaaaggcaccagtttctaatattatagtcatctcaatatacaaatcctgctcaatgaattttactgtgacccttttgaatgactgtgcagaaaccttagcaatgtggaaatttgtaatccctttataaagttatctgattttgagagggacacctttccaaggtaaaagttatgaagaagatcacaattcaattaagcttattttgtttctgtcatctcctgtaagtatgcactgcattaaaaactacagaatgactacattggcaggatcaaggttcacatattgttagtgatcagtcgtatcaataatatggcacttgaaacgctgtgatgaaaatggcacttatctctgtagtcttcttcttcctcagaatgtcctaattctagtctaatcatgagaaaaacatcagactatcccaaattgagggacattctacaaaacacttgtcaagtatttctcaaaaacaaggaagggagataagacaaataaatacaagatgatattctggatgggatcccggaccagaaaacggaccataagtataagctaaggaaatctgaataaaagtatggagtttagtttcaaaaggaaacaaaaccctatagattgcttcatcattcaagtttaaaacaagttttattgatacaccattcagttttttggcagcatcatagaacaatgccaaattttgcatccaatggcagtgacttgataacaaatgtgagatgtttcctgggacttaattcatttgattaacgcaccgatcactattaccaaacaacttaacatggtaaaaattttgctccattttattcttttctgcttagtaatttctatactaagaatgatatacgggctttctccatttcaagaatggatggtgttctcaaagaccatttgagaacagttgtttggaccctggatacattttcctgtgatacttgtatactaagtagtaagtgtcttgtcacgtacatatcaaataaatactaatggttctttaaaatatacatgtgattattaccattggtaattaactgctgtatagacttacttatgaatttcattttaaaatactgatgcctagtcccaaatctcgaagttttatcgagtctgtttttcacacaacccatattctaatatgaatcttgggaagggaaggaacctctggtctgttatagttctatttcaaacatccaagacgtattttccccaactactgtttgggcattaaatcagggtctcctgcctgcctgttttgcgtaccaggagttgaaagcaggactccatgaaatgaaaacctctggtattattttcccgaagcaagagctttaggagcctaggattggaggacaggattgggaaggggacgattgagtagcaaaaagagaaactacaggtaccaggactctctgcaaagtttgtatctctcaagacacttggaataatagaactgtcaagctgtaagtgagcttcgtagacatgtccaatgcaaacccttcgttttgcagaaaaggggatatcttgcacaagttggcctggggctagcttcctgataatttcttttgttatactcctagaggccatggagggtaacttgtaatcttattttcttctttccacacattgcattatactgtctttttattgtttgacccactacaaccatgactatatccctaagccttctgtacatgaagttatgcaaaattcatcagagatttcctattcagaagatcgctgctagtaaccatagagaaaaggtgcagcctggattcttataaacatgagagaacacagcaaaaatttggaagccagaaataaaagctgacttctagtgtttaagtcctgccttaactttctgttcccagttcaatatttcgactgatccctttgattaatattataattaagactagttttaaggtttaagattaaatgtttccatctttctttgaataccctccatttaacaaatgacctgcaaaacaaagcaaagactcttcttagtcttcgggtagaaaagggatttttaaatttgaaggcaaaacgtgatttgtctttagctatcccttctttagaaatgaaggctatggcaaagatgtcctcatggaaattgcaatgagagctctgtagtaatgcatgatttttccagggtggcgtgaagcaataacatgaagatgagggacgtttacctgcaggcctgagttgctgcagcagtgaaagcaggaggaggagtcattttcatctatcttctttctcattaaacctcacctctctggccctgggtagccatgccataatagtcaccaactctggaccaccctggtctacaataaaaagcaaacaactcaggactgaggttcagagagacgcagaagaaaatgaagaaattaacttgcactgagatgagagagaatttcctcagatcccagcttctaatggctgtgcatttatataaaggaaatatctattctggcatgaataaagttgagaacttcatgcatttttgtttgaatacatatatgagattattgatattctgtaaagcaaaaaagaatcatcactaaataacttaataaatgaacttttcattatggccaatgattccattaaagtaacatataccaaaagggagaaaaccttgaattcttttctggccagttctttattcatggaccttttttagaaaaagaaaaatttggccaggcacggtgcctcacacctgtaatcccaacactttaggaggccaaggtgggtggatcacttgagttcaggagttggagaccatcctggccaacatggtgaaaccctgtctctacaacaacacaaaaattagctgggtatggtggcatgtgcctgtagtcccagctactcaggaggctgaggcaggagactcacttgaacccaggaggtagaggttacagtgagtccagatcacaccactgcactccagcctgagtgacagacggagactcagtctcaaaaaaaaagaaggagaaggagaaagagaagaagaagaaagaagaagaaaaaagaaaagaaaaatttatttcaaactgtaaaaaaatttcaagattaattatttaaaatgaatatttgccaatacatttaaagctgacaatgggtagtatattctcattcatcttttacaaatgctgctctgatatttgaatttttaaaacatctcttttgagtacctgtggactttcatttttggcctttaattttattggaacacacacaggcaggaaccacgttgtaggcaagaacacgtaagtgcttagctgtagggaggccaaaattgttctagactgaaatgtgtagtaaaagaacatattactcaaatatattttataacttttacatttgcctttgtttttcaaatataaggacattacaaaaactgcagatagaatcagatagtaaaaattattatagcccagaagtcagaatggcagtcttctatgcctaggtctttatgaccttagctaaagtcatttaacatctccagattagttcctttatttaaaaaaaagcaatgtggaggttaaactagatgaggtccactgttttgaagtgtgttggcattttaagattttgagataaaaacatctttaaaatggtgactctctgctgtcatgtttaaaaggaaaattatttatgtggaataagcataaatatgctatgatgtgaaacatgcccaaggtcctaatttttccggtgtttaattattgaaaccaatcacttatcagcagctggtttacccaggtgcaaaatagaagtaaaagtatttgttatcttatcttcacaaagaatcagccaggataaattaaataagagagattttaaagtcgtagaagaaaggtgctttctaaatacagaatatttgcattactatcattcttattatgcagcagatatacgaaatgcaattttcctgtatattcccgttggctatagctcctcaagaaaatgtatttgaaaaataagtggaactatttcatgactagagtgctcaaagaaaagtctatttctgaaaaccacaattttggaaatagcaggagcaaactaacgttatctcaaattccctgaagaagagattatattttccagagtaaattgatataatgaaatacttcagattcattaaattacttttacactttctatttctttaagttattccttccactgctaaaaggatggtgattacacctagatgctgtacaacaagaatacattagaaattggccctttttgcttagaattttagaagtcttcttgtttaaagagattttttaaaactttatagtaataggtactttagaaaattttttaatttgaaaacatgatttagcagaaaataactccccatacaaagaaacgctaagatggttctttttgatttccaatgaagtcaaaagattctgccttcaaagcttagttatcaataagactctttgtatagcaattaaattaataagagatgattgatgacttgattatagaatctacccatttttattttagtgtctaagcttatttaatttcaagcatttgaaaatcgagggaataaggacatgtatctcctaacattttccacgtacacaaaaagttgcaatgaggcaacagtccctgtagtttaagcccaaatcacatcttcctttttaaacgtgaaaatatcttttattggttcagttttcaatgctactttctctatatataggtattcttctgacagaagtaaataaaatatttattattatatattaaataatatattaataattaataaataatactttaaaaatatatactttaatatatatttaaatatatattaagatatatttaaatatataccttaatatatatttaaatatatatttagatatatttaaatatatttaaatatactttaatatatatttaaatatttttatatatttaaatattataaaatatttaaataatacttttttaataaactttttaaaatatatatatatttaaatatactttaaatatatatttaaaatatatttaaaaatattaaaaatattaaaaatataaaaaaataaaatatataaaaaaatttaaaagaatactttttatttacttttccagacttgcagattagtcaatacactaagctttattaaatcaggaacaattatcacataaaatcctgtgtaccaaatgttcattcagtacatggccagcattatattttggatatatcatagaccagatctatatattttgggcttaaggctcactttctcaatgttcttactcctttttcaaactgtttctgtagataattatttacagattgcagtgctctttggttacataaaaaatgaaagaggatttctgggcatttatctgaacatttaagtaagctgggattctgaattgatttttccactaaatttatacttattacttaagtgtatatttatcagtattcccagaaaggctaagacattgaagaaatcagagttggaaggacaaagtcactagcagaaccaggaacacaagtgatgagcttttgataagccaggatgctctcttgtagcattttaaaatccagggtagaccttgatgttcttactgaatctcatcttacctactacagttatggaataagaaataaactcagtcatacatgacagttcatgtgtgtttactaaaacattttattttcgtagttttccccaagaattgatcgatctaaactcaagaggaaatgaaagtatactgaagagcagatgagtccaggcaaagccaggctaactgatttgcatgtggattggtagatgttaacaccattttatttatttatttatttatttatttatttatttatttatttatttatttatttgttggaggcacttagagtagacttctgtagctcatttggattatggatgacctgggctaaaactaatagggctatatttgccttttgttctgttggctctgaattacccatctggaactatagttatgttccttttgcatgtggactttacttttaaatggtacataatattgtctgctttgtaaaataatgctgagttacttctgttattggaatggcaaggtgaaagtaaaattctgagtttcacaaattttgtcctgggttgaaacattatatttggtttccaatacatagggagagatgtttagttcttaataataatggtcagtcataaggtgtagcatctgactctgttaatttaaaatgacagaattgattcaagggtattacatcaagaatggaaaacaattgtgaataataagggacacttgattcttattccttggttttgtagagactggtaatattggaagaaatggaaatataataactaatgactattatctattttccaaagaaatgtgaatatgatactgtgcagatacgtgattttagaaagagagatggggaaggggaggaagagactgagattattctattattgttttcttgtttctaaaccatgcatatgtatcttggtctcatttttatacttgtaactttacatttttattgtttttagagcctcctttggtgaataaacagaaatgaaaaggtgaaaatcaaatcaactttgttactccttagttcttaaaagttcaatatttcattatttaaagagtcccctataggccagttgtggtggctcatgcctgtaatcccagcactttgggaggccgaggcaggcggatcacctgaggtcgggagttcaagaccagcctgaccaacatggtgaaaccccatctctactaaaaatacaaaatgagccatgcgtggtggtgcatgcctataatcccagctactcaggaggctgaggcaggagaatcacttgaatcctggaggcagaggttgcagtgagccgagatcatgccattgcactccagcctgggcaacaagagtgaaacacagtctcaaaaaaaaaaaaaaaaaaaaaaagagtcgcctataaggattagctattgtctgtggtttctaatcaccatagccccagatgaatcttataatcagacatatttgatttgagaaatgatgtattacttctgccttcttcacacaacatacttatcttgttgtatatttgtattgtgtgttgttaacctactttatggctttataagctccctataggtataagcacagaaggcatgtcagtgtttgcacttttctgggaagagaattcacagcttttgccctatactaaaataataataacaataataatttttttaaaaaatcattgtctcaaactaaattaaaaatgattagaaaatgtgttatatactattttatattttaagcaaccaaataccagaaactgcatttcttactaaaagtatttctgctagcatttgacaactgtcctcccctaaacactgttgcacaaatggattttaaaattgcatgaaactgggcctaattcctcagacccagtatcccacagtaataagttagataggaacttgggttgcacatttatctcctcaggcaaaagaaggttgtttaataaaataacaggtatttacttaaccatttatttagccatcttcctcacttaaacttttatcaattctaaagaaaacagaacataattaattaattcaaattatcttcaaataattctcaagtaaagaaaaagaatgaaaatgtccctcccagttatggcaagaaacagttaaatatccgaaaaatctaaaacatccacagtttagcccctttatataggttcattatgcagtgattttcatgttaaaacaactattaattcaaaaagtgaaagtgtgtgcagagtctctgtgaaaatgtgactcttgtctctaaaaataatctgccgagaccagctcggtcggggagaccctaacccagcggtgctagaggaattaaagacgcacacacagaaatatagaggtgtgaagtgggaaatcatgggtctcacagctttcagagctgagagccccgaacagagatttacccacatatttattaacagcaaaccagtcattagcattgtttatatagatattaaattaactaaaagtatcccttatgggaaacgaagggatgggccaaattaaagaaatacgttgggctagttaaatgcagcaggaacatgcctttaaggcataaatcgctcatgctattgtttgtggcttaagaatgcctttgagtggttttccgccctgggcgggccaggtgttcctggccctcattcctgtaaacccacaaccttccagtgcgggcattagggccattatgaacatgttacagtgctgcagagattttgtttatggccagtcttcgggccagtttatggccagattttggggggcttgctcccaacataatccaacaagaaaaataaatgcatataaaatattaagcaaactaagatttcttgagtggaaaagataaacagttatggttacttttctatattatttgactttcccaaaaatcaggacctgaaacaagtacaaacagaatggaggatcaagaggacgactattcaaagaccgcttcaaaatgtatcttaccaataagataaaatcacacaactaggtagtgttttaaaaattcacctagtaatgttagcaaagtaattagcaaagactagcaaagcgtgattacaacattaccaatatctttgcatcaaaacgtgaaatattttaactataattggtacttcccgtatatagggaagtatatatttaagtggattttgatggttaaagagaaaatttctaccatttaagatgaaacttaatatactcatcctattaattaaatactatcagtaattagtcaggtaatagctataaacaaagtcgagaggtctttgctgtagatatgcaaacataaagtaactgccttataacttttgcgccctgtatctgccttttgttagcaatgttgcctttctcttcttttccttcctttcctttctcttttctttcctttcttttcttttccttcttttcctttcctttcctttttttctccctttccttcccccttcccccttccccacgcttcccccttctccccccgcctccttccctccccttccctccccttccctccccttccctccccttccctccccttccctccccttccctctccttcccttcccttccttcctctctttctttctctttctctgtcttttctaagctgtgttggctatttcagaactattgtttattcctattgctctaggaccagaagagcagggcccaagaccaatgtaaaaaagcccccaaccttcttgccaaaatgtctcatcctcagactcactggatagctacttatctcctgggccattttaatccaccccaaaaatcttgtgtgacttatggaacttcctgaggctttcagaagatatagaactataggttttaactcttactgtgcatcaaaatcacctgggagctttttaaaagtagggatgtctaggtagcacctccagaaatttctcattcacttggtctgtggcaaggcttaaattaattgtttttaaaagatgctcaggtagctgtaatgtgcaacaaaaggctagaatccctccactaatctatgtgtacttccagcctaacttcacaaggccccaaaatgagaattttgggggtgctttcaaggattacaaataataacaccatactttgaatatatgaaatggtatcaaaatagtctgaaagagttcaccctgtttgttagctgggcgtagtgacgcacacgtgtaatcccagctacttgggaggctgaggcacgagaatagcttgaaacctgggaagtggaggttgcagtgagccaagattgcaccgctgcactctagcctcagcctgggtgacacagcaagactctgtctaaaaaaaacaaaaagcaaaaaacaaaaaaccaaaaaaacaagtttcaccctgtttgcacctgagatttctaaatccaacaaacacgtggattattattcaacaacgatctcattaaggatttaattatccaggcggccaggaaatgcttgaccacatacagtcacagggtctgatctcaacagatgtcttttttcagcacctgttggagtcaactttgccgctagccctttcaatgggatggagttttaattttccaaaagtagcaagccagctggaatgctagaaatgcacatttgctgcttctgttccattctagtaaaccatctcccggatcactatgttgatctcttgagtgtgtagttaatgacagatgtctacaaacaccattaggatggactagcagccttgtttgtaaaagtttattggagggagttgatttcacataattagccaataatggaaaacaatgttgtttttaccgtctgagaagcctgtcaacaattgacttgttaaaaaactagaaatgtgattgtaaattgaagaatgcagaaagcttacctagaaagctgtttcacaaatcccccaagtggagagtctaaatttgtgtttgatggtaatggaatagctaatgtgttacacagcttaatgttaaacatacccatggctgattctatgcaaaagtatacataaataggctgtgttagtatcattacctcaagtgcattcatcatttctatctatagtgtaatactgaatcaggtgttgctgagctgaaggtcacgggttatgcatagctattgaaatactttatttttgagacagctgaattactccctgacctgacgttagtgagtgggcagatcatcttcatctttatgccttcctgtcctttctaaaaatagcagggcctttgacaaggatatattttaagcagctcatattcacttgtctcatcaggagaagcttattttggccacttgcatgcgtcaggtttgcatgtgtgcatagttagacttttggaatagcagtccatgcttctccacaccactcatataagaaacttgcaaacataaagacactgagattgctagctgagagtattggctacaagtcagtgggtacacaaaaatgaagggaagacactttttaggaatgtgactatgcttccgaaatcatccatttcggacatttgtacatcagttctcagcttctcggatctgttttcataaaacctggctgtgatttcgctccagagacctccgtgatcttgccgcttttaataaatatttataggaggcactgccagcctgtggataagggaaactgatgagaaactgccatccgaaatctgaacggcaaaaacaaaaccaagcaaaaccaaaaaatctaaaacaaaaccaaaaaagaacaactcaaacaatccgtgttcacaagaagacgcgtagaaaaagaccaccatgtaactttgatttgataactggatttatcagtcacttgactggcatgcagtgggtactttgcatttttctaccgtactttgaaacacaagtgcaaatttatgttattctgcacaactgggaccaaaaaattatgagtgtgagaaaacacaaactctaaaagcaagatggaatgtaagcaggtaaaccctgttccacagtcatgtcattctggtacagatgtacgtggtactcgtgtttgcacctctaagaaatttccattttttcacatcaaaaaatccagatatgaagctgaagcggctttcttcgccaacctgaagctgtctgatttcaacatcattgatacccttggagttggaggtttcggacgagtagaactggtaggtgattgttctttaaatgcttttgatcgcctctgcttcctttttaattttttcccctagattaagatttctttcttttctcttgttttgtctttcatcattaattaccatgattcctaaatcagttccaaatactttgcggcagacatgtcataattagacacaaagtgggctaaattatgcagtcaacgactaaaaataaaataacaccttgctttttagaaaacctcttcatattaagtgtaaggtaaacacatttacttaaagaagagtcattaagaacttcttacccaactaattttctataatctttatttccttagttctgagtggtgcttactaacaattatgcaccctaacaacaattacaataatttaaatgtaaatataaatacatataaagggaaatcgaagagatatatatgaagtaaatggtgttgtagtagcaattctgtgattctgtagttgcaagtacctatttctagtcctaacagtttgaatattttatatagtttatttcacacacactgtctgtatacatatgtatacacatatacatacatctatatattcatgaagatgatgatgacactttgtacaagttcatacattaaatacattgcatgaatgtggtgtaaacaatatgaaaacgtactctactttgcatttatttgaaatataaattttaaaactgacatagtgtcacaagaattagaaaaaaatgtactcttatgactaactgcatttcaagacggtgtggctataaaccctaattgagaatgcagattgatttccacctctctgctgaacatagaggagttcctgatatcagacaccagtacagtatgtgaggaactccctgagactgtgtacagtgcagtaaacagttaccgttgccatcaggggtcaggagaaatccccttccttaaaagtacattgacccagtactatttttatatttgtctatttgtattgcagttggaatttctgacttgaacaggtagaaagatgttatttacttaaatattagatgagaaggttttagagccatatgcctcactgaattggtattatgcttcccttaacactggttggagatactgtagtaatatcacctgtgacttgaaagtccatagtgtgcctttgacaatatgagtattttcagttctgggagaaaaaaaaaaaaaagtaaggttctagacaaacctcttgcttttctgaaccctaccaattaatgtagccatggatttattttttaagaactttggttttgtggcaaatcataattgtctgtatagctaataaagattcattaacagcattatacatgaactgctttgatttggaggtgttgggacatacaggcaggaaagaggacagagctccctgccatacaggatttattttctggtgtgtttatatagttgcgtatttctaaaacagtctccaaatgaagcagtataagggacagaatttctcagagagtgattgtaggactgttataggtccttaaatattattttttaaagacgaaggacaataaaactactatttttgttgacaaaaaaaaaatcagtgttacaactttgtgaactcttagaagtttgataacttaaatggtgatctttgaagttaccagtgagatattacatgaaatataggaatttacttaagatttttgaaatactgaaaataacttacaggcactgaaatcatttcaagctagagaactgaataccaagctgatagtgcaaatcttctagaagatcctctgaaaagcaaatgaggaggtacaaacaaaattttgattagcctcaaaattgggaagaatttaatgtgggcatataaaagttagtttaaaaacaaaaatttgcatgtgtgctctcgtgtgtgtgcacacatgtgtatgctcatttctgtgtattcatgtgcatgtttgagtatatatatcatatatatacatatatatgtacatataatctccatccccagagaaataccagatagcctaattttcctctcatggatattatattttactcttttagacagatgtttatatataatgaacaccatagtcctaagaattaattgagattggaactatagcccactttgcaaaaactgtagatattactgctgagtgataaattcaaaatggatcattgggtacaacttctacatcgggacggagtgcacgtccttaaccttttacggccacatcagcttttgttgtcttgtacatccacaacacactgtagacaatcagaatgcctatattgtcttcagtattcaatgtggaccagccacttaagtgatcactaataccttattttcccaattcttgccacttactaattgcctgataatattacttttggggtattaaaatattatctgtgattgttcatcttttacatacattcaatgatgctggaattgggagtttggcctcatcactttgcccataattgtacataacattgtcacggaatataatcaatcaccataagggtaacagtgtaccatcagagttaggagtaagatgtaggcagagaccagttcttttgtgattacagaagttttactctcctctgagaatgacgcatgcaagataatcttgtcaatattataaagtgctattgaagcaatatctaagcaataaatcttcatataagctaatttcatatttatgtacacagtgctcaacatgttaatacaaagtatataatacttagtgtcttagtttagcagtaatgttgagcaggtaaatgacatttcaagataataccataagttacactttaattttaaaatagtattttaaaaaatttcccagaaataagattataaaattataaaccctccagtggagtataaagaatttagaaatttgaatttttgaacttcatttcctgttagagtgaagttaagaatgtagttttctcatcactgtttgacatacagattgtgtttgtgtgtgaaggtagttacacccttcacagactttttagcatttcttaatttttatcattcatgtcaatttagataaatgtagatgcagaagtatttttctacaggagaatttataaatagtttattatcaatttttggacgtgagtacataattttgccacataataagaaacttaaatgtgttcagtaaagagtccagaagcttaaagtgaagatcttttaggcataggaattgtagtcttaagctattcagtctcttcctaaatactctcagcataactgacattcacttgtttaatatcagacagtatcctgttcacaaccatttcctctgggcagtcatttggactgctttcctttctgttttctggcatgtgccatattttctgcctatgttctttatttttaagaatggtctttctaatgtgttcagttactgtctgtttacagtatgtcttccaggagaacacattccatttatagtatcactttcagcaaaagaactcagctctctttttatatatgacttattaattaaagctctaagcactgctgtaagtcatctaggtaatcgtcttcatttacaaagtataactgtaaaataaggaggttgttttacaaattacaagtgaaaattagtcccattgccttatagtcatattcccaatttactctacttttgtccctgcgagaaaggcacctgcttttcagaatagatttgtatgactcaaagacaaactgattttttaatatgccaataatatgtagtcggtgctttaaatattagatatttaatctgtttatttagcaatccacatatctcctataccagagcggcaaacttggataaagcacaggaacaaatataagataaacataacctctgtctttttggattatattctttctgcatcagttattatgtatatatgtagtgagctctatgattgaagataaaaaatttaataaatagaatagttcttagctctagagactcacagtctactgggaggggcaatcatgtaaactaataaactcataagcaaagcatgatcagcaggggttcagtgtgtggaggaacaagacgtcttgcaggagatagcatttctgaggcagagggagagttaaggcatcaacataagtaacctgatgcattatggaacatacttagtaaaatgaaactattgaagaaacaaatgtttattaataaatattatttctttaataaaataacctttcatttgaaccctactttataatcttcaaattactttcatgttcattgtataattttgcccttatagctactctgtgaggagaacatgagacatgatccacattttacaggaaagaagacaagaataatgtatttatgtggtttaaggccacttagtcattgaaagagctgttgttattgcccagaattactgattttttaactagaagctttttctgccattctgggttttaaaaatatttggattcttaccaccaccatcaacaaccacccccaaatcaaacaagtgttacttcattgttatatgtacacctttgctttaaaaaaattcttctggaattcaagaacctgaattagaactaaatctagaatagatgtagtaattgtctgctgtgtgcctctctttttgttatatcctcagaggctcccctttctctaaatccttttctgctcctagtttaatggcaaaatacctgcagagaaaaaaaatccgacagtgtaacatggtagctagaagctagagctctagaattaggctttctggattcagatattacccattgtgtatgcttagtcatttacttaaaactttctgagccttgcttttcttgtctctgaaatgatgataataataggatatgtacctcacaaggttgtgaagattaaacgagttaaagccctcaaaatagtgtctcacacatcataggtcagtaaatggtgttaatgttgttattgttgctattattattaaagcatgctaatgatagttctttttatttatcacttccagctataagcatagaaaaggaagggaatgaaagtattttactcttttcttttccattgctaggccaaggcctgagagtgcaaccattattccaatataagtaagagccagaggtcttcaaatgaccttcagtgataacctctattaaatttctccagaccactaagctcttaactttctgatctgtcatgagaggagatgggaaacaattttcaatatcccttatgctgaacctgtgtgcccctgaagtagcctgcttttattcatccatttcacttctaaattgtgaagccccacctcttaacctctcaatgggaaatcattttcagtgcaaactgctgaatcatacctagttcctctccagccttcttaacccatggcacctcagttgggcataataaagacctggctcttggcaagttgaatacaaaagttacctctcattccttctctgctgcagttcagtttctaaaccacataactggattgcccaggaaaagaaaatgtggtagtcgcgagaaccaatttatgctaagacaaggaggtgtatttcacagggtgtgtctgttcatgacatccataccactctcacagcatttttgccagctgccttggcactataaaaacaagcaagcaggcttggagtgctatgtaaaccaattgaaaaaaaaatagaaactaagaggtgattaagcaagaagttaggtgataaacccattgctcagtcagcagggtcttattgcgaaaggtgagcaacttaactccaaagggaaaccccatgtaagatgaaaacatttcaagagcttcctactgccaagccgcacagcaatgaaacagaatagctatggagatctttgggcagtattgccatgtgtacccacggtgatttatgctacatcggacacctggggaaaccctgctgccctaaggccttgcatcctctgtgactaaagtgagtaaggactcaatactggttgaaactgaaagtttgcttcattttaacacagcctcttctttagtagtactctgtggtttattattaaatatgtaattctcatgttatgtttattcttcaaaagaataaaaacggacaaaaattattaactctaataaatagcactcatttctcagaaaataagttcttcagagaactaatgaaaatcccatctaataaacactaattgagcatcagtaggtgtagtaacaatatactgcaactgctaaaataaccacatgacagtttcaatgcagaaattacaagtagtaaagcttatctctactttggtatatgcaaataaagtaagataagcattacttcatctcattattgtagaataaatttcttttgtacattgataattataataaaatttagattacatgaatgaaaacaaatatgttactttctaacccatcttgtgaaattacagaaattttatatattagcaatcaattgaaatgcctattttttcttacaagtagttgaagttagtatcctaccacaagataaaatgttaatagtttctcctctaaacctgcatatgattttagaataatcactataaatctagaatgcactgggcatgtctttccaaagcttaaaataattggtgataaaacagctcttacaaaagttgacatttaggtcatacttgccttttttgttttctatgacataaatattatttctttaatccaagaaatattatttctttaataaaataacctttcatttgaaccctactttataatcttcaaattactttcatgttcattgtataattttgcccttatagctactctgtgaggagaacatgagacatgatccacattttacaggaaagaagacaagaataatgtatatatgtggtttaaggccacttagtcattgaaagagctgttgttattgcccagaattactgattttttaactagaagcttaataatgggtacatcatattaggcaaaaatcatctgttttaaaacatccaaaatatttgtgggatataaaaatatctgacatgattcctgccctcaaggaatttctgccccctcctaagaaagaagataagattaacatattggaaaagtagcaaacaaaatattatgctattgtgttaaattaaaaattatgcagaaatgttcttagtatttcatcaggagagaggtcatttgaaattgatggaatagaagaaggcctgggaagatatacagaactgaagccaggcagtggagaataggttgggatttaaatgaacagatggggaaaggccattctgagaaaaggccattccaggcaagggttacaacataaaaggccacatgttgtcacaggacaccaaagcaagtgaccagactagagtgaattactgtgggaggagcagagagaaatattagatagctgatcagtagagtatgattgtttatattctttaaaaagattagacttgccaaaaaaaaaaaaagagttgtttggacattaagtaatgaaagcacataaacacagactctgctctgaacttctatctatgacatgaaagaatgcactataaggtgactagacaagctatttttaggtggcgctgctcccagaaatagacatcataatttctcttctgacaaaagtaggttattttgtaccacagtgcagtctgcattcctgaaaatttcatgtaaacactttcaaagagggattccttccatgagagggaaaaatagtccctttgtatgtcttaattatgtagaaaatagtcatgtctttttaaataaaatgaaataatttatcttgctttctggaaaaaatatgaaacaggtaattctgtatgtttcaatatatctcatcaattgcatatatttaatttattgctaattagtacttggtccctcagtattccccattgtcattgacatatacaacatattagcttgaacattgagctatgaggtcaggagcttttgtgggccaggtagtttgttcttagtctctagctccagcccactgcctttcacgttcacactgagagtggggagatcatcactacccaaaagaagttcaaataaataagttaaacaaaggagagccactgtctcgtcatcactatgaccttggatgccacatctgcacaaacaaagcaatttaaatttttaatgtgactgttttccctgaagtaaactggcataggcaaaatccagtaaattcttattgaacttacttagctacagttgatgtcctcttatatttgtgaaaatctgaaacacaagataaatgtgaaatacaagaatcgtatgggggaagaagttatctttttctttttcttttttccttaatttacttttatctgaaaatgtctttattttgccttatcattgaaagaggcattgaatctttcaatggttggcaggttctcctctacatccttccaaccccatcctccccaccctcattcccattcccccagccctgtctcccagcactttttcagtattttaaaaaatattttaaattgtaatagctttagggggtacaaatggttttcggctacatggatgaattgtatcgttagcctttttgtaacatcagaaggacaaagtttgaggatagcatgtaataagacattaagatctgattataagccattttattaaagttttccagtatgtaacagtttaaaaaattataaagtcattcatccctatatttcaaaagtataactgcaatgcaaaacctttcatgagttaattgggccacatgtcagaaagagagttgaatttcacagtatgtgatcctctgtttcatttcaactcattttagattttcagagtcaataaatgaaaggaattgaaatataaatattcaacttcacctacgtggttatatgtgtgctttaagtattagaataaattgaatctatgtgagctattcatgtgctcaatttaaaatatgtaaacaagttttcaaaactgatacacatagtatttccttatacaagggagattatgcatagaaattaaagtattgggtagaggatgaaaaatatttgattagttggtgaaaaaaataaagtgtattataggtaataaaattctgtaaataccatttttaataatcactgcaaaatgaagtaaagtttatttagcataaaagcagtaggaaataaatgttatgtttaaggaatgagaagacactcaaagtaggtagccttttgaatgaaaatgaatgaataaactaattccttaataagggaaattataaatgttctttgatttgcaagtaacttctagaaaattgtccaaccctttgttcacagtataattaaaaataagaaattataaatattctttgatttgcaagtaacttctagaaaattgtccaaccctttgttcacagtataattaaaaataagaaagtattaggttctttttctgactttcctccaaactgaaagttaaatgtctctaaaaaatagaaaaaaaaaaccttatctcctcttcaaaaatacctttgtcttttgataaatttaaacttaataagatagatatttcctgatatttctggccaccagctgtagaactgattttaagtctgaaggtaagttacaaagcaaataagattactgatattttgatgaagggttaaggtaaacgaagaaagaaaaacaaggatgagaagaagagagaccctctcttgattatctttccattgtgcaaatggcagatggattcaaatgaaaaggcatatatatataataagctacttttctatcctcctttcttttcaaaatgttatacctgactctgtgtgtgtgtgagtgtgtgtgtgtgtaggtgttgggggggcctgtctatgaataggaactttgatgcataaagcctttaccatgaagttgagtcaccactacagcagtgctgtgcctctgtgcctcattcaaacatgtgtcactcaggctgtgacgagttccttttattcttctctcttgtgtatcctatgaaacaaggcaaatgctatggttcattcttaaatttcagacattggccaaggagaaaaataaatcatatgatgttattgtgcagagaaaagtgaaggaagtagagaagttattgtgatctctggttaagttaataatagaattagtattttttgttattgttgttgttaagaaatgtatataatccaacattgatgtgaatccaacactgatttgtaggatagaagctttctgttcacttaaagcatttcatttccttttaagaatgtagtaagctggcttctcctgaacaagtgggcactttagttggccatgtccaaaaagttatttgagttggagtaataaaattgctttttctttcgccatgaaagtaaaacttccttaaatttaaacaggtagatttgtcctagtcctgtattcattcagttgattgggactactaacttaaaaacagatttaattatcagttgtaatagtaaaatatcatatcttggaaatcatagtagtaatgatcattcttatataacacttcttaatttataaataattttcacatacactatctgattttaacttacaatatctgtttctataatatgaagctggttttttttgtttgtttgttctttgtttttgagatagagtcttgctctgttgcccaggctggagtacagtggtacaatcttggctcactgcaacctctgcctcctgagttcaagcaattctcctgcctcagcctcctgagtagctggattacaggtgcccactgccatgcctggctaatttttatatttttggtagagatgaagtttcaccatgttggccaggctggtcttgaactcctgacctcaaatgatctgcccatctcggcctcccaaagtgctgggattacaggcatgagccaccgcacttggtctggttttattctcataagtaaggaaaataaggctttaggatgtcatatggacttgcatacaaccacagttggtttattattacaatattttaaccttccaatccccagcatccatgggggattggttctaggacctgtcctcaccaatacctcttcctgctgtggatatcaaaatttacagatgcttaagtccctaatataatatggcatagtatttgcatatacacacattctctcctatattttaaatcatctctagtttatttacagtacctaatacaatgcaaatgttatgtaagtagctgttatactgtattgtttagggaataatgacaagaaaaatgtctatatatgttcacctcaaacacaaccatccatttttgttttccgagtattttcaatccttggttgtttgaatgtggatgcagaacctacagatgcagaaagctgactgtacctattattttgacaagataagttttaaagaactttgtgttaattatgtacattttgtttaaatttattcatgatcctaattttttaaaaaataagacttttaaatttaggtttttcaataaacaagtagtaaagtcattaaaaatgactttttaaaaatgtgtcaatatttaacagaaattagagtttaaaaatctagtttgtggctaactggggaacttttattgtaagtgagatagtaagcacagagaaatacatttttgacattaaattctttaaaatgtaaatgaaacatgtagctacctgacaaatcaatacagaactagaagttgtagattcaaggaattacaagttctctctctttttaaaaattctttaacaacttcattgaggtataatttacataccataaaactttcccattttaagggtataattcagtgatttttagaattgtatgaccatcatataacccagctttagaacattcctaccactgcaataagaacccttgtgcccatttagaaatactctccattccaatctccaggattttttttttttttttgagacagggtcttgctctgtcacccaggccggagtgcagtggcatgatcttggctcactgcagcttgagcttagaggctcaagcaatctcccacctcatcctcccaagtagctgggactagaggcatccaccaccatgcccgactaatttttgtattttttgtagagacatggccatgttgcccatggctggtctccaacttgtgagctcaagtgatgggctcacctcagcctcccaaagtgctggcattacaggtgtaaaccaccatacctggcctgtcatctactttctatctctcaagatttaccttttctggtacagatattcaaatgctaaaattttgtgttacactaaatatttttattttctacatgtatgatctagttcaataatctaaatacccagttatttaatgtatagtaacttcatgtcttttttcctgttgaattttagggcagttttatggcttctgtataccctgcttcagctttgttattatactccactgctgcagaacaggatgtctacattgctttctgaacgtagaatctaaggccagtgtcctacagggctgtgaagagctttctggcaacgggaatattgggaaatgatggaggtggaacatagtgcttatgcatttatagggagtctagtggtttgtttactgatgttcttattgttgatgttttattataggcctttggctgattttggtgaacctgccctttggcccggttaatctaataggataagatactcacagtctctcaatgtagggctttctctctccttccccctcccctccagctttttttttcttcttttcttcctttgcagaacatttcactacagcacttgtcttaaattccttaagttatcacaatttatattaaacgtgggttacttaaacgtaaaatcatataccttgccaaattatttctggattacttacaaagactttttctcccaggttaaagagagccaaaactaaaaaatggctttatgcttcaccaaataatatagatttcctgagtaaaattttgtgctattttatttagagaaaatatttgccattcctattttgcagctattacaattacggtgactctgcctggattcccttatgccttgaagcctgttttaatgctcttcctgagaaagctactgctacttttttccagtgtgtgttctttgaaagttagcaacacagagaatataacagaaaccaatcccttcatatgttggggttgagagggcagaaaataaaacccccacccccgaagagaatatgaacataaatgtaaagtcaaggtcatactttcagagaggaccatcatgtttccttaagcgacctttgtgttacttggagtatttccccttttccttcttcccaagatattgccacatgttttttgggccgtttctataaggttaaatataattaacatgctttaaaaatgcatattacgtcaaattgcagatgtatagaattctctagctggaatgagtttttaaagataatatagttttgccctttattttctgaaaagtggtctgaggcccagtgagattatatgacttattagtgaaagatccagaattaggtcccaggtttatgttttccttaactcccttcatcaccgttgttctgtagcatcagtttacctaaggtagagcatgaagggagtacccttctcctgctgtgcatggaaatgtaatttgaaccacttcatatgggacttttgcataataatgagtcatgtgacattgacagtttaagccttgaatttaagaaatcatttcaattacagtgtagttcaggaagtaattttcttccaaaataattaagatattgacagtgcaaaataagctacgagctcttaataacaaggttaaatgaatgaatagatacaaattctaaggatcaactcacagccagtggtactgagccagttttaaccttgccttgatcataatcttccttcccaataaaggcaaaaaattgggtccagtaggaaacaagcctttttaaggcaaccagataccctaggtagaaaggaagcatgtactgtatttaaatacaaccagcaaatgcatcttcagagctctttaaaatgctgatgacatcacctctcattttcaggccagtattatgcagacatcagctatagccagatagttaagaacttgtcaaaatccttgtcaaaaattcccaccttaagatctacttggcccaagtatacattcattcaaatgtcaatataatacttcattttgaagtaacaatgtactgtaaatgaaacatttaccgattctaatttctaatatagcacatagcatttcttatataaaataaaatgaagatcttgagtattgaaattttcttgttcattttccctttttaggaattttgagagtaaaaccagtgtggtataagcatccataatctttgttttttgagaacagttatataattacagaaaaatgtgaagatagtacagaaaattcctatatacgctgaacccaattacccctattattgacaacttacgttagtatggtacatttagttaatgaaccaatattaatgctttattattattattattattattattgtaaacttttttttaagttctggagtacatgtgcaggatgtgcatgtttgttacataggtaaacatgtaccatgatggtttgctgcacctatcaacccatcgcctggtattaagtcagcatgcattagttatttctcctgatgctctctgccaacacccccagctctcccccgacagaccccagtgtgtgttgttcctccccctgtgtccatgtgctcacattattcagctcccacttataagtgagaacatgcgctgtttggttttctgttcctgcgttagtttgctgaggataatggcctccagctccatccatgtccctgcaaaagcacatgatctcattcctttttatagcatccacaatattatagaagtagcttctcaaatccttactcatctacttgttagcactgaggtgggttgcagtcggaacaaagaaaacactttgtttgatacataacacttttatttagttttcacaggtaatctgtcaggatatccccatatgatagatgaggaaatgaaagcagagagagtttgagtaatttgtccaagagaacaagcaaaaaaacaaaaaaaaaggttgagattgaaaaaaaattagtcaaatgtcacactagtcacactctcaaccagtgcattagcctgtacacctaggagattaggacagtcttcaaaggaagacaaatctgaggaacatgcataactatctaggctagtccttggcaagaggcagaagaaaaatatgcactcctgttctccttttttgctggctgatctctttctctactcgaaagtaatttcatagctctaaccaacttgctaaaaaatcatcatcatcatcatcatcatcatcatcatcttaaatggacacaagtggactttgtataattaatttagacaacaggaaaaataaaaagcaaactaaatgtcaccttacaattcatcatggattaggtttgttaaaatatttttataataaaacctagtatcttaggctcaacaaatacaaattgctataactgactcagagtttactttaaaaaaaatttttgtggccagccctgtaagaaggtaatagtgtggttcagccccagacctcaataggttgttatgctctgtacaatttctcaatatctttgcattcatggaattctagttgaatcagaatcaattagaaagattcagacaataataataaatagctattacaatttaaaagagacttgcaagttttttcatgatgagagttttacttttactcattgtaaaagcaaggtatgaggattgttcaaaagttaagcaattcaaaaagtaaaaagaagtaaaaatcaactaaaaatctccctaaggaaaaatcattgttaacgtattgatgaacacatttctgattgtctcttcatacatttatttcacatatagatgtgtgtgtatatatatacatatgaatgtatatatacacactaacatacgaacacactgtgagatcataaaatgcatgctgacttgtaatcagtatcttttattcatatatatgtcttggttatttttccgtaatgttaaatataattctaagtcatcatttttacagttgcattgcatggatataccataatttatttttcaagctcctcctcttgctagaaatttagattgtttctaaatttttccattagaaacaatgttgaattgaacattcttgaatgatctttgggaagttgttggtttatcagaagatttctgatgaatatgttacttgggctttatggaaataattaacttcaacattctccactgtctctgttgagttagctcacaccagtggtcctcaggtaccctgactttctggttaagatcctgagttctgtgagtcttgtagcattctggtttaaattggaagtggagattctaagggccctgctctaaggagctcatgagatcttgtatagagtccaaagaaggaagatgattctagacccaaggactggttccatgcaaagtaaaggcaaagcagaaagcctcagtaggttagcagtatagttctataaactttttgtaattaatgctttttaaattggcaactagtaagcctgactcccaagaatttctgttgctttctgtagcttttacctatctcttatgacatctgccacccaccagttctcattatcctctttctaccccacttggcttctccttgcagtattcaagcaatcgggtatctcaaacccctaacacatggaggtccctgggaagtgcctaggaaaatgtcagtgaggctttggctgttctcccaaatcacatgcctagcataagttaagcttaaaggtaatagaaatattgttcagtttatctcacagtccatgagttagtcgattccgttaaactctgatttgcaaagtatcaatcactatgcatttaattggttttgtattcagctgaagggaagcagcatatactggaaatagcttgggccaaaaaaaaacctgaacatgaatccatttctgccacttgatagctctgtgaccttgggaaagataggaatcatttttggaaatcagtttgttcctctgaaaaagcaacatttgatttgccctattcagtagagattgctgggtacaagcagagtccatcaatgaatgcccatttggtggtgcgttttcatttaggatcataataactgtggtatctggtattatcctcagctagaactagggctcagagcagttaagcaactagcccgagagagactagttgcttagactgagagggactaagtggagtcagaattcaagtccagacctgtgactataaaggctgaattctttcctcctaccctgtgtacaagtataaaaaaaaaaaaatctgtgtatctgtgttatcatcactaaagagaatcatttttatagtaggcatttttgaacaactgcacaacagtcctcactagtttaactgggaatgactctgaagagggaatatgactttacttcttcttctctgaattgtagtactctaacatagctcatttttcatgccatcttccctagctttccagatttcttttagaagtgagttttcacatttggtgttttattttgagttactactgaatttatttgtagcacactaatctgtcatctttgagtttcacagccagagtacagggtctttggctgttaaaagcattttcaaatacccatttttccctctacctgtcatactgattcacaattgctggcagctaaccgaggcccatttatttgcagtatcttcatgctccctcctaaggaacttgccacatgaatatcttcgaagattgaactcaatctgtacatgtgtgcaggaacaagacacttaagaccttcgctatccctgctgatgaagcagtaaataattaacgactaaagaggggacagccatacttcagctgaaaagcagaaacagcatgccatgttatttccccaaggttacattactcccaaataatatgggctgtttggtatcatcttgaggattctgctgcttgagagcactagatgataatgtccttacattgcttttaagtaattagctctattacctctcttgtttttgttacaagtcaccttcttgaaatttcttgtaaaaccataaacagcaccctgtctgagtaaggcatgtggaagatccatgcctcctctggagccactgggagccatgagggctgcaagagaggcatggcacattgaaagatattaagcctccaagtcttcccagttattagagagtaaagtttgaggtcaaaggaactaaagccatcatgcttgtttgagaagaaaaacaaacggttttcaaaatctcctgaaaaaatcttgttacaattttttttctctttaaactgtagggagggaaaattctgcaaggttaaaaagaagaaatgaatacagtcagtactgaagaaataacagtctgcagtctcagcagagactagggtccaccactcaagctaaaaattagaaatgttaacaacaggtgctggagaggatgtggagaaataggaacacttttacactgttggtgggactgtaaactagttcaaccattgtggaagacagtgtggcgattcctcacagatctagaactagaaataccatttgacccagccatcccattactgggtatatacctaaaggattataaatcatgctgctataaagacacatgcacacgtatgtttattgcggcactattcacaatagcaaagacttggaaccaacccaagtgtccaacaatgatagactggattaagaaaatgtggcacatatacaccatggaatactatgcagccataaaaaatgatgagttcatgtcctttgcagggacatggatgaagctggaaaccatcattctcagcaaactatcgcaaggaccaaaaaccaaacaccgcatgttctcactcataggtgggaattgaacaatgagaacacatggacacaggaaggggaacatcacacactggggactgttgtggggtggggggagggggaagggaaagcattaggagatatacctaatactaaatgacaagttaatgggtgcagcacaccaacatggcacatgtatacatatgtaacaaacctgcgcgttgtacacacgtaccctagaacttaaagtataataataataaaattttaaaaaaaagataaaaaaaattagaaatgtttgtggattagaactaaggaggaagaatataaaggcccatataaccctatttttggccatctttactgaaataaaattggaaaagaagttttttttctactcttttgacagaagaactataaaatgtattcaaacacactctatgacatgaaataataaaactagaactaagtacattttccctcttctaatccacacgtgaacacaattaatttggaatcaagttagttaaaattcagccaattcagagcatgagattggatgatagctgtgagccctggatgttaaacgcagctctaccaaggatttactgtgttttgacttgggaggtggctgaggttcatttaagtgcgccatgtacctgttaatttggggataataatgcactcttacaagtctatgggctttttcttactctcttctctctttctttaaggtccagttgaaaagtgaagaatccaaaacgtttgcaatgaagattctcaagaaacgtcacattgtggacacaagacagcaggagcacatccgctcagagaagcagatcatgcagggggctcattccgatttcatagtgaggtaaaggctccatgccagggacagacgtacccaactccaagtgacaaatccaccacaaaaccctctgccacttgtgctcactgttaacacatttcgtatgcacaaagaaacttctttttaatctaatcttaagaaagttttgtttgatttctaaaaataaagttctgactctattctttcttttaaagagaattagtgtctgaaaacaatgtgttttcccaaaggaggtaccagagtttctaacattccatttttatctttttttaaatccccaaactctacatagacctttgatgcttaaaagacaaaatatccaaaatcaaactatttaacctttaattatctgaatattttttgaagatctaaaaaaatgaaatgacagctgaccattccacctcagtactaataaatggataatggggagatttttatatgtggaagcagctttttgtagtgaattttccagtggcatttactgaaaacaagatgtaacatgaatttgagcgaatagcatatgaaatttatacatgtctgaatctgtaaagtttaatccactttattcccattttcactgcatgttgatgaccactaaatgttgccccaagggtctatgctcaaaacattacccaaattggaatggaaagaatcccaagaaaccctctttgtccataatcattatgattaatccatttcaagggagagattagcgccttagtttcttctattaaaatcctattcatgagccattggcttcttttccccatgtgtgggcttagatctctctcattctgacaaaattttgagcttggcaaatcaaaactataatctgggccccccaaaattgcacacttgtaaaagacagtaatgtttataatctttgttttcttgtttgcaatttacagactgtacagaacatttaaggacagcaaatatttgtatatgttgatggaagcttgtctaggtggagagctctggaccattctcagggataggtaggagatttaagaaatttctatgatatctctaaaaacagttgcccatgttggtctataagaagagttaatatgataaagtataataatcatatttataatttacacatgcttatatttcaatatttaaagtaagcacagggcataacccactatacacatatgatttactgtacatataacaaaactcactttgtaactaacaatacaggcttagtcgatcataaaaatggtacatagcaaaatatatacatggccttagttttgcatgaatgttagaattagctctgtagctggaattcaattcattgctttagcagaaagagaattatagttattttataattataatttgaattaactatcagtttaattgctctactctttttccagataggcagtttgccttttgtgacattgtgaattttttccaaagtaatttttccctctacctttacatggctctttggtttcaaaattaacaaaagtttccagccatctctttatcccttggctagtcttaggaaaaagaaaagaatccacttataagcaatatttcatgtaaattatctgatttagatttaccttcttacccttccagggcaaggaaagtttgtctacatggtgcttgtttgttctaatcatgcaaattcattgtcttaattttccatctcatatttagataactagcaaattatctaattatcttctaatataatttatcctataaaatgtctcaggagatcattatctaccctgtgtttttttaaaaacacacttttattttcctatgaataatcttttgattattttccatgaatgatttattgatcatacaaaagtcatctttgttcttttgaacactcacatttagacatctgtatttttcttatttgtttgagtcctgcctcccagactctccttcacagggtagcatccttctgaaacttagctataggtagccctgatgtatataaccatgtaatgtttttatatttgttactttgcagataccccagaataaaacaagtggttccttatgaactgttgatttaaattctcattcctaatggtgttcttatggtaccttcatatctttgtacaacaggccctttcgtgttattcccatggcctttcttatatatgccaaatggatttcttgttaccacattgtatcctattgcatcggtattttatttcaattcttaaatttaaggttaaaaaagcataaaagggaatgtaatcatgttggcattaggcgataaggttaacatctatactaagctattatatcatagtgtatatattatgtattattgctagttaatatgtacatagagattatataccaggcattgtgatagaggctggggatccagtaataaacaaaacagatggggtctctctcctcagaatgtatagtttgtggcacaaagttaatattttaatctgtgagttaacatttggcatatctaatgtgtttctactgtattatatttgacttgatatttcaattcactgatttatttgaagtcttctacttttttttctaattagaatagaagaagatttacaggtggaattaaacatgaaagcaataataagccacaaagggagagcccagctatccctcttatagcttattatttttttattttttcataagttattggggtacaggtcatatttggttacgagtaagttctttagtggtgatttgtgagattttggtgtacccatcacgcaagcagtatgtactgcaccatatttgtagtcttctatccctcacccccctccgactcttccccccaaatccccaaagcccattgcatcattcgtatgcctttgtatcctcatagcttagctcccacatatcagtgagaacatgtgatgtttggttttccattcttgaattacttcatttagaataatagtctccaatttcatccagttccctgcaaatgctgttaattcattcctttttatggctgtgtagtattccatcatatatatacatatatatatatacatgccatcatatatatatatatatacacacacacacatgccatcatatatatatatgccctcatatatatatcacagtttctttatccattcattgattgatgggcatttgatttggttccatgattttgcaattgtgaattgtgcttctataaacatgagtatgcaagtatcttttttgaataatgacttcttttcatctgggtcaaatggtaattctacttttagttctttaaggaatctccacactgttttccatagcagctgtactagtttacattccctccagtagtgtagaagtgttccctgttcactccatccacaccaggatctattggttttttgattttttgattatggccattcttgcaggagggaggtggtatcaccttttggttttgatttgcattcccctgaccattagtgaagttgagcattttttcatacgtttattggccatttgtatatcttcttttgagaattgtctattcatgttttagcccacttttcattggattatttgtttttttcttactgatttgttcgagtttgctggagattctggatattagtcctttgtcagatgtatagactgtgaagactttctcccactctgtgggttgtctgtttactctgttgactgttcctttcgccatgcaaaagctcatcagttaaactaggtcccagctatttatctttgttttcattgcatttgcttttgggttcttggtcatgaaatctttgcctaagccaatgtctagaagggtttttccaatgctatcttctagaattttagtagtttcagatcttaggtttaagtccttaatccatcttgtgttgatttttgtacaaggtgagagatgaggatccagtttcattttcctacctgtggctagccaattattccagcagcatttgttgaaagagtgtcctttccccattttatgtttttgtttgctttgtcaaagatcagttggctgtaagtatttgggttcatttctgggttctctattctgttccattggtctatgttcctatttttgtaccagtgctatgctgttttggtgactatggtcttatagtatggtttgaaatcagttagtgtgatgtctccagatttgttctttttgcttaatcttgctttggctatgtgggctcttttatgatcccatatgaattttagaattttttttctaattctgtgaagaatgatggtggtattttgatagggattgcattgaatttggattgctttgacagtatagtcattttcacaatattgattctacccacacatgagcatgggatgtttgtgtcatttgtgtcatctatgacttctttcagcagtgttttgtagtttttctggtagaggtctttcaacttcttggttaggtattttccgaagtttttggttttttgtttgtttgtttgcagctattgtaaaaggggttgagttcttgatttgattctccacttggtcaccattggtgtatagaagagctactgattcttgtacattaatcttgtatccagaaactttgctgaattctgttatcagttctaggagcttcctggaagagtccttagggtttgccaggaaaacggttatatcgtcagcaaacagtgacagtttgacttcccctttaccgatttggatgccctttatttctttctcttctctgattgctctggctaggacttccagtactgcgttgaagaggagtggtgagagtgggcatccttattttgttccagttctcagagggaatgctttcaacttttctccattcagtattatgttggctgtgcctccctcaatttacaattggcaataaatctgcacagattgcaacatacttcaggttcatacactcactgattgttgttactcgtcaatgaaaaaggtgaaatattttgatgagagatgcttagctcctgttacattctgatatccaagaactcagtttatgacaagttgactaaacattgtgattaaattttaatttgagtctatcaatattcataaataaccttctatttctctcaaattgtcatctaactgccatctagcttaaaacaaccacccatccccaaagagggcataagggccttatctctcactggttttaattgaaatgacacagctgtcaaggcataattcattatttcaaagagctatataaggcaagtgatttatttctttaagtaactatctaaactattgatgaaacagggtttcttttgttttaaatcaaatttacattgtcatttccaattctaatagtaatttttcattgtgagtcacctcagtgttatgctttgtgactgctttcaagatgtctattttaaaatccacaagttatctacatcacatgtttagtgatgggacagtgtggtgctggtaaacatttgtgtgcatgcattgtatagatttatcaaagtttgagacaaggttttcatttaattttcaaaatcggttacaaatatatttatatgtgaaagatactcaatatagatgtgttgaaggaatggaaactagatttctaaaaccctccacattccaaaatgactcaaaaccagagaaaactggaaacaaatagagttgtcaagaactgaggaccctaagatgtacaatttgtggtctgtttgcttcgtggtgaaaaagggagagctttgattggcaggcaataaaagggtaattttggcccatgtgagaagcatggggaaagtgaaaagaacagagattagcaaaggattcttcagagttgatttgtggcagttagccttggcagtcagaagcacttaaataacagagaggattggtgttccaaacccccaacctccaccctgaaaatacttcatccctattctatactatgttagttaattttactatattaagacatagtagctaaaaaatagttttctggtgctcaatcatagtggctactattacatttagtgagcacaagttgtgtaccaggcacttattttcagtacatgcattattaattctttggatcttcacaacaacccagtgagatagttactgttattagccccattttgcacatgagaacacagaaacacagagacatatagttaattgctcaagaacaaacagtaaatggagtctggagttgagcccaggattcttgcttcagggtccatattctaacatatagcctcctcccatgaatttgagtttgtattagcatttttccatctttctgctaatgaccagcttattcagaatataagtataatattctgcagacatttcatgagaaattgatctctcacctaagcatttactctcattacaacattaacaatgcatttgtccatttgattccattaccaattgactattaaggaagcagaggtatgttgcccagagtcacaactgtagaaataatctcctcttctactaacagtaatcaagcatttgtaagctttcaaaaaggcccactcaaatcacaattagacagtcctgatgtaaatgagtaaacaggcaacctacagaatgggagaaaatttttgcaatctatccatctgacaaagggctaatatccagaatctacaaggaacttaagcaaatttacaagaaaaaaaacagacaaccctatcaaaaagtgggcaaaggatatgaacagacacttctcaaaagaagacatttatgcagccaacagacacatgaaaaaatgctcatcatcactggtcattagagaaatgcaaatcaaaaccataattagataccatctcatgccagttagaatgacgatcattaaaagtcaggaaacaacagatgctggagaggatgtggagaaataggaatgcttttacactgttggtggaagtgtacattaattcaaccattgtggacagtatgacaattcctcaaggatctagaaccagaattatcatttgacccagcaatcccattactgggtatatacccaaagattataaatcattctacttaaagacacatgcacatgtatgtttattgcagcactattcacaatagcaaagacttggacccaacccaaatgcccacaatgacagacaggataaagaaaatgtggcacatatacaccatggaatactatgcagccataaaaaagaatgagtttggctgggcatggtggctcacgcctgtaatcctagcactttgggaggccaaggcaggtggatcatgaggtcaggaggtcgaacccccatctctactaaacttaaaaaaattacatgggcatggtggtgcgtgcctgtagtcccagctactcgggaggctgaggcaggaggatcacttgaacccaggaggctgaggttgcagtgaaccgagattgcaccactgcactccagcctgggtgacagagtgagactccatctcaaaaaaaaaaaaaaaagaacaagatatatagtttgaaataaaataagaccattccctttactctttcattttgttttgttttgctttgcaatgctctccattgagaagggatttaattcatagatagcagtgtagctaaagctatatattaattatatatacacagatgcttactctttaaggtaaataatctcttcaaatgaaagaaacatgctactcttgacaggtaaacatacttaattaagggcgaagaagaaaggaccttcaaggcaatactgtaatccctttggaactacatacaattataaaattttaactctgccaaagatatctccaagtcagaggaaaattgtagcatgaagtatatcatttgtttcctcatatggatgcagttctcaaactttctcttgtgctcataaattcacaattgttccattcagatattattcaagggagattcaggagtcatggtaattatagttaagattctagaatctagaggaatagatatcattatgcctataattaattatgtttcagaagaatgatatttttcttaggaaaagctggttatttcagtgaaaactcaagtgatattagtagctgaaatgaagacattctctttctggaagacactacctatttctgaaagcctgaaaagtggctgctttagccttgattcacttatgaattttgtaaaaatgtaaccatattccactgcccagtttgttaaactttactccacaattttgaaaaaaaaataagtgtcaccaaaatgcaaacaggcatcagagactcatgaaagcaagctctgaagctatcatttgttgtacactgtctattaataaaatcacttgtgtgcttgtcactcatgttatatctcaaccacctcaggcgctgatgttcacactaatatttttgaattatgaaatgaaattattaaattgtgcttactactcgggaaagaaaaaaaaagtacatggtttatctctttaagaagtaccatgaaaaaaaaaaagaaaaatagttaaagttaagacgttctgccctagaacaaagggtttaaccttagatgccaaggttttttctaaattatttcattcaatcaatcaatcaacatatatatgcccatatatcatatatatgagacagagagagccttcttgctaaacataataatcaagattactaataaacattcccttctagttacttttttctttgtaattgtcttttagtccatcttttccccttaataagaattcagtagtataggaaatagatattgtttgttttggatgcagaagtttcaaaaacagaagagtacttagcttgcattatgattgcatcagtagcattataacttatttccggagtggttctttgaaaacagttgcttttattcagactctcatgaaccatatctgcattatttagaaagattaaaaaacaagccctctaagaataaatatgaataaacccataaacttctcctttaaaaaacaaatgcttggtaggcaagctctaaaataggattatttttctctcctgcctacttctgtaagtctgtgcctttttcgattgtagtgggctgttgagaggaagacactaagtacatgaaatgtgttgtgttgaactattctttcagccctttcagtaagtgagatttaactattccattcataaagacagagaattccttaacttgatccttgaatgcttcagaaaacccaatgtaatggcaatcatgtaacatttagctagcaggacagtgatctctgggttaaattttggcaaaggaatatagtgaaatgagaaaaaaaaaataaagccatattacagaaattaattttttatacaattttcattccatttctgcacctcagaggttcgtttgaagattctacaaccagattttacacagcatgtgtggtagaagcttttgcctatctgcattccaaaggaatcatttacagggacctcaagccagaaaatctcatcctagatcaccgaggttatgccaaactggtcagtgcatttcatacgtgctttctgccctgcagattaaaaatatttgtttataaaactgtgttcatttgctaatatgaaatctgagttttccttttcaatgttgtaactttcttaaaagcagattttagcattacacttttcaactgaatgttctttcaaatgatgcatcagttatgaaaaattaagttggctaagtttgaattaacaatactctggcaaaagatgcttttataagcatgagaaaacacacttgctggcatgtgtttacatgcccagaagtccttttctccagtcagctttttgccattcataagcaatgggtttttatattatggaaaaccataaatcattttaatattttagatttaagaataatgctaatggaaaaaaatgtgctttacaggcaatgctagccaggttatgtaatagtaataataataatggtcaaaagctgtaaagatttaccatagaagagaagttcttttatttacaaatgcacaacttttgttggatctgttaacagcttgattccatttttaaagttttcagaattgttattcagcatgtggtttttagagaaatcaaatcagtggcagttttttatttgtagtttcaaccaaatcgttttagaaaaaatatattttctgcagtcgacactcttccttcaaaagagttccagaaaaatgaagaatacattataattttatttctgtttatgcttactaagggcagagtcattggtcccaaaactatcttactcacttcctgcaaacataaaatagcttttcaaataattaatactaaatgaattgtcgccttcattaaatccagcagaaatcatgtatattctgggaaagatgttaagtaggcccaactggtcgttaacaatttttaggtacagaagagattctgtgtttacactccaacctccattagcataaaagaagaaaaaatgaaaactatattcggaaaggaagatttacctttatttttaatgatgtgaattttatgctatactcaggtgtcaacttttgccattaaaactgaggtgcatcagggagactgtctttgcaatatagactattctttttggaagacagaactataaaaacatacatgtttttaaattattatcatcatcagtgtgcttcaaaataacttattactttaaaacttaatcataaggagcttaagtatcttgtttttctctctttgtaaggttgattttggctttgcaaagaaaataggatttggaaagaaaacatggactttttgtgggactccagagtatgtagccccagagatcatcctgaacaaaggccatgacatttcagccgactactggtcactgggaatcctaatgtatgaactcctgactggcaggtatggatattgatagggaactgctgataaaaatagaccagcatgcagctacacactcctgcttttgtcacttggattagaccatcttaaagtacttttcaccatatcttggtaccacagtttaattagttatacagatgaccaggaattcataatgtaaggtataaaatagtccaggctagggcaaccacctgaacactaacttttggtctcattattgctacttcttttttacatatgtgaatgtggaaggatataatgtccttctgtgagctatcttagcccagtcatttagccagcaatgaaacaggggagatgataatcatataaaaatatctagggtcaattttctatagaagtaagaggacctgttagcaactgttatatctaaatgaaaggtgactgctttgtacatctttcctgtaatgttattatcatcaactcaaataggcactagggacaccacaaggtataaaacaaactttaagatcctcaaggacccatattaaaagaacaacaaatacactaccatgacatgtgctaaaacagtgagtgacaggggtgttatgacctacagatttcaggacagggatgggttcgtaaagaggcttttgaagaatgaatataaggcagctgtgtcttgaatgaagagtaggacttagatatagagagcaagaaaagggtattccaggcaaataggcatggcttaaagagaaaggcaataatcgtcacagacatggagaaggttcatgtaaaaaaaacaggaacagtcatcttttgacgatcatgattgctgcacttgagtgtttggactccatctacagagggaatcattgagattttctgacaaaggttgagtgatgtgtgttgtggtatttaaggaaaaacaagttggcagtaataagcaaattggaagaggaataggaagctagtttgaagattgttgcagtaatttagttctaggacactgagagcctagagtagggcaagggcaatggaaaaaaagagtaattgtgaggcaggatgtgaagaattacttaagaggacttagtcactacagtgaacatgagaggaagactgaggactttgagcacagggtactctgtgaggattcagtgcatacatgaaacacttagaagagtgtttcgcacatagtaagcattccatgaatgttagcagctgctactactacaacaacgacagtcattgccagaaatagttgtgttttgattttatttttatttatgggtattttacattattacccataaagtttctctattgacttcaaataaattatgtgtgacataatccaattttgttcagtgtggattgttcaattttgatcttgtggatggaggtaaattattttaaaagtatgaccaattaagtagacctgtaaagatatgaaaaatttggacaaagtagaaggttaaatttaacatatgtgtgtggatggatagataggtaaataggcagagagatagataaaaaggtaatctttctagtgtgcttagaattgctataagaaccaattatataataaatagaagaaaactaaatattaactatttttgaggaagtaaaatattcacctataataactagactaaaatattaaacatgacaacttatatttctccttaaatgtttagacatttctctacaatcattgtttattcattaagtaataaggtgaaaatgattaaaaccttaatcttaaaaactggcatatactaaactgtaagaaataattaataacagaaaaacctttaatcctttaaagtagaaattgcacaggttacaatatctgactggaatataataaaacttggaattaataacaaagatttaaaataaaaagtctaaatacttgaaaatttaaaaagcatttttctaaataacctcaaggacatagaaattacagaatagcagagcagcaataaaaataaagcactataagtcacaatttatgttgtattttcaaaaccaaacttaatttttttaccataaatatatatatcgaaacattatgattaaacatacctaaacttaatattcatttcaagaaataacaagacagaaagaattttggtcaaagacaacagcattaaaaaaatctttacttttccttttctacccaaagagatgatggtggtggtaagagacggtggccaggggtgggggtgggagaaggcaagaataaaacaagtaggatgatctttagttacaaataaagttccacaaaacacacctgccaaacactatgaagtatggcatgtgactaggaatgatgcttggaccacaagcatgactccaaagtattttggtcctgaatgtcatatctaatgatcttcgatagtaataatgacatttagaggactggctggaccttgaaaaagcaaagactgttcatgcagagacctaattaagcactacagaatgaaagaggaactgaggtgaaggaagattcatacaaatgtaccaattctgccttttaaggcttataatgttggtcagtgaagcagggagtgaaaagggggagagaggcagtgattaatgatttcagagaatgtggtggggctttgtatgagccacatgacctccctgaatgttttaaattgagggcaaaggaaataaatgatctggttataaggcaacaaacagtagtgaaggctggtgaatttctcattgcttccttccctccaactttccctgttctattcttcatggtaggcggcccaatctaaggataagtaatggtcagaaagggtcccagggaagccagtccctgcccctcttacaaccccagcccccttccatgcatacacaccaactcctttcttactgattttgctcaaggatccatctcccccaccaacttaggaaaagatgaatttatctccagttttaggttttgattcagctcgtctattccagtcacatggcattcctctagtgattggcatttattggactgggtacataaattagaggaataattttaaaatacattattggaggagaattcttttttcctacagtagctactcagtaaataattactgaatgaatataagtccttatttccactggtagacttcctataactatgaggggaaacagccatgatgaaactaatagtgactatggcagaatgaaaagctggaaccactgatcctaccagtctagaatttgccctacctctggaaagtgcttttgtgagttcaatgtttttcttattttaatcagtttgagctgatgttttccatttatgtcagctgaaagatgcaaaagtaaaagaaagctaaagaacacacaagaaaaatgaatcaaggaaatataggaggaagtgtttagataaactcttatctataatttctttgaggctatcaaaagcatgatctccctaaaaagtaacctctaagatatttgcaagtgttcataaatgagaagacaagtaactagcagagctcaggaccattacagaactgaaagtcatgctgtaagtaagagaaaataaaatagtaacaattaaaaatgcagcaagggagatagtagacaggcttggaaaatataatgaaaaaagaaaaaatacatagatatgatttcagaaagagaatctattagtcaaaggaaatagaaaacacatcaattatgtgtatgaatataatattacaaacaggagaaaaaacatctttaattacataataaaaatccatggcataaagaattgactcagtatatccttttgatctgcagtgaccatggagaaactgattcagaataatatcaccacagtatttccatgtggtgaattaatgaattaaattcattaataaggaatagtcttattggcatcaaagccataaaaacacggcatgtgtggtattgggagtgaagacagttaaagttccagctggcctcaaccttctctacagcatctttaatgccaaaagatagtatatcaagaactacgtagttctgagggtcagagaaggtataacccaagtaatttatactgagttaagttcttcttcaaattcaaacacgacatataaagtgtggaccccaggcctttctcaaaaacactactattcaatcaagcccacaaaaagatgaatcaaaataaagcattcaggaatagaaaaactagtaaaaagattgatgagctttgggtctaattaattagaacttagatcaaataatttaaatttgggtaattgaacagaatgtaaatattgtagtctttggcaatcttaaaataacactaaaaccaacaaaaattaaggtgggaggtaaagcaggtataactataggtatacttatttctcatcattaataattagtaatcttacatatattttatagttaaaacatgtcattacagaagagaaatctctaaattcagtttgattttttttttaattttagagaaatattttaggaattaatattggttaagaagcacacatatctgaaatttagcatttctctccattttactcctcagtttagctaaagtaaaattaaatcgaatacttctaaatttaaaaatatgcataatataatcctgtgtgtctacaatctacatatagaagtctatgaaattatgttcatcaaatgtagagcattctgaatattttgaggttttggatgactttcttctaaataattttgttttatatattgaatgaatattagactaacatgcatcacataaaaaccacaaatactatatttaataattgattttagttttctaagataagcaactaaatataaaagcaaaataaatataaaagcaaaactataaattagaaatcattgccaagatgtggctcctcctcattttttaaagtaaaaaatgaaaactggcatgttaagagattaaaaagaatattcaatcatagaatcaactaaagataaaattttaaattctaagagaatactaaatagatttgcatgtttatacatttttcaagtgatttaaaattgataggcaattactagctaatgacatattaaagtaaatagaaagcatttttcacagaaaatcaaagcagaatccatcacagcccttaacaggcaaatctactactccttactttaaattactcattagcctgcttgataaaaaagaaatagtttgaactgctcttaataaacatgaaaggcaaaaaaaataataattcagatttcttccccaaagacacacaaaacctgtattaaagagagtaattaatttccaaagaaatcattcgtcaaggtgtatcatcatctcccctctgaattgtgagaaatttgaaggaaagacctgactttagtcatctttgtactcactgaagctgccacaaaccacacttcaaggatggatcagttaaaaaaaaaaaaaaaaaaaaaaatcaacagatctggctcatgagggctggggtattacatccttgctagcaaagaggatgcctagtgttaaattatctaatgaggtcctctgagcagagagaaaaggataggaggagtactattctatagaaacattagagcaataaatatttattgcctccttagtatgtacatgctgcaaactctactcaactctgggaataccagcagaaaacaaactcttctggaagggaagacagacataaaacaatcacacaaatgaaaagataattacaaagtacaataagtggcataagggtgctataaaagtgtaacagggactctaatttagattaaactttaaactagagcatgaaattagattgctaggttacgtgggttgatataggttatgtaattggttgtaataggttgaccagagtaggccttttggaggaaacagcataacacttatactgaaacttgataaagtgaggcattggccagataagtatgggaagaaccttccagaccaaataagtaacaccatgaggtaggaaagtgctcggcatttcagtggaacagagagaaggctattgtttctggatcccagtgagtgagggtggtaatggcatgaggtggggtagtatcgttggtgttcctgcggcccctcctaatgattttggacttcatctcaagtataatcaatgagtcagtaagtgtggaaaaggtcagagagtagaagaagcatcttgaatgaccaaggacagcatgagggcttagactccagcacttaaaagaaagcaagagaagagcagataaacttgacccatttctggtttcactaagtgatttacttggaagggcttccacactgttttgctattaatctattttcattccattgtcactattaatctaagcccccaaatatgaattgatgtcatctgtggagtttatagcaattcaagtgttctcatgtagaaaataaaagtaatatctcttgtcgtgtctctcattcttgcagcccacctttctcaggcccagatcctatgaaaacctataacatcatattgagggggattgacatgatagaatttccaaagaagattgccaaaaatgctgctaatttaattaaaaaactatgcaggtaagtatttcaaccacattatttttgaaaacatcataatgtgaaaaaattagatttaataaaaccattattttatttttagggacaatccatcagaaagattagggaatttgaaaaatggagtaaaagacattcaaaagcacaagtaagtgttctttctgcagagttctgaacacgtgacatcatttccccagggtgttgctttttaagttattggtgtaaaactagtataattagcctataggaacatccaaagacagcgtataaactagtaaggcttttaaatgcctttctagttgtgattatgaaaccttatttatatttatctgacaaccctgtaacataagaagctgaactcagtttcttacaactcataccaactagcatttttttcccctctggcacaaaggggaaatgtgtattttaaatttggggattctattctctaccacagaattacaaataaaagtcccctactgtatcttacctgatttcctaaagacaaaatatatttttccaagcatttcctaattagatgttataacaggagaaaaacataagtacagaatacagtgttttttaaacaatagcaacatcttaaatatcagaccttccctatgttgattggatgttctaaagctaaactaattgggttttctctatttgtttgtgtaacactgacaggaaattcacatccttatcaaagaaacatgtttactaaaatatctctgaatatctgaaaagcctgctaagaatttgttgtaagcatttgctaatgctgaaacccttcaaagacaaaagaaaacaaacaagcaaaaactttagtcttttttggttcttattttcacagaaaaactgtacacaaaatatctttattcttcattaaaaaagggaaaaaaagaagaaaatgggacatgtagagactatgacaatgatgtgaaaaggttaattagctgacactgtgcactgaatcagtggcaaaaatggaaagttaattttctatcctgacttttcatgccctggttctacctccttaaaataaaatatcctgtaaggcacagggccagacacattatgacatgtattaaattttaattatagtgtaggaacaaggtcatagagacattatgactgaattacaaggaataagtgttgcatgttaattggtgtttaaaatttgacagttatacttttaaaaatatgtatttcataaaataaactattaggaaaacatatgcaattaaatagaaaacatttttgtcacatgaaaatgtttgcctaactgcttcccattagccatggacattgtatacactgcaatgagaagcttttagctgacacaaaatgtttttatcaacgttttttccttttctagatggtttgagggctttaactgggaaggcttaagaaaaggtaccttgacacctcctataataccaagtgtaagtagactttccagcttataattgtgtgacataattgatggtgtttatgtcagtcaacaatgatctgttatttttaaagtttaatcctatgattaagttaaacaaactctaggaaaaatgtcacattaaaataatgacatattctaaaatccaaacttgaaagcagataaatttggggatagtcactgtaaatgtgttttactcttctcttttttaactattcatttgattcaagtttccctcatttatgaacataagttaatttttagcatgggaaatgttcaaaatatagaaatgcagacaaaaatatataggtgagaggatcacttgaggccaggagttcaagagttcaagaccagccagcctggacaacatagtgagactctgtctctacaaaaaaagaaaagaaaatactagccaggtgtgctgatgtgcacctatagtcctaactactcaaaagtctggagcaggaggatcacttgagcccaggaatttgagcttacagtgagctgtgattgtaccactatacttcagcttgggtgacagagtggaaagaccctgtctctaaaaaaagaaataaaataacactttttcaaagagtctttacatgatcactcttttttttttttttttttaattttttttttgagatggagtcttaatctgtcacccaggctggaatgcagtggcgtgatctcggcttactgcaacccctgcatcccaggttcaagcaattctcctgcctcagtctcctgagtagctgggattgtaggcaagtgccaccactcccagctaattttggtatttttagtagagacacagtttcaccatgttggccaggctggtcttgaattcctgacctcaagtgatcctcccacctcggcctcccaagggttgggattacagacgtgagcaccgcgctgggcctacgtgatcactcttttatttttttatttttttatttttttattattattatactttaagttttagggtacatgtgcacaatgtgcaggttagttacatatgtatacatgtgccatgctggtgtgctgcacccattaacttgtcatttagcattaggtgtatctcctaaagctatccctcccccctccccccaccccacaacagtccccagagtgtgatggtccccttcctgtgttcatgtgttctcattgttcagttcccacctatgagtgagaatatgcggtgtttggttttttgttcttgcgatagtttactgagaaatgatttccaatttcatccacgtccctacaaaggacatgaactcatcatttttatggctgcatagtattccatggtgtatacgtgccacattttcttaatccagtctatcattcttggacatttgggttagttccaagtctttgctattgtgaatagtgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggtttaactagtttacagtcccaccaacagtgtaaaagtgttcctatttctccacatcctctccagcacctgttgtttcctgactttttaatgatcgccattctaactggtgtgagatggtatctcattgttgtgttgatttgcatttctctgatggccagtgatccagtgatgatgagtattttttcatgtgttttttggctgcataaatgtcttcttttgagaagtgtcggttcatgtccttggcccactttttgatggggttgtttgttttttttcttgtaaatttgtttgagttcattgtagattctggatattagccctttgtcagatgagtaggttgcgaaaattttctcccattttgtaggttgcctgttcactctgatggtagtttcttttgcagtgcaggagctctttagtttaattagatcccatttgtcaattttggcttttgttgccattgcttttggtgttttagacatgaagtccttgcccatgcctatgtcctgaatggtaatgcctaggtcttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcgtttccccattgcttgtttttctcaggtttgtcaaagatcagatagttgtagatatgcggcgttatttctgagggctctgttctgttccattgatctatatctctgttttggtaccagtaccatgctgttttggttactctagccttgtagtatagatgcagaaaaggcctctgacaaaatttaacaacccttcatgctaaaaactctcaataaattaggtattgatgggacatatctcaaaataataagagctatctatgacaaacccacagccaatatcatactgaatgggcaaaaactggaagcattccctttgaaaactggcacaagacagggatgccctctctcaccactcctattcaacatagtgttggaagttctggtcagggcaattaggcaggagaagtaaataaagggtattcaattaggaaaagaggaagtcaaattgtccctgtttgcagatgacatgattatatatacagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttccaagggatgtgaaggacctcttcaaggagaactacaacccactgctcaatgaaataaaagaggaaacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcctgcatcgccaagtcaatcctgagccaaagaacaaagctggaggcatcacgctacatgatcactcttatactttcatggcatctttgtttccatagctctagccaaagtttattatatagaaagattttagtgattatttgttttaatcatacagtttattactcacaagggtataaactctccaaggataagaaccatgtctgcttgtacttaccactgtgaccctcaatacctgctacatagtagatactcaatgaaatagtcactaatagggaataaatacagaatgcacttaaaaattccagcttggaattccactaaaaaaaatccactaaaaaaaacctgtccattttttacaggttgcatcacccacagacacaagtaattttgacagtttccctgaggacaacgatgaaccaccacctgatgacaactcaggatgggatatagacttctaatgtatttctcttacctgcttctgccttgctgaagacagctttttctgagacacagctgccagcaaacctgagggaaagagagaagattagtgctcggggtcaccatgatgcctttgatcgatgctgctccagtaactacagtggcattaggacttaccgcttagatgacaatagtgctctttacatgttttctgtttgaacctaaaatagcagttgacatggtggtcctgaagcaaagcctttcaccagtaaaagatgttttctattgttgcaatgaccttgctttgctctgattataatttgaaagactgtaggaaacacttcaatgtagtataagagtctgtaccttgctggaatattcaagaagatgaaagaataatatattgggtacaatagattactatggtacagaaactgggctattccctttcttcaagtgaaggctgtgggatctattactgcaggccggtgtatataccatacaaaagaggaccacacatctgttggtcacagagttcatgtcacaccagtgctagaagtttcatgattttatttcccagcagtgctgatgacaagactgaatgttaccttttctttctgacagattttaaaaattgatatgataaaagcacaactgctatagattctgctgagacctctcatagtaggtatatatgagttttcacagaagactgaaaaataatgcatgatatttgtttgttttttttgataaattggcatgacagagtggggaaaaaaagcaattcacaaaaccatttcatattttttaaaatattgtgcttaaagatggtcctggaagtaaatgactagcagccaattggttttacttaacataccctcaaactgaggcttaaagtattcccttttataaaaataaatgcttggggtagggtggagtggggagggattaaaacccatccaaaaaataaataaaaactatataggtgctatgtatatctttcatctgtaaatgtcagtgtctgaacagacaacacaaattcaaatcattatacgtgtagccagaaactcaagcattttcactaaagttattaaaccaaactcctgtccaatttcacttatacaacatagtcagtctagagttgagagacaaaggtaattataaacctatttgaactagcttcttgtcttaggcctgaaccaaaaaacaacaaacaaacaaaaaacaagaatgaaaaacagaaataaaagaagtagaaaagacaaagaaagaaagcccaaagtcaaagttgttaatatttacaggtttaccagatctggaacattacttatttgaggtcagagaacaaaacaagaacctggccaggtgttgattaccttttagtgaataagctgagtccatatacttgtctaactaagaaagcagtacagaggaaaacaggaacctgatttttttaaaataaattttaaataaaatagaattactacaattctgcaatttcatactacctaaaaaagactagatttgaaaatgtcaagctgatttactttattcacatggagaaaagaatccacaaattaaactgagtccttcactggcatgccagttgactattattagctgtcataagtaactcagccatttggaagcatttcctggacaaaattacattatacctgtgaagaaaaatatagaagctttcaagctgtcattctgttttggccctgtgtgaatttggtatattaaattgacgcttgctttttttttcagtagagttttctttttaatcaatcaaacgcctacatttctggaagaaaaagtccaattagatcattacaccttaactaagaaggcaaatcttataaattttgcttgaattgttcttactcaaaactaccttagaatatggtatcttatgaaaatataatattcttaaaattttggaggataaaatgaaaagggtataaacttcaattagaactttaatcctaaaatattgttattcttgtatttttggagttttccgtcccttacaatttctccaaattggtctattccccaagatatccactgttttctacagattttagaatataaaattaaacatatcaacctaaaatctagctatgaatgttatttcaagagttttatatttttaattggctttttaaaaatatgtaattccaatattatagtgaatgttcagtaacttttgttgaaagataatgtggtttaggcttgctaaagaaaggcttgctagaatactaaatttaccttgttatttggaaagagaatctgctcctataacgttttaaaaatccccaaagtcccagagattagcacttgctatggattttggaactatggttcaagtctaagacaaccaatatgaataagttcaatggagaaggaagaagtagcattcagcacaagaaactgtagattgtttctcccacttgttactgcatctttgttcatttcacccatagcattgcatttgatgtctgaagtaattaccacaaaataaaggtaaactacatcttccaagatgtaccaacagaaaacattcgtctaattttgtcaacattgaatttttaggatttaaatcttgtcttaatgaagactctagggctaaaattcatggtcagttccataaaatgcatctcactttatttctgaatttttcacaacccctctattttcttacattaaagaacatctggataagttagaatagtgccaacttgtttgatttgttatatgattttcttgttaatgtgttgagtatgggaaataagggctttctgtgtgtcttgactcacaggaaaactgaaactgccaagggaagcaacattaaaacaactgggatagattgaatacatttgaaaaaataatttctggaaaaacgctatacatgctttttatgtttatatcttctttcttattaagacatgaatcagatccatgtggcattcaaaacaaatttattttggttatattctttacaagtcataatttttacctaaaattgtggaatatgcatgtgaattacacatgtgtagtaataaactcaactattgaatttttcctgtttcatttctaaatgactgaactgatggtaaacaaatttaatgaagtcagctaccatgttgaaaataaggatattagaactgatttcatacaatagaggtgatctgtgcattatccataacaacgttttctttcactataggaccacagacaaatatttatgtaaataggtatttttgtgtgatattttgtggtacatataactttttttagtgtttcacagcattattatttcattttatttgtattgaataatgtttttaggtccaagtagacttgaattaatgtcataattgtcagtattattgaaaattatgtcaactgtactgttattcatctgtcccatagtttagaacatgacctggctatctggcattgttgcaagtgccttaaattcatggcatcctattaaaaaaacaaatttggtgttatgctgcatgacaaagacaaacacacctcaaaatgttgtcctttcttagcttgctgcgttttacagttctttctgctaacaatttataagcctttattatataatattgatgaattacagaaatgatgaagttgttctcttatttctgttaaatgtaccagagctgtgtatctgttaatgagatacagcgtcatttctgtgaaatgtataaatgtatgtgcaggtcaaattaatatatgacattctatcagtctgtatacaggtattcctgttttgctaagctgtgcagattctgtaaaaataaattagtgcagtcaagttctaacatatctcattttatagactccattgacaatggtccaaccgaaaagaaaaattggaaatgactgctaaccagacctcgttatgaaaccaatgatgaaaaagtcacttggtgcacctctcaacaaaacaggatgctttttccgagttcttgtatatgcaaatcatttacgaggcaagttttcaacagacctagaaagcaaaacattgaaagtgtgttgttagccctcctctctgcccctgaatcaacagacagagctctgggaccttggcaatgactcagaggttggggctttctgagtaaagggacatttctttaagcatcatctatcaaatttatttcaatgtatgatgtttttacaactggtcagttcttttgtattcttacagctatggttatttgattgtcctcttacaatttgttctacatgaaagagttctttgttagtcagaatgcaacaaactgtcatcaaatggtcattgaccacttgcactcttttgatgtagattaaaaactttttcataaatttacctgctttgatttgctctgtatttttcctgcagctgtaattgctgagtgcctgttgtatactttatagagttgaaataaaaaaataattacttttgaacttagttgatgtttaattccagacaagattccaagaatagaattggtatatcatactagatgaaataccaggtagtgctgttgtagaatgtcactataacaaagtaggaaatacctataatccaagcatccctcatgaaataatatactatattataatctaatataaaactaatccaacaaattggttttaaagaattcataggaataatgttgggccatccagtgtgaaaagcaaagtgaatatagatattcacacaaactcagaaattagcagatttctgagcatgaccaccacacagtccttttttgggctatccctagtcaaactctgtactaggcaaaacaatcaaagggacaattcttgtatattactacatcctaggaggaaatgatttcatatgaaaagcaacttcatgagtctttgtccaaggatttttcacctgattccttggcttcatcatatgcacaaagaagaaacatttggggaacaatatgattacaacaaattcaactctccaaagcctagttaaacatattctttctacatccctttgtccttctctgcagtaaatgatgcacacatgaaaactggctgcagcatgaagattctctcaattacattgtttttgtctttttgacctcacattgccagtgacagtgagttgaaaacccttgtttgatgaaaactagaaattcagttaactttttcagataaagtcaataaaaccacttgaaaaaatactatgtcacgattgcacatccagtaatttcatttcttctgcaaatagaactgtaatataagcttttaacatccatcctttaagttatatgatttttcatacccttaatctaagagtgttcttcttgatcatgaaagggttttgtttttgtactaattgcacagttttgggaggagcacgcagatcaacacaatcattagaaggatagggaggaggagacgtcagtgatggtgatgatgttgcatctacatcactcacatcttgtgcatactaatttcagtgggaataaatcagtgtgcaatttttcaagaatgacaataggaatcaattctaaatttgaaagaaatggattgattgtgtgatcatccaaatgatacccaagtgtaaatattacaatgttacgcctgcagacctacctttagattcttagttatagccctgtgtgtcatgctcataatacaggccaccacattaatgtttcttttgtgtgggtgggttgtgtttgagacagggcctcactctgtcacccaggctggaatgcaatggcacaatctcagctaactgcagccttgactttgtgggctcaagggaccctcctgccttgacctaccaagtatctatgactacaggtgcacatcaccatgcccagttaatttcacactaactttttttttttttattgagagtcatattgagagctttcttctgtgtccccagacttctcctttctaactcaaaaagtcctataaattgataaaacagtaatatttatctctggcagctgttttttatccaaggtgagtctatggaacaaaagacaaatctatctatctacctacatgcccattagcaaagccaaacaggttaagcctcaaacttgtgcaaaaaaaaattatagaaagaaaaaaaaaaaggaaaacaaggtatctctaacaacccaaaagtctggccacagattttataaaaattcatggacaagctctagacataggatctaagccagtgtttttcaaacattactgtcataagatgtatctgggaaataatataaaaacataggtttctaggataatccaaagttattttgaggtataacccaggaatctgaatttttaaccagcccattagtgtattttgatacatctctatgaggtagaagcaggagaaaaggatccatggagaaacatttcaggaatggtggggtaaatgaggtaaacagaaaaaaataactctgtaaagaatcatggacatccaaagcctataaatgctctcagaaatgttaaatggcatttatattccacccatagaagtgttctttcaattaacatattaaaatgggctatgaataataagctactttttgttaaggaatagacccatgtcttgatttgcaaagccaaaaatgtatatgtatacccacctctggtatctggtacatcagtgcaggatactaggagttaatttgcaggaggactcttagtcctctggggagaaatgatactggtgacctgagcgctggctcagctggattttggccacagttcatcaatgtctgatttccctccctggggcacttttctgtgccatgtaagtcaggtttggctttttgacttgctttggcggttgaaaggtgagccttgtcactgctgcaaacagaagctttaagagccagttcttgcttcattacattctcctttacctgtgatgttgtgatcagcatttcctcaacagtggctgccctgtcagcttcagaagcagagtaaggacagtgatgagaaggagtggagcccctcaccaactcccaaaggctttacagtggaatatattgttgttttgaaccactaagattttggctttgtctatttcaacaggatttcgcccattccgactgatacaactgtcacattcaaaagaaaggtgaggcctgccctagcctctgcaaggtgatttatcactgtagaaaataacaggcagaaaataacagaataaatctttagaccctgagtcacaggcagtaaaaactgcagtgaagacttgaattcacccaaatgcccaatcttctggcagaaactacctcaaacttgacatagcaaagatacattttaagagagtaatggaaggaaacattttaagagtccagaccatctaaggttggtgcaatgatttacctgggcaatttgcatgaagactttcaaattcagaagcactggtactaaagcatgagaagcaaagaggccagtagaaattatgttagacatggaatcgggggatttgtaattcctaggaagaacatgattcttcaaggttcctggaaagaagtgagagtggagagattttacaataaaagcaagttggaataggaacaacataccatcttaaccataattctaaatgtcttctgtgtaaccctttgctaattacatgtgccacaaattactatgtaaatggaagtgaattacttagggccttggtttcctgacccataagaagattattagagttatttttggtaataaaactctctgcttttaagttccttcacttacaacctccctgccagggctggcaaactgtgatgcaccatctaaatttgtctcacagcctgtttttgtaaataaagttttattggaacaaacatattgtctgaagctgctttcatgttacaacaacacttgagtagtaagctagaggctgcatggcaggtaaagcctaaaatatttactatctgggcctttccagaaaaggttgccaatctctgatcacaaaggaaaggcttgcaatgagctgatgattttcaagttcagttctccatagagcttcagaacattgaagtaatgtctcagagtctaccgggatggaatagggagaggagtacctggattaacaaaaggggacatgcagggagtaagctccacaggctccagatttctaattctgattcagccagaaaggttacaatattatttgttttacatatcagtttaacatattctaatgttaaaccacccatatgtatttatgtatatatatgtgtgcatatcgtatatatgtatatacacatatatatgtatacacatgtatatatacacatatatgtatacacatgtatatatacacatacatgtatacacatgtatatacacacatatgtatacacatgtatacacacacatatgtatacacatgtatatacacacatatgtatacacatgtatatacacacatatgtatacacatgtatatacacacatatgtatacacatgtatatacacacatatgtatacacatgtatatacacacatgtacacatgcacatatacacacatgtacacatgtgtatatgcacatatgtacacatgcctatatgcacatatgtacacatgcctatatgcacatatgtacacatgcctatatacacatatgtacacatgcatatatacacatatgtacacatgcatatatacacatatgtacacatgtatatatagaaatataatttaatgtgtatttaatattccattggtatatttgccactctatgcagtactatcaaactggctcagttaacatggtgtataaatattatttatatcttatggggtacccccactgccctccgtccctccatccccctagctttttgtctttaaaattgttttggcacactagagtccttttattctacataaatattaaaaccatatggtcatgtttcatgaaaacaccttttaggattttgattagaattatttttagttcatagattaatgggagaaatgacaaccttatgattttaactttttccactcgtgagcattatttacagtttatagaatgtcttcaaaagcatttttaatacaattcatttacatatttggttgctattaaaataacattttaacatattatactctcgaatattataaaatagtggcacagagaaattcaattgatttcttcgttttttttgaacagtctcactctgttgcccaggctggagtgcagcagtgctatctcgcctcactgcaacctccgtctcctgggttcaagcaatcctcctgcctcagcctcccaagtagctgggacttacaggtgtgcaccaccatgcctggcaaatttttgtatttttagtagagacagggtttcaccatgttggccaggctggtcttaaactcctgagctcaagtgatccatccacctcagcctcctaaagtgctggaattgcaggcgtgagccactgtgccctgccaatttcttgcatagtgctcttatgtccaccatccttgctgaaattttactgattaatgtctatgtctattttttggttatttataaagataatattgtcatctctgaataacgaaatgttgtatttaactctttatagttccaatcagtaatctttttcttgaagtaatgggctggctaggactccacgtaaatgtataataataaaattacagttggcatccttgtctcttttctgattttaaatttcatcattagatgtttgatacaggttttatacacatacacacgatcatattaagagagttcttagttggtcaatctttttaaaaaatcaaaattctgtttcagcatacattaagatgggcatgttactttcttaatccttttattgtggtcgacttggtggaagatgtataacacatctaatgttaagccacccatgcttccttggcatgaattcaactttgtcattacatgcattttgaatatattggtgtttttgatttaccaatgttatattttatttatttatgtattttagagacagggtctctctgtcacacaggctggagtgcagtggtgcaatcctagcttactgcagcctcaaactcctgggctcaagtgatcctcgaggtcgcctcagccttttgagtagctgggactatagacacatatcacacacagctaggttgtttattttttatagaaattgggtcttgctatatttcacagtctggtctcaagctcctggctttgaatgatcctcccaccttggcctccaatattatattttagacttttctgtctatgatctcaagagagtagcctaaaagtcccctttcttgaattatcctcatctgtttgtgtataaaggttatactaacctacttagttaggttagtcttctcatccagaaaacagaaatatatggatatatactccacttcattaccaggaactgtaaatttaaaaattaaaataaaccatttttattcatgagatttgcaaattaaagtttaaaagtagcaacatgttggttagaatgtagagcaatgtaaaattttcatatctgctggtacaaatgggaatttttacaaattggaagaataattttccaatatttaacaaagttgaaaatgtctgtatcctataactgaacacttctcttcattggtatatttcctagaaaaaaagttcatacacattcactaggagatatatatatatatatatatatatatatatatatatatatatctcagcatatcttcagaagaattttgaaatagtaaaaaatttagaagtcaaactgcccatcacctggataatagaccattaaatctggtgtattcaaacaatagaatattatatgaaagtgaatataaatgcattagttaaatttaacatggctaaatttcagaaacagcgctaaatgaaaaaattgcataatacagtgtgacaacatttatataattttttaggtgagaaacttttattttgggggaaatggcagattcagttatttgaatcaactctcttactgaaaatttaaaacgctactacatatgtatatgtatatgtatatgtatatgtatatgtatatgtatctgtgggtgtgtatgttacatccctctctctctcttaaaaatctcaaaaagttggcaacatactaagaaaaagccaagtcaaaatctaagggaacacgggaaccatgaaagtgggccactgaaactttatttgctctgagaacatttctcgagtctgttgaagtagagctttggtttaatagccacctgggacaagggatatatatataaaagtcaatattcaaggactacaatttttaaaaattaaatggcataaacttacaactaaagtacattaaaataatagtatataaatgttacaaaaattatataaaatatatactcaaaatatatactcaaaacttattactacctaaatatattacttcattgtactattgcatatcctcttgaaattatttatatcaattgtatctgtatggggctcagtgcagtgtctcatacctgtaatcccagtgttttgggaggctgagactggaggatctcttgaggctaggagttcaaggccagcttaggcaacatagtgagatgctgtctctatttaaaaaatcatttttaattatctgg

SEQ ID NO: 1310 - DNA, 25691 bp, Homo sapiens
ctctgctctcccgttatgggggtcgggggaatgatgggtcaagggtcttccgaagaaagcgagaaaggaacaggcgccttcaaaagcccacttggcgatgggttacagtaagaggtacctccaggcccgggcatccgctggaaacaggggtgggtagggtcgtgtcatctaaaggcgcagcttcaaccagaagactagaagtcagccaggagctgggagtagtgtcacgcggggtgggggttcctatgagcatcactttacaaaaccaggagggacggaagtgcgagggggcagagtcttggaaacaggtcctgggccaactgcaacagaatatacccgccgcgtgtaggggaaggcggcgccagggagagggcgcagtctctgaatctttccacggggtccatcctagggcccctccaggttcaacggtctcctaacctgtagtcacccacaagagcgtgccctttctgcccgcccttcctagcgttgctccctgcttggctgagcactgcggagtttcacgcctctaaaccccgcctcttcttgcaacctgtgttggcctcatctacccagcaactgtcgacgtcacacgacctgggcctccctgaatgggagatatttactaggcaatcccgcctactgttctgaggtttcccctccaggtgcagcttcagagccaggcgagccaggaaggaccagcgggcgaggtggtgagttgtgaggcgcgcccagtccctctgttcccgcctggcacttgctctggccgcgcccgccccatctgccacttcggagaggccacggctctgagctgcggccgctagtgccctgatgggccctgtggctggggtcttgcacattcttgggggtgggcctaaggggataggggaagtggaaggggcctcataggaattaaaaagcttaagggaaaaggtgatgcagttagggggtaaaacattgaggatgataaaagaggagacatccgcagctgaaaagtgcgctgcaaaaggcagtgggccgtttggtgtgccggaaacataagaaaccacagtacaaaacaccaattttattataaatatcaagaacctacagggtgtttatgggccagcatatgccttcagttatgttgaaaatagctgatcatctttccgtacattctgaacatttctcagtttcagagtgctggccacaccaaagcatcagccctggctctaaactccgttacagtaaggaattacaaatcctgtgtttgtactccaggaagtctgcattatcacgaggagcttggaaaggaggtaacacactcaaggcaaatttcaagtaactcatcctggaggcagctgcctactctgcagctgtggttctccaccacagagagaagaaaagggagggagatggagtgcgcaggtctgagaaggctttcattctggagcatctgcaggagcctgcaccatggcccagtagcacccctttttctccatgagctgctggtgggttcccccctcccggatagcgcctccttccagaaagaggatgtggtcagcctgctccaccaggctgaggtgctgggtgatgagaagcactgagcgggagtaccgctcagggctttcgtacaggagctgctccacctgaggaaagacatcggaccgtcagagccggggactaccctcagcccagggagacacctgtgtttccagggctgggactgacctcacaggatcactgctggctctgctaacaaccccaaggacaccaacgtttcccattctgagtacttctccgcaaaccctttgtttcattaaggactgttttacatgaagggtgcaaaagtaggataaaaatgagaaccctagggtgaaacacgtgacagaagaataaagactattgaatagtcctcttctctacccatggacttggcatttttatattcgattttaaggaaatataacttagtagtaaagagatgagcattcaagtcaggcagacctgaatttgggtcaaggctgcgccactcaaaagctatatgacctctatatgagcagcttattcaacctcttttaacctccattttgtcatctgtagaatgatgataaatgcctagctcagaaggattcctaatgaataaatgagtgacagtgcatgtaaacagactagcttaattaatattaatatgattaggatgggctgggcccggtggctcatgcctataatcctagcactttgggaggtcaaggagggaggatcacttgggcccaggagttcaaggccagcctgggcaacatagcgggacgctgtctgtacaaaaaataatttttttaaataaacgatattatgaggatggtcttttccttatgtttcgctttagaaattcagtctataggactgggcgcagtggctcacacctataaccccagccctttgggaggctgaggggggcagattacctgagctcaggaattcaaggccagcctgggcaacatggtgaaacccatctctactaaaaatataaaagtcaaccaggcatagtggtgtacacctgtagtcccagctactcgggaggctgaggggagaatcgcttgagcccagcaggttgaagctgcagtgagccaagattgtgccactgcgctccagcctgggcaactgagtgagacactgtcttaaaaaaaaaaaaggaaagaaagaaagaaattcagtctgtagtttgtagatagtctcttttaactgattctaggtgtctttgcctcgtcttctatctctactccttggggaggcatccaatggaactggatttgggaactgagaactgcaaggactggtttgtataattatgatgttagtaaaactaacagaagatgtataaaagaagcaagattgggtgggatatagccattaagaagatgactgcctcacctgtaactggctgtttgcatccagggcactggtggcatcatccaggataagtacacacggtttccggatcaatgctcgggccaacgccactgcctgtcgctgaccccctgacagctggctcccagcctcgtctacctctgcagagcaaagggccaagatgagaacggtatagccacatgtgtgcacgcatgtacatgcacacagacacactcatgcattcacgcactcacacacaccaagatctgacggttgtagctggataggggagattctgggaagatgaacagaatcctgaggatgtcaggatgaagaagccataggagcatgatcttacaacttcaaattgatgtccatgagtaaggaggaactgaaggataaaggcaagactactggggtttcagcaaaggtaaagatggctgggtggtgagatgagtggagagagtacctgtgtcatagccctgagggagtccagagatgaaactatgggccccagactttactgcagcagctgtgatttcctccatagttggcttctgggtcaggccataggcaatattttcttgaagacttcttccaaatacctgtggctcttgtcccactgcagccacctgagatgaaatatgatgaagagtcatagaacaaggcacatgggagtatggttatctagagatcgaagactcaaaatctttattgagaacatgtcacaaaatcatactacctccctcctgactacaccaccatctccacccaaggtctcttatcattccctaacccctctttcagagtgctcagtaagaatgctcttcgtatttgatgctccctgccctccttcaagccacctgcttccatacctgcctgtgcaggtagcggtgctcatattggggaaggggcttcccatccaacagcagctgtcccccggtgggctggtacagattctgcagcagggcagccactgtgctcttcccagacccattgggtcccaccagcgccgtcacctcgccagggcgtagggtgaatgtcagcccctagaggccagagaagcacacgataagaggctaccaaggcctctaaccttgagagtgtcattgccttgttacatagcatgatgtcttaccccagaagaaaaacagggaaatatagaaactcctaccctcccacatgcacagatttctgggtgatgcctccccaaggagtagagatagaagaagcggcaaagacaagggcagagacccagcaccactatgccacacacttgatgtcagataccaccaggaaagggaaaaatcacattccaaattacaaaggaaaaggaaagatggaagaccgaagacacagattttgctgcagcaattccttggaacgtgagagcactctcttcgaaacctcttctctcattctctttggaagcccaaactgggttcttgagtttggggaagatttatggaacagatgatgcctaccattgcctttaaagggttagggaggatatatgcttggcagtaagcaggctgaaggcaggaagaaaatttaggatggcagaattgcagttggggccagtggaatacagggagtggtaggttgtacctgtagcactaagacatctgggcggtttgggtaggcaaaggagacatcttggaactggacaaggccctccaagtgtaagggagtcaacagaccactgggtgggcagcgaggggtgcggtccaggtactcaaatattttctctgaggagcccacagccttctgtactctggggtagatggagagcagtacctagagggaggtaagaatagtgaaagtgaggtagtctgcttgccagcattatgtgaagcaagaagggtaaagaatggaaggacatcacacagatggtgctgggccagaggaaggaatcacactggggagtgaaggtggagggacctcacctccacagcctgggtgaactgcatctggtagagaacaaatgtgacaaggttcccactgcttacagccccactggtcaccagctgcccaccaatgtagaggattcccactttcagcagcatacctgaaatctataaagagaccacaaaaaaagggactgaggtagagaaatctggaggggacacaaagaaccgcagtcattaacctgaaggaaatatcaagtccctgtctcctaagtgacatcggcaggctcaataggcagacaggagaatgaaccagagaccccatggagtctgactcaatgcacatcatgcaagtcacagttatcttcaccaccatcaccactatcaccttgtctggggagcattttactcttcacaaaaggctttcattcatgtgatgtcagctaatacatgaagagccttataaagaaggttatatcactccatttttgaaaaatgaggaaacaaccagtcgggcgcagtggctcatgcctgcaattccagcactttgggaggccgaagtgggcggatcacaaggtcaggagattgagaccatcctggctaacacggagaaacctcgtctctactaaaaatacaaaaaaaaaaaaaaaattagccgggcgtggtggcgggtgcctgtagtcccagctactcaggaggctgaggcgggagaacggcgtgaacccgggaggcggagcttgcagtgagcccagatcgcgccactgcactccagcctgggcgacaaagcgagactccagctcaaaaataataataataagtaaaaataaacaaacaaacaaacaaataaataaataaagaggaaacagtctcagagaaggtaaatttgttgtcatgatcacaagacaagtaaattgcatcatcaagccaggatcttcggatcactggcgtagctctctttccagtgcatcacagatgtccctcatccctggcttccactattcccatcactctcactaacaaatctacaaggtaccagcatgaagcagtcccaggtgcaagaatttatggcgccctgcacttcccctgagaggcaaaggaaggccctaggactggaagacacgcatctctccaatccacatggttgggtggattttatgtaccatactgaaaggaagccacctagcatctttaaagagagggagggggctagggacactgagtagagtcattgagcctcaggttgctaggacgaaaatactgaaccaaccatttcccagtaaaggaggagtgggagcagggtcataggaatgggaatggagtcacggcatcttaaggacaagggaatgggtattcatcttcaggtgctcacactagtggtccaggagttgactgcataggccacagcctccttctggttgagtgtctttatttcttgcagcttttccctaaacttctgggcttcgccctcctcgttggcaaagcttcgaactgtaggcatggccgacagagcctcaatggccacctggctggactttgccagagattcccgcacctgcacttccagcaactgtggatacatggacaagagatgtcacacgggttggcaaaccatcagggacactaatacctgagttacctatttggaaattaaaggtgagaagagacagaggaaaaggagaaaagagaaagagacacagctatgccccttggatgctaaagaaatacgaggaagaggaaaatgactcagaacgggttggggatcaaattcttaaagacagattgtggggagaagctagaaaagaagacccagagagtatggaggttaatgttgagcaacctgggaacatggaccacagggacagggtgttccatgaagatggagaatcagtaagggtgccaggaaagctggactgaaagcaatgtgagaggaactgagtctgccaagtctgggagatgagggtctgtgtagagcgggccaactccatgaacatacctggtaccattttcccaccttcttgggcagaaggaaaagcagaggcagggtgatcagggtgaccatggtgagggacactgatccccagagcatgatccccaagagacataggcctcgcaccaggtaccacagaaataagctcagattctcactcagagaatcactcagggtggacgtgtcctctgttacccgagacatgatgttacctgcagggttggggagaagagagtgaggtgaatcagacaggttccaagtgatgagacgaactaacaatgagccaggatgccagggtcaggggtgtcaacatggggttctaaggaggctgcaggaaacaaggttagggttctccagaggtctgcaaatctcagtgcagggaagatgagtgttaaagaggaaaggcctgaccttcattttaattataaagtcattaatgcacatgtgaatttccattttcctgaaagctttctgttccctagagaacctgtatgtcccatgctatacacacaggcaggaagagcttaaactggtcacataacagagatggaggaggagggtgctgctaggaagcatgccaaagtctgtggagcactcactgggactagggttctaaccccaggtctatctctagccatatgtaactgtacagcttctagtgctgctagaaagcatgccgaagtctgtggagcactcaagagaccagggttctaaccccaagtgtgtctctagccatatgtaactgtgcagtttcagcatttagggtcttggcctcagtttccttctctgtcagatgaggcagttggtctctatgagctcaaaatttccaggtttgaaattctatggtttctatctaaggatacataggaatagatttataagaaaatgctagatgaaaactctaggtttttcttaaggtaaggaggacaatattttgctcctgaggtatatcaagaatgagaaaaacaattgtgtgtgtgtgtgtgtgagagagagagagagagagacagagacagagagagagagacagggagagggtatatcaagaatgagaaggaacaatgtgtgtatgtgtgtgtgagagagagagagcggggaggggggagatcaaagcagatgtatgaggatatgaacagtacatggcgtataatgaaagagtttcaggagaaacctgtctggttctgttggaaaaactccgtctcctggcgcaggacagccccaaacacctctccctgcaagtggctgtgcacgtggcccatggtgttgttatagatcccgtcacccacgaactccagcactgcactataaagaacccggaaaaaaaggggatcagggtgtgttcagggaacagactgaaggtcccaggtatccccatataagtgcatttcggacagcagccccaacttccaactccctcatttgcagggtgccccattttcagcccccagacctggctatggtgagaatggacatgagagttaagtttcgagtgaaggtatcggctgagccatcttgtagaatccagtcagtgaggcggcccgtaaagaatggaatggccatctcccctggagaaagagaagagaggtcacgcacaaatattaagtctaagtaggtcagttccagtcagactggccccaccacgcctcctccccctcaccattatcctggagggcatcagcagaaaggaaacactgacgtctcaatcccgaacctaaataggctgccctggaactcactaccctgtggttgctctaccagaactttcaggattttattaggaaggctggagatcatgaagtagaaaagcctcctgttagagatgaggatgccccgcccttcggccccagagcaaaggatttccccgcttccggcgtggcccaaagaatcaagacccggtcagcaatggagcccagaacctctggcccccgccagtccagtgccgtttcttctacaccgaagtggtgttccaagacccacgctaggagtccttctcctgctccacatttcccagaacccacgctactctaccttactgacaattacctttgattcctgtcccagtccccttgtgtcctcccctcttgccctgcgttccccttaccaagagaggagaggaccaccaggaccaggaacagcgagaggcggcgcgtctccgagcccaggcagcctagaagccgacgcacagggtttccagagccgccctgaccgccgggcacccagaggctcccgagtttgtgccacagggctgctgcgggcagtgccgctgcataactgacaacgaaggcggtagggtgacttccccagtgcagtagcctggtgctatccgcggacccgggggctccccatgagatcagctctcggaacaaggcaagtcccggcagggccaagcccagtgccgcagctaatggcttcaaagcagccagccagccctgggcacctgcgttttcgctcttggagccaaccgttgccctgaggaccccgcaggcccccagccagagcacggcccagcggctcaggcccaccgcccagacccggagcagtggcagcgcggtgggcaccagcagggagaatatgcggggcagcgcggtccggagcagcacccagtcggcgagaagtagcagtactgtccccagccatgcgagagaagctccggggaggcagcggcacccgcggggagcgggacacctagagctagccattggcactcggacgccgtcccggtcccggccgggcctgggactctccgcgccccggtggggcctgaagctccgggtaccgccgagtcctcccctactggcggctgggggagggaacgagggcggggctctcggaaagtcccaggaacaggctgatcctgcgctggcgagaagctcagccatttaggggaaagcgaaatcgaaagcggccgcctgctcactagataacgcctacttccaaaagtggcctgcccagactattttggtagcaagcgtggaaatcagatctgagaatctcgggagcagccctggtgcccaattttctccatcacgcacacccttctcgcctctccctgcctcctgcctttccacttgcaccagttttcccaccccagcctcagggcggggctgcctcgtcacttgtctcggggcagatctgccctacacacgttagcgccgcgcgcaaagcagccccgcagcacccaggcgcctcctggcggcgccgcgaaggggcggggctgtcggctgcgcgttgtgcgctgtcccaggttggaaaccagtgccccaggcggcgaggagagcggtgccttgcagggatgctgcgggcgggagcaccaaccggggacttaccccgggcgggagaagtccacaccggggtaatgggtctgggcttgagggttggcagaggggtggaggagatgcagcggccaggggaccctggaagcgcgcgcggagaagtgaatgcagagaccaacgggagcgcagggaggtcgcctgtagcagccagcgcttgcaacccgcaatgagcatagagtatttcttttctgaggggggtcgtctagagtgtccgtgaagggaacaggcacgcgaggctggtggaaaaagcgggtgctttgactcttagctggaagcgtcaacgggaagctactctaaagcgctttcgctttcactctggtcccggacagtgggggctggttaaatcaagaaagggggttggggatggtgcaaagagatgaggaaatggtgccctgggtgaagtagaacagcacttgggagaaggaaatataggcacttattgagaaggaccaactcatcacacagacttttgataaacttgccactgggcaactcttagcccaagcactgataatgggcgttctgtgttaactagtgatgcccttccctagcttgacccaggaaggcctctccttggcccagatgctgccttactcccttccctgtgtcttccctgcccactcccatgtgcccactggggggactttgcttaggatgggcgcctggggcagatggcagccccaagactggctggctggcttctgctctggactactgccaccactcgtggcttgggggcggctttgttagagaggaatagcctctaacttgaagttaaccctgttctttgaccctctattcatgataagtcggtccgtcggaaagcatactcagaggagcgtcctttggggccagagtaacttacggcctggtaagaaagacacagtgaaaccacttataatttgggaaatctcccctcactgccaaatgagcagtggcaagtaggaagtagaagtggaaacaagggataagagttagacctgaattttagtcccaggtctactattaactctgtgtgactttgcataagtcgtttgcattttctgtgacttggtttcctcatttgaaccgaggatctttaaggctccttccaactcaatagtagaataaatgtagctttatcttccctcacttcttcttgattcttttcttgacctggaaaagtcagcttaaacttctcagtcaaattatctcttggtacaaatttacctccctggctgctgagatatgtatttacctcttgatcggaaattccataactgaaacttttattttcaaccatctgtatgtgttccttgctgcttctctcctgccttgcccctggccatgctaaccactgccctcctcgattttttccaatgttcagtaaattggaagagctcacttctgatgaaatggggggtgagagtggaggattgtggaccaaaaaaaaaaaaatagactgaccttgtttcccaagatcatagtcaattactctgtgttgggtctacaccacatctgcacatactatgagcccttccgttggagataattttcacttgcggagctgcttcacttctacctgtaggagcctcatctccacctctctacagtggagaggattccactaggcaagttggaacttagggacacagttctttctgtgttgtatcacagctgggctgtggcattcccctgcagccggatgaagcaatagagaaagtggaaagatgaagggaaaaaaagcctgtactgacagtcagctctggcctgttactgtgtaatctttgagccagtcacttcgcctctctgggaatgtttcttcttctctaacatgagggcatcaaggctgttcttgccctgacattccatattctgtgtctctgcagaccaccatcatggcagtggagtttgacgggggcgttgtgatgggttctgattcccgagtgtctgcagggtgagtaaaagtgaagatgtatgcatttggaaagaagctaatggcctcaaatacacactttccttacccattcatgaaaagactggcaaactggagccttggaggaatggagttgaccttccccaaaagccactatgataagctatttggtgggtgcttgggtctctgaatttgtggaggaggatctggggtctgaatgtgtatgtgacctgtcccagtagtgtacagggatgagtaaaggaatagggtctgagagggggacaggagatagatttttgagggtcttctttccatctgtgcttagggatcaaaaagatgattctgtcaagcagatacctggtttctcatttaccatatattgaactattttgtctcttctcccactcctaaccaatttcctcacatgcaaaatgagtatatggggttaggtcaatattactgacattatgttccatagaacataactctctcaagattgttaatagcaaagaaaattgatgaggcatatttttcttaccttagcattttttgctttgttataaaatctaagcctgaaaaataagcctaattttgattaacatctgcagtgattaataatatctgagatgattatttgcctcctgctttaatccaagcattaaacttcatgctattctcttgtcaaagaaatttgagagacattgaatgatcaccctcaaaaattcctgagttctggttgggtgcagtggctcacatctataatctcagcactttgggatgccgaggtgggcagatatttgaggtcaggagtttgagaccagcctggccaacatgttgggaccttgtctctactgaaaatacaaacattagctgggcttggtggtgggtgcctgtaatcccagctattcgggaggctgaggcaggagaatcacttgaaccagggaggcgaagtttgcagtgagcccaagattgatccactgcactccagcctgggtgacagagtgagactgtctcaaaaaaaaaaaaaaaaaaaaaaacctgagttttaacttggtgactgttgactccctcctgacagcgaggcggtggtgaaccgagtgtttgacaagctgtccccgctgcacgagcgcatctactgtgcactctctggttcagctgctgatgcccaagccgtggccgacatggccgcctaccagctggagctccatgggtatgaagctctggagttctgactccccacccactagagctcccccaacctgcatgaatccctgtacagtgtgctgttccaggagctggacactgggaaatggaaaagtcttgtttcggctcttgctggcacttgaatctgtcagtttctgcatctgtaaagtggagataatatagtacctcatgagacggttattttgagaaccacattctatatgtgaacacagtttaaaagctgtaaatcactatcctgatataaataatcaggaagaaggtgatattgtgacccaccataatatcaggcagttaccatacgagaaatcaaggtcgttgggacggaagtaaccttatctgcttttccccataagagcagggtccttgcagccaaaagaaagttatgtgggtggggctgagcaaaagagtgagcaattgaaagcttcttaccagttggtggtgtgggactctggttcccctgtacatgtgggagggaggctgcagtttgagctattgcagttacagttttcaggggtcgtttagcagggatgatggtaacagtataggagaatgagacttaaaattctatcaacctttattcctaatatttccctcaggatagaactggaggaacctccacttgttttggctgctgcaaatgtggtgagaaatatcagctataaatatcgagaggacttgtctgcacatctcatggtagctggctgggaccaacgtgaaggaggtcaggtgagtttctcccaaagcactctctcctctgggcttccccactctcctgcagaggaagatggaagtcctatgtcattctagcaatgagttccaaggacactacctctgaaagcatagtactttggggatatgagataccagggcttcattgcagggtgcagagaccacttaatgtctcagtgggaaggaagggcttgatgattctttaacctgaggatccctttcccaggtatatggaaccctgggaggaatgctgactcgacagccttttgccattggtggctccggcagcacctttatctatggttatgtggatgcagcatataagccaggcatgtctcccgaggagtgcaggcgcttcaccacagacggtaaccagccaagtggaagggtacctggggagggctttgaaacatgggaaggaagtagattatgaggaacaggaagagaaatacaggggtggccatttaagttaatgccgggcctggtacacttttaagagtgaaaaggggcaggacaaatgcaaagctcaatggggttcttgggcaatacggataaaccagggctgttctgagtaaatcaaatgaggatacacagtcactgtgagaaccagtggtgtgctaagcacagtggctcacacctgtaatgccaacaatttgggaggctgaggcaggaggattacttgagcccaggagtttgaggccagcctaggcaagatggtgaaaccctgtctccacaaaaaacaataaaaaaaagtaaaaaaaaaaatgaactgggcatagtggtgcacacctgtagtcccagctactcaggaggctgaggtggaaagatcatctgagccggggagatcaaggctgtagtgagcggtgattgcaccactgcgctgcagcctaggtgacagagagagaccctgtctggagaaaaaaaaaaaaaaaaagaaccagtggtgtgctgaggtgtgctgaggctggcttgggaccactcatgagagcggactgttaaatagtcaaggatttgtgaactgcttagctatttgtaacttgcaattcatcatagcgggagcatttacaccacggacatcagcagatgccacatatggaagcctttttgtaaaaaaactgatttaccagcacaccactaaatatgccttcctggaagatgagttttgaggtgaaagtggtagtaggcatatggatggagggggagtaaaaagatttttgaagctaagccatcctctctctccctctctccaacttgaaaccctctgcagctattgctctggccatgagccgggatggctcaagcgggggtgtcatctacctggtcactattacagctgccggtgtggaccatcgagtcatcttgggcaatgaactgccaaaattctatgatgagtgaaccttccccagacttctctttcttattttgtaataaactctctagggccaaaacctggtatggtcattgggaaatgagtgctcagggagatggagcttaggggaggtgggtgcttccctcctagatgtcagcatacactctttcttcttttgtcccaggtctaaaacatctttcctagagaaaacaaaagggactaaactagaaatataaagagccctatacatgacaggtgatcacgtactgaatgattttgaagtagtacaaacaataaaaattctcattccgcatcatcatgcggtccatgatgatgaggccgcaagtgaggtgatgggactctttcctttaaggctaagactgacagataggcaagacacctacacacatgagaattagctaagactatcagcaaactcgcatgtaaaagaattcctttcataatgcattcattcatattaaagggcaatacatgaaaaatgcttaaatattttggggcacttgtgaatttcaaagaataatgacaataaccaaaagaagctacatttgtggcattggctaaatgttttataaattttatctcttaaaattcaaaccaaaaaaccccctgtattcacacctgtaatcccagcactttgggaggtcaaggcgggaggattgcttgagcccaggagttagtgaccagcctgggcaacatagtgagaaccccatctctacaaaaaaatttaaaaattagtcgggtgcggtggtgcatgcctgtagtcccagctgcctgggaggctgagtgggaggatcgcttaggcctgggagtttgaggctacagtgagctgtgattgcgccactgcactctagcgtgggtgacagagaaagaccctatcttaagaaaaaaaaaagaaaagaaaaagaaaaaacaaacaaaaaaaacacccaaccctatataggtattattattacttctataggacacatagaggtttggaaagattaaatcacttgaccaaggtcacaaaataagttctgaggctgggatctgggattcagtcttattatatgcccttcctctaccactccctaaaacttctcattccctcaatccccatatatcatcttaaaatctgcaataaatagccccatacattcgttggcacttaggaaactgttaccagatggctgagtaactgtattaaaacaaatttaattctgcttctatctttgccttgcacttcctgagtgacaggagtgaactctcatatccttttctgtcaaaagatggtgctgaatgatttctaaggtagtttacagttccaacattcaatgccattttgctaacaagtgggcagtcaacaggcatattcaacagaaatactagtaggatctcaggctaaacatacgaattcaaaactctaaaacaatcacatccccctggagtgtaaagaaaaaaatctaaaattacaaatgcctggagttgtttctagccatgatatttaacttatttgagattttaaatagcccatttttcccactgatcacaagtagaaattctgggcagtatacaaaaagcaagtactcaaggactccaaaaagtaaacaaaagcaggtggattgtgaagagggtcaaaactgggagaggggcccctcctggggagtgggttttcaatgttttccccttttttcctcccagctctgccctgacgtcaggcctcaggtgcagagctgcactgcgtggtagcacaagccctgagttaacaagagaaataccggctttctggccagaggaatgaagaaaaagggcccctgcgggcaggaatgtgtaggggaatctccaaactgagagtacaggcggaaattccctaattctgagtctgaaccctcaggagtaccaggttacccctgagctgcacatgcgtgtgacatgccttaagggcacagcaaagactttgagaactgaatgaagattagatcttttaaaattggaagacttcggccaggcgcggtggctcgtgcctgtaattccagaactttgggaggccaaggcgggtggttcacctgaggtcaggagttcgtgaccagtctggccaacatggtgaaacctcatctctacttaaaatacaaaaattagctgggcatggtgcctgtaatcccagctactcgggaggctgaggcagggagaatcgcttgaacccgggaggcaaaggtggcagtgagccaagattgcgccattgcactccacctggacgacaagagagaaattccatctcaaaaaaaaaaaaaaaaaaaaaaattagaagacttcatttttctgtattggccaaataactgttctaatgcccttcattccaataaaaggtttgtagcagcttacagagataatttaaaacaatttttaaaagaagaaaacaacactgggtcagagagaaaatatggttaagaaaagtaagtgaagccaaggagtgaaactaatggaaactaatggacaacgtgaatatcttaaaaaaaaaaaaaagtggtgcgctgtcttatactggctagcaagagcagattgcaaagtattcaggatttttgaagacagttgttaactattggtaacttgatattgaccactatggaagtatttatactatagaaatcagcaatgctacaagtcagaagcattgtttttcttcagagagccggtttaacaggacacatatttatcagccaactataaatggataaaaaataattggctccaggccataggatagtgaaagcaaagaaggaaataaaatgaggtacaagattcataaaattcattttttaaaagttgccagaaaaccaaaaattatatataatagttcaagccacacagaacatttactcaaataggacatgcatcattccataaaggtaacgccaataaattccagagtatcggtatcttagaaactatctatattctaggccaggagcagtggctcatgcctgtaatcccaacattttgggaggtcaaggtgggcagatccctagagcccaggagtttgagaccagcctgggcaacatggcaaaaccccgtctctacaaaaaatttagctggatggggtgcacctgtaatcccaactagtcagaaggctagacgggaggatcgcttgaacccaggaggcagaggttgcagtgagctgagattgtgccactgccctccagcctgggcaacagagtaagacactgtcttaaaaaaaaaaaaaaaaaaaaagaaaaagaaagaaagaaactatattctgcaaccatactgtaataaaattagaacttgataactaaaatatacttaaaattgtaagtgaacaaatatatttatcagtaacatggatttaaaaggcagtcgtggatgggagcatcgctggagtccagaagatggaggctgcagtgaggcatgattgcgtcactgcactccagcctcagcaatagagtgggaccctgtgtcaaataaataaacagcagttataaagaaaattaactcttttagaaccaggtgttaaaaatgttacacataaaatatacatataaaataatattataatttcaaatacatttattagaacaagaaaagttaaaataaaggacctagaaattctactcaaaaatttggaaaaagagaagttgagcaaacctaaagaaatacgaagaaaaggagttataaagataagaatagaaagcaatgaaacagaaatagagaacaaaaaactaggtagtgaaaattaacatacttttgattccaaaagctgcttacttaaaaatatttgtaagatattcagagttacaacaaggccgattatggataaagggagaaaaaatgaataaacaaatacataatgaaaaagggggaacagctacagatatgacacagatataaagcatagagtgttatgaacaagtatatgctaataaatttgaaaacctaggtgagataagcaaattcctagaaacatttaatctatcaaaattagcacaaaaagaaatacaaaacttgactataccaatgagtattaaagcaatttttaaagttatcaatggcatctaataaaaaaatatatttttgaaaatgcccagatggtttcacagatgagttctatcaaacattcaaggaacatgaaacttctatattatatactttttccagaaaacagaaaaaaactaaacctgattagctaattttatcagccgagtgtaatcttgactccaaattgagttgtggaaaactcaaggaaaaaaaaataatagacccatttcaccttgaacacagatgggagaaaaaaataattatttatgaaccgaattcaacaatattacaaataataatactgggaggccgaggtgggaggatcgcctgaggccaggagttcaagaccagcattgtcaacatactgagatcctgtgagatcctgtctctacaaaaaattaaaaaattagccaggtgtgatggtgagcacctgtagtctcagctactagggaggctgaggcaggaagatcatttgagcccaggagtttgaggctgcagtaagctatgattgcaccactgcatttcggcctgtgcaacagagcaaggccctgtctctaaaaatatgtataataataacaataataataatgattatgctaataatgatacatcaagatcaaatagggaatccttggaatactagggtggttcaatataataaaacatattgttgctataatttaccatattcatagaaaagtcatttcctttgctcagtctattaataaaagacatttggtaaagtatatccatttgtgatttttgaaaaacagttaaggaagcaggaatcaaaactttcctattttggcaaaggttataatccaaaaaatctgtaaccactagtatacataacggaaaaaccttgggtatccaagacaagaatgttcactataattactagcttatcatagcactaaagcctatgggcaacataacaagaccccatttaccaaaaataaatttaaaacattttaattagctggcatggtggcatgcacctgtagtcctacctacttgggaggccaaggcaggaagattgcttgagcccaggagtttgagcttactgtgagctgtgatcacaccactgcactccagcctgggtgacaaaggaagaccgtatttctaaaaaataaaaaatacaaatacaactacaaactagcactagaccaacagtgactatgtaccatgaactgaggaatattattaattccaccatttgcatctgaggttaacaatatgtcaatgacttaaataacatcatatctctgagagtaatttctcctatatttccatgacaaatgttagataattttccattttttccattcaataaaataaacaggaaatataattaaagagttcaattgaggattgggatttagaaaggaaggcaggaattaagaataatccttagttctcttcctaatttgcacctctctcactgatacacatgtattattttctttttatgtcttttagaatctaataaacatgttttatattatataacaaactagaatatatggattatctttggtcttccttaccaagttcttaactctgctggctctggggcactggacataccatgtaagaagaaaaatgttttaactccattgaacttattcagaagcatcggaaattggttcagcaatattcaactttgcccagcaatgtttatgaaagtttcatatatagtatagtataagtatgtgtaatacagaatttatgttctcaaaaatgaagagataaagtatggagattctaaactctgttgacatagaagagggtggatttctcgaagaaacagccttctatagaaagtggcttgtatgagtcgggattctccagagaagcagaaccaataggatgttggcagagagagatttattttaagtaattggctcatactactgtgggagctggcacggtcgaaatctgcaggtaggctggagacccaggaagagctgatgttgcggcttgagtctgaaggtggtccagaggcagaattccctcttccttggaggacctcagtctttgcccctaagaccttcaactgattggaagggccacttacattatggagggtaatctgctttacccaaaatctattgatttaaatgtaaatctcatctaaaaaataccttcactgcaatatctagactggtattcaaatgtctagaaaccatagcctagccaagttaacacataaaattaactatcacttggctcaaggtgaaacttccagatcaatgtggcaggagtgttgaggaaggaagtgaactcggttctaaccaagtaggacagccgaatcatcactgaagtgtggcactggcctttcgccaaggtaacatgtggcaaggttttaggttaggataggtaccaggcaaaagctgggtgactcgatggaggcttttgtgccaaccttcagagactggctgcgtcagactgccctcaagagcatacaaaggaaaaaaagacaaattaaaagcctttaatccaaactcaagacatgaatgaaaaactgtaaatgcctctatagcagttttaaaggctatcttttctcctgcaacccagcacagatatggctgagggtcaagcccgggggcttatgataaaggttatgaagttgtagaaatgtttgttgcatcatccaacagcagctgttgtgataaggcaagacccctggttgggatagaccggaccctgagatatgaaatagggacatatgagcagacacagagaagtctgagtgagaactatgaatcaccgcaccccctgagggtccttgctggaagaagcagactcaccgtattagttacctattgccatgtaatgaatgacacccgcttaaaataacagacatttactataaggtgttactgggacaataggggattttttaatatggattgtgtgtttgataatatggtatcaattttaagtatcttgggggtgatgacagtattagggttttgcaggagaaatgtccttattcttaaattatacatgacaaaatatttaggggtcaagtggcataatttccacagattactctcaaattgtttaacaaaatggttcttcaacagtaaatggataaacaaaacgtagtctattcgtgcaacacagtactatgtaaacaatgaaacttcatcaactactgaaaatgtaacaacatggacgaatctcatagaaacaatattaagtgaagaagccagacttgcagaaatacatactgtatgtttccattatctattgctgggcagcacaccaactccaaacttaatggcttaaaacaaaaataatcattttattatctctcatgaatctgtgaattactggactttaagagccactgatgtagtccatgaaccaaaacacatattcacggcagccactccacccagcacctcacacctgtgatgtttactggctgcccatgggatttgaacacctttagagtactgtgaaatttcccctaccttttgagtcctgcctccctaaagtggaaaccagaaagctcacttcccctagccttctttgaagctagagcacctaagttccaccaattaaattcatccacctaagacttcagttacaaaggggccacaggaggaaccagggtgtgggggttgcagagcaccttttactgtatttatttctctggcaaaggtgacagaagaagcaactgtcttttggggaagcggtgggttttttccttttttttttttttttttaagtgaagttcctgaaacagaagtggtttaggaggtgtcttcagtggtggctgcagcaacctccaggtcctaacaacagaaccaacagcagcgtctagaagccatggggcagcagcagtggtgtggctcatcagacctgctctctgcgtggtctgaccctgtacatacatgtgcctctcatccgtagttccagcatttcctctctaaagtctagttctgagagaaatttctttggtagacttttcaaagttttatcaaactcaaagagggaaccagcaagaatacaagagccttgatccaaagagtatttgaaaaacagagctgtatctctctgtgaggaaataatttctaggctagagattcaaaatggctaacgtgctagagggcaataaaatcataaccttggtgttatcttctttaccggagaaaaagagaaagccagcatcccttatcagctctctgctgattaacctctaatcgcacagggctggccgggttcgtcttaggcaaattacaatccctgaaacactctggttttgatcaggcagaattatgagcaaaggttcaagtgtgatataaaataatcaagcacgtacaattttgccttatttataattttgaaacacttttcctacacaatttctgaccttaaggggcagaattaaccaaataaaacttttcagaaatgctctaattcagttccactcattttatcgtctctatttggcctgttttagggctaaacccagaagcaaaatcttcttcaaaatgaatgtattgacagtcaccatgccagacttggagtacgaacaagagcatccttttacccttactgaaacctatgtggtcactaaaacatatatcaataatatttttaacctggacaaaattaatctagaaaattgagctactgttttttatttgtcagcttttaccacattgtgggtttgagacacaggtagttcttttgatagtacagcgttaatttaaaatataaaaatcatgccaaacacatctaattacttttagcttccttcacagtaggcggaggaaggtgaaaaattaagccttttgcgccacctagtggccaaatgggtagtggctgtctagtgagaaaaaacaaagatttgggggcgtgaaaaatagcttgacagtgttagtattctgaattcagggtatgaggttggaagaaggcaacaacaaaaaagaattttcagagaaactggtcacttaagtgcataggtacctgagagtgagcaattgttataactttgatatctcaataaccagagtgacaataaaacatttgaaaataaacataaagaaggtaacaattataagaaactttaggtgtttcagaagcaaatggttttttgttgttgtttgtttttaaaataatttaaaaacttgatgctatcagcacaaagcactaaaagttatcaaggtattaagtgagagcattctgataagaaaccaccgctagctgggcagattatgctaaagggaaagaaaaagttttttctctgtcttaagtgtagagtgtatattccaagatcaattttaaattacaaatcctctccttttttgcttattaattcgaattcatcattacgtgtgtgttttacagaaatacatatatagttgaatgacaattttgtttaaaactttccactttagttttaaaacgtagttaatcttatcaatacaatacatgaatgtatatccacactaagtttaccaccttaatttgagttttgcaaaaattaaatatggacaaaggtatatatatagaaagccacttagtgacccaataatctttctctctatgatacacttaagaattttttagacaataaaaagtcacttattaactagctcagtgaaaattagtccaaagtaacaaaatcatttgaggctgcaaaacaacaatatcactattgatattaggagtttttcaaagaggtaaaattctaaaatttttacatagagtgcaagctaagtagctaagtcaaatgacttgcaatatttttctgaaattcacaagagccaatagtttaaaaaaagcatctcataacatttaattaaaaatatacattttcatttaagtttgcttcccacaaaccactgacacactcattgacacagtgaatgagtctagtgacaagaaacaaatcctttttgttaggtcacttctaacactctgcctccaacaaaataaagaggacctattcaagctgtcagctattatatcatttaaagtaattttgggaaggaggccaggcaggaggatcgcttgaggccaggagttcaagaccagccctgggcaacataatgagaccctgtctctatgaataataataataaaattagtcaggcatagttcgatgtgtcatagtcctagatactctgaaggctgaggcaggaggatcacttgagcccaggagttcgaggttacagtgagctatgatcgcaccactacactccatcttgggtaatggggccagccaaacaccacagaaaaaactgcgactccacccccaccagctaaggtcaaa

SEQ ID NO: 1311 - DNA, 207558 bp, Homo sapiens
gaggccaaggcaggtggatcacaaggtcaggagttcaagaccagcctgcccaagatggtgaaaccccgtctctactaaaaatccaaaaattagccaggcgcggtggcaagcacctgtaatctcagctactcaggaggctgaggcaggagaatctcttgaacccgggaggcggaggttgcagtgagccgagatcatgccactgcattccaccctgggcaacagagtgagactgtctcaaaaaaaaaaaaatgtagattctgatccagcaggtttggtgtagggccagaaattctgcattttcaaccagctcccaggtggtggccatgctgctgtctgtggactccatttttgttattatttttgttgttgttgttgtttttattttgagatggagtctcactctgttgcccagactagagagcagtggcgcgatctcggctcactgcaacctctgcctcctgggttcaagccattcttgtgccttagcctcttgagaagctgggattacgggcgtgcactgccatgcatgggggtggagacagggtttcaccatgttggccaggctggtcttgaactcctgagctcaagtgatccacccacctcagcctcccaaagtgttgggattacaggcatgagccactgtgcctggcctgtagattacattctttttttttttttctgagactgagtcttgctctgttgcccaagctggagtgcagtggcgcgatctcggcaacctccacctccctggttcaagcgattctcctgtctcaccctcctgagtagctgggactacaggctcgtgccaccacgcccggctaattttttttttatttttagtagagacagggtttcaccgtgttagccaggatggtctcaatctcctgacctcgtgatcggcccgcctcagcctcccaaagtgctgggattacaggcttgagccacccgcgcctggtgattacattcttaatagcaacattttagagactctctgattgtggtggttattaatgctgttcagcagccatttctcaccctgctttctgacatatgataggattatacttcccagcttgtgtgttaggtggggccaagtgacttgttctggctaatgagctgtgaacaagagatgcatgtcactcccaggactggacagttaattgctggttccagaccctttcaaggtctctttccctttgccatggcaactggcagtgtttcggtgtctgctctagcagacaggccctgaagtgaggatggcatggagcacagccctgtgctgacctgtgatggacttgcagcgagaaaaagacatacagttttgttgtcttaagtcatgagatttggaagggttgtttgtgactctagcctaacctagcccattctgactggtacgccaatctaacccacattttataaaagaagaaactaagcccaggaggagtaacttgtctgtgctctgatacctgcttaatgaagtctcagggctctgacttccaatctcctttccatcagttactgtctttaccactcgggtctcctggaaaatgtgccaagaacttcgtatgtgttatttccttttctttttacagctctttgaggtcaaaaatcatgggccaggtgcggtggctcatgcctgtaatcccagcactttgggaggccgaggtaggcagatcacctgaagtcgggagttcgagaccagcctgaccaacatggagaaaccctgtctctattaaaagtacaaaattagccgggcgtggtggcacatgcctgtaagcccagctacttgggaggctgaggcagcagaatcgcttgaacccgggaggtggaggttgcggtaagctgagatcatgccattgcactccagcctgggtgacagagcgagactctgtcccaaaaaaaaaaaaaagaatgagtttatttttaatttttttttttttgagacggagtctcgctctgtcgcccaggctggagtgcagtgacgcgatcttggctcactgcaagctctgcctcccgggttcacaccattctcctgcctcagcctccggagtagctgggactacaggtgcccgccaccatgcctggctaatttttttgtatttttagtagagacggggtttcaccatgttagccaggatggtctcgatctcctgaccttgtgatctgcccgcctcggcctcccaaagtgctgggattacaggcatgagccactgcacccggctatttttaatttttatttatttatttattttcaaatttttctgagaaggaatctcgctctgtcgcctgggctggagtgcaatggcgcgatgtcggctcaccgcaccctctgcctcctggggttcaagcgattctcctgtcccagcctcctaagtagctgagattacaggcatgtaccaccacgcccggctaatttttttttttggtatttttagtagagatgggttttcaccatgttggcaaggctggtcttgaactcctgacctcaagtgatctgcccgcctcgatctcccaaagtgctgggattacaggtgtgagccaccgtgcctggctaccatatataattttcatttgcttatttagattgcaggtacttttccacatgacacaaatggtccaagttaatttagagaccgaggtgttctatgcagccagcacaatgtgattaagaatttttttcagcctgaaaaaaaaaagaacattcttttcaagtctggaaaaaaataatttatttctaacaagcctggaggacccagatgcagagaagccgtgggcctctggccttgcgcccttcttgtctttgtacctctcagtcctttctttgtttgaggtgatggttctgctgcaggcttgactgcctcctgcccactgcttgccacttctgggctttgattttttttgaaatggagtttcactcttgtagcccaggctggagtgcaatggtgtaatctcaactcactgcaacctccgcctcctggattcaagtgattctccagccttgcctcctgagtagctaggattacagggatgcaccaccatgcctggctaatttagtatttttactagagacgagggtctcaccatgttggccaggctagtctcgaactcctgacctcaggtgacccatctgcctcagactcccaaagtgttgggattacaggcgtgagccaccatgcccagctcacttctaggctttgtatagaagttgttctcaagccctggacaaaagctccttgccctctaggcctcgactctccttgtcacacactccctgtgttttcagatatcctgaaaccctgtgtcctgggtctgtcctgccagacatgcaggtactgggctcactgggggtttgactcagatcctaacagctcaggaggtgggctggggcacagaggccagtgggtttctgacatggggacagggtggggacccttgacagcaatagccctgtttctgctctcccagacgttacagggttttattcccctgcattgaaaatctggggaaatttatggttaaaatatgattgttgggttctgactgggttgcattctagtctcttgcttttggggtttggcatgcaactatctctttggaagtcaaactttgtttcttatctcaacacacacacacacacacacacacacacacacacacacgcaggcacgcacacactagaaaagaattgggaaaatgcttaatgttgcaaatgcttgaaatgagaaacaagaacaggactgccaaggcactcccgagctctgtgcatgggcaggtgactaagacagtgtttagagaggaactgaggtctggtggacaaacatggagttctaaccacagcccagttattagtccacaggaaacatcctgttactattataaagatgaagtgctactttttttttttttaaagaattttctaaaagtcttcctttccattctgattcagttcagtctgtgaggcagaaaggtctcagggcagccatgcctgcaacattagctaatcagactcccaagaaacattccattccgcttaggagggctttggagaatggtttgctcatggtggcttttaaaatacactgagggttgccaggctgaatgggatccctgcggggctggtgacctggttctaggctggtgctcagcagagctgcctcctggtgggttagtggacttgttaaacatagttgcctctcctattccctgttcttgggggatgaagaagaaagtcttgtactctatcccttcccattctaaaattggggtaacggaggcccaagagagtaataatataagaaataagagccaacacagatcactttatgttaacttgtctacaaatgtcaaggggaggaacatcatggcatagtggcaagaaagatatagttttagatcctggtttttgccagtctgaaactgtgtgaccttgtgtaagtaagtaagcctgagactcagtttccttatttgtaaaatactgatgatgatgcctattatacagcattgttgtaaggagtagaaataatggatgtaaagtacctggatgagtgctggcatccagtgggtacctgataagtggtctgtatttatttatttatttatttatttttgagatggagtctcactctgtagccaaggctggggtgcaatggcacgatcttggctcactgcaacttctgcctcctgggttcaagtgattctcctgccttagcctcctgagtagctgggattaccggcatgcaccactacgcccagtgtgtttttgtattttcggtagagacagggttttgccatgttggccaggctggtctcgaactcctcacctcaggtgatctgcacctgcctcggcctcccaaagcgctgggattacaggcatgagccaccgtgccctgccttctttcctttttttgagatagggtctcactctgtcacccaggctggactgcagtggtgcaatctcggctcattgcaacctctgcctcccgggctcaagtgatcctcccaccttagccccccaagtagctgagaccacagggatccaccattatgcctggctaatttttgtattgttttgtagatggggtttagccatattgcccaggctggtctcaaactcctgagctcaagtgatccgcctgcctcggcctcctaaagtgctgggattacaggcatgagccaccatgcccagctgtaaaatttttccttttagagaacagggtcttgctgggtttgccagactggagtgcagtggctattcataggcaatgaccgtggcatactatagcctggaactcctgggctaaggtgatcctcctgcttcagcctcctgagttgctgggactacaggcacccagcagataaacaatgttttgtaatcatgcctgacagtaagaattttccaacggctagttaaaaatacagattccctggccaggtgtggtggctcacgcctgttatcccagcagtttgggaggccgaggtgggcacagatcacttgaggtcaggagttcaataccagcctggacaacatggagaaaccccatctctactaaaaatacaaaaattagccaggcatggtggcgggcacctgtaatcctggctactagggcagcagaatcacttgaacctgggaggtagaggttgcagtgagccgagatcgggccactgtactccagcctgggtgacagaacaagactttgcctaaaaaaaaaaaaaaaatacagattcccaggcttcaccctctacagtctatggaaaggcatgggaatctatattataacaagccattgagtttctttttctttttctttttttgagacagagtcttgctctgtcacctaggctggagtgcaatggcgtgatctcagttcactgcaacctccgcctcctgggttcaagttattcttctgcctcagcctcctgagtagctgggattataggcgtgtgccgccacccccaactaatttttgtattttttagtagagacagggtttcaccatgttggtcaggctggtctcagactcctgacctcatgatctgcccaccttggcctcccaaagtgctgggattataggtgtgagctggcactgggtggcttctatgaggaagttttggaatgcatccaggagccctccactccaggttcttggtttattagccttttggtcctctatttatctagccctctgttcagtaaagctttaggtttgtttgaaggagacatgattagaaggtcaaatattgtatattctcaaggcgaatgtgtcctgaactttgcatagtagaatttattcctgaaaagttgtttgcagatggaatttgttttgtgcgtgagagaacaggcatatacagaataccttagtttgctatttaatttaaatcaatattatctgagtgactgttatttgctgaggatacaatgataaacaagatgcagaccccatcttcaagggtcttagagtccagcgaggaaggtggtcaaataaacaggcaattacaaaattgtggttagataaggttaagcacagggagctatggtggatggaggaggaagtgcacccaactcagtgttggggcatcttggaatttctaggtgaagtgacatgtgatggagaaacctatagactggaatatagtctcaaatccattgcaaagggaatgatccttccccaacttatcttcgtggaaaaataaactttctttctttcttttttttttttttttttattgagatggagtcttgctctgttgcccaggctggagtgcagtggtgcgatctcggcttactgcaacctccgcctcccaggttcatgccattctcctgcctcagcctcccgagtagctgggactgcaggtacctgccactgcgcctggctaattttttctacttttagtagacgggatttcactgtgttagctaggatggtctccatctcctgaccttgtgatctgcccacctcggcctcccaaagtgctgggattacaggcgtgagccaccgcgcccagccgaaaaataaactttcacatcatgttacccctggatacatttttgtggccatgcatctgcacgaatattcaatccctgctacaggcaagacactgagtgggacgttgcagggctaccaaggtgaggaggtcccaacccctgtcctcaaggagttgatgtaacacctacccaggattaatttcatttctctcagaggtcattaatccagtgtgatctgtttatggctgaagaggtagtttattattcaggtcttcactccctttcctgaaaaggctgtttattttgtttcatcactgtgcagtggcgaaatccagttccaaccaatacttaagctgggcatacattttacccaggagaaaactgaagggcgtgcaggagttcacagagctgtttgctgacccaagccatgaatctgtggagacctgggtcggtcttcagggttagtagggtctgtagggtctgtgaggatccgaggcagcctgcagacctactatcatcttctttttcttttttataattggcaatcatccttggctacccagtagcatcttttttttttttttttgagatagagtttcactcttgttgcccaggctggagtgccatggcgcgatctctgctcactgcaacctctgcctcctgggttcaaacgattcccctgcctcagcctcccgagtagctgggattacaggcatgcgccactacacccagctcattttgtatttttagtagagacagggtttttccatgttggtcaggtggtcttgaactcccgacctcaggtgatccgcccaccttagcctcccaaagtgctgggattataggcgtgagccactgtgcccagccccctggtagcatcttaaatcaagctttccttccctctgggtatcatggacatgaacaccttttatgtctctgcctcaagaggggaggaggcacagaggaacaaaaatccttgtgaattatgataattacatagtgtttaaatgaagggtggcaaggtgtgtaagtccataggtaaggtttcttttttctttttcttttcttttttttgagatggagtctcactctgtcacccaggctggagtgcagtggtgcaatcttggctcactgcaacctccgtctcccgggttcaagcgattctcctgccctcagcctctggagtagctgagattacaggcacgccatcacgcccagctaacttttgtatttttagtagagatgggttttcaccatgttggccaagctggtctcgcactcctgacctcaagtgatctgcctgccccggcctcctgaagtgctggggttacaggtgtggtgtgagccaccacgcccagcctcttcttttttttttttttttttttgagacaggttttcacgttattccccaggttggagtgcagtgttgccatcttggtttactgcagcctaggttcaagccatccttgtatcggcctcccaggtagcttagtctacagctgtgtgccaccacacccggctaatttttgtagaaactgggtttcaccccgttgcccaggctggtttcgaactcttgagcttaagtgatctagtcaccttggcctccggaagtgctgggattacaggcgtgagccatcgtgcggcctggcaaagtttctttatcctcagtgcttgtctgggtgtgttgtctggtgggaaccacttagaccctgtaagtgaatgtgtattcccatcttgtagatggtaacctgaggcccaacgggtgtctggaggtagtgttggacacctcgtggtctgcatcttgctgcacacagaatccagcctagactcattatcctggcctttgaagtctcccccagtatgaatcccccagcctcccattcctgtttctccgaaggccaagctcgaagcatctgctgcctcgtttctgccaagttggccccacctcctgagacacttctcccctctactggcctggtgaaactcaacacatccttcaaagcccagctcaggtgtcacctctctcctggttggaattaacctcttcctccttagcactctctggtttggccctttctcttgcggcttctcctgggcaagtggcatagcctccctgatcctagtgtcttcctctgtgcatgggcacaggagtaatatctgctgtgatctttaactcctgtcagttcattgacctctttaacaacgtgatgaaagcttccagaagagctaatgtatgtggagtcccacgatgtgtcaggctaggtgtttaggactttactaactactgtctcgtttaatcgcgaatgcagtggacctctctctccacacgtcctagtacgatctttatttcacacgggaggagaggagggtgggtggggtcggccagagaggagaaatgcgtctccagagttcacagggctggtactaccagcagagccccgtccaccatatgccacagctggggttctaatccctggactggcttgtactgggctctctgcctccctggccggcgctcgggggctgggggacagaacacaatgtacagcgtgccttctacaatttcggggttcacgcacccccaagcccacccagggccaggtcaaacgcgccttcgccgggttgctgtctacaatcaggcttggctgcgctctcagtaggggtctcggtcaacctctgcccacccgaacccggcgccgtggacctggtgtgaggctggggagcccgtcctgaggggtgccggctcgaggcgctagagccacggagcctggtcccgggctccaagtcccaggaatgtgggagggctgggcggaggggcgggcgaggcgggagcgcttcctctgcccgcgggaggggatccgcggccggctcggagggggcgggggcagcggcgggcggcggcgaggggctgcggagctccgcagccgccgggccggccggggcgggaggaagcgatgaatattcagagggggaggggaagggagggggccgagcgctcgccgcggctccctgcagcagccccagccgcatgacgcgcggaggaggcagcgggagcagccgcgggagccgggaccgggtagccgcgcgctgggggtgggcgccgctcgctccgccccgcgaagcccctgcgcgctcagggacgcggcccccccgcggcagccgcgctaggctccggcgtgtggccgcggccgccgccgccgctgccatgtctccggggaagcccggggcgggcggagcggggacgaggcggaccggctggcggaggaggaggcgaaggagacggcaggaggcggcgacgacggtgcccgggctcgggcgcacggcggggcccgattcgcgcgtccggggcacgttccagggcgcgcggggcatgaagccggcggcgcgggaggcgcggctgcctccgcgctcgcccgggctgcgctgggcgctgccgctgctgctgctgctgctgcgcctgggccaggtaagcgccgggtgggctcgggcggggggcaggaggctggggcgggactggcattgactgcacctgcccgagcgtacccccccggggggttccggggaagggggcgggggtccggatccccggatccccggaaggcgacttgcggggaccccggccggcctcgcacgccggcgatcgatcccttttccggctgcccaggatcgggggagagaggcgggatccgggtgccgcggtgcccgagcctcccggggaaagcctccgcgcgggctccaggccgtccctggcccggctcttcccggcgctgggcacatctggcgggcacgggcccggcttcctagccggaggcggccggagggggcgtgtttgcggaggtctggggacgcagagccgggcggcctggctgagcctttgccgacagacctccgacccggcctgcaggggcccgaggggcggcgggggcgacagggcagggccaggcgctgggcagtggggccctgggcgaggcgcgggactccgggccgagggccctgttcctggggaaagttcccaggccggggaaaaggtggccgcacgctggcttttctcaaggcagccggccctcttggcgtcgtgcttgatttcatgggtgtttaattcgtgctttgtgggcgctggctccccctccccaccccaccctcaccctcttttctggcttcacttttcagataatgctgtccctggcgttttggtgaccgacctttccccttcctggcatttccataggggctgaggcagagcagctgaaggggcattcccatttcacagatggggaactgagggagagaagtgaaatagcggagcacccagcccgtgccatgggagctgagccagcgggcacgtcctcttagcctctggagcctgttggggtttgaacccgcaggggaagcggtctagggctgccttgctgtgcgtttctgcaaatgaccatcttgcttgttttatacagacaccatctctgaggaaatgagttattggctggggatggaacctggtttcagggaaaacttctccagcgcgaatacaggagagagcagaagcatcaccctggggcagcaatgccgcctagcaggctgtaggagaagggggctggggcctgggggctgcgtgaccctcggcacccaagggtctctcctcgcagtttccccagcaggttctgcacaggctctcctgggggccagaaggcaatgtgacctcctgcagagaacctgggagtagatgtcaggagactggctccagggccgggccacagggctggacttgctcttcaggcttctctaccctcagttaaccgcatctgtagaatgagtatagcaccctctgcccaatggaattgtttgaggggcttccactggccaatgtctaaaagaactttgtaaatattaagggtttccacatgggattctcattattaaggtacagtgcctgtgggggctgtcttctccctgtccatgtaaggaaattcagggaagcagtgtctgaagttaaaaaagccttgtatttgaagatttcttgtatcaaaagtttatgctaaaacaaaaaccacaaaaaacagaaaacccccaaacttaaagcttcatttatttttaaatgtataatatatgtaattttttttttgcttcagcaaaaaaattttaaattatatatatataaaatttatttatttttgctccagccatagtggttgctagctgtgttctcaatcagcaaaaagtttcttgggtaaatttattgcttgctcaatccttccttgtatttcattagcatattgccactctacacttgtcctgtatttagatatttccttcctctatggtttgttctgtagaacctcaaaaggactctcttatttcttttttttttggacacattatgaaataggaagtctaaaaggctcccagaagaagcatcttcaaaatccacattcagcagttcattttgataatggatatttcagggaatcagtgcatttttgagctggaccagactttcaagacagctgaaacccctcagagctcttagatgaggatattgatgtccagagaagacagggagcaggctgaggtcacccagcaaggtattagagaagacaagatgggaacctgggtcaccggcctgggcctcatattttcaaagtgctatttttttttttcccgtgttttcactttgatcttacttttaatgatagggacgtatcactgtgtcttctcaaaatggtgggtgtgaatggaatttttcaaagttgaatcaatttgagatatttctgaagtttgtttaggaaacaagtatgtgactaccttcctaagagctgactggttttttgaggcctggattgtgtgtgtatgtgcttatgtgtgtgttataaaatggaatcaactataccaggttaaacaaatggacaagtcatggaaaagacacagctctgtttggacattaataagggcgggtgtggaagctggaaagctgagatgccggaaggctcagtgcttagtaggcccggaaaagcaatttttgaactggcatctcattccccttttctaagacaggaaggacggtcagagatgattccaacatgaggactttgctagttgcagtgtctgactcctcccattctcatagcagttttgcacagtagttttggtttgtgtgtatgttttaggcaatgtgacaaagcagttttcctcctgcctccttgagaaatttaatcctgacaggttctttaagaaatcagcttgatgtgggctgattttaaaagaataaatgaaaaaaaaaagctggtgactgatagctgttttattggtcttgtagtgttttggttttgttttatcttcactttcttgtttcctggtgaataataactgggtttattatctctcatggctaatccttaagcctgattccttacctgttccatccagagtacaaagtatattttgactcctctttaaactgcttgttagattctcatatgagtgactttaaatatttttgttttgcttcaggacaacgggaaaaccaaacgattatgttttgtttgcagacagtttacgaaaacagcaaattggtttatggttagaccgtgactttgagctgacttcaagttgggccccacgataaagataaccatggaatacccaagctttcctaagcagagaggatcctggcttccaaatgagcaattttggtcagcaaaggggttatttagctcctaaaagtaatttttgcttgaggttggggctgaggcagagtggctgaacaaccgtaggcctgggtgtagccagaggatcatcagtaattacttctcagttcattcacttcttgggctagggaattattttgagtgcaggataagaggcaattttctgtgtgtttcccttctaatataatgccactgatgatattataattaataggtaacattatgcatgacaggcactgtgtgctaagggttttaatgcattatttcatttggccatttcagaaataccaagaggtaggtgctgttcttgtttatttgtttgtttttttttttgatagggagtcccactctgtcacccaggctggagtgcaatggtgcaatcttggctcaccgcaacctccacctcctgggttcaagtgattctcttacctcagcctcccgagtagctgggattacaggcgtatgccgccatacctggctactttttgtatttttagtagagatggggtttcaccatgttggccaggctggtcttgaactcctgaccgtaggtgatctgcctgccttggcctcacaaagtgcagggattataggcgtgagccactgtgcccggcctttttttttttttgagatgaagtctagctctgttgccaggctggagtacggtggtgtgatcttggttcactgcaacctccgcctcctgggttccagggattctcctgcctcagcctcccaagtacctgggattacaggcacgtgccgccatgcccagttaatttttggatttttattagagacagggtttcagcatgttggccaggatggtcttgatctcctgacctcatgatctgcccacctcggcctcccaaagtgttgggattacaggcgtgagccaccgtgcccggcctgtttttgtttttaagagacagggtcttgctttgtcacccaggctggagtgcagtggtacaaacgtaattcactgcaatctcaacctcctgggctcaagggctcctctcgttttagcctctcaagtatctgggactaaaggcgtgtgctaccattcctggctaatttttttttttaatagagatggtgtctcgctatgttgcccagtctggtcttgaacctctgggctcaagtgatctgcccaccttggctccccaaagtgttgggattacaggcatgaaccactgcacccagccatgtttttattttatctgagagaaaactgaggttcagaacttaactgtatacttctggaatcttcacagagaaataaaaaaaaagaaaaataatttactatagattcattaactactacgtggcggagccagggctgatgtctccactgccccaatttaccatcctgtgctgtaaaaagtcatggagaaggttttctgtgtgcagctaagagaggaggtggcagacatttatttatttatttatttatttatttatttatttatttatttattgagacgaagtctcactctgttgcctgggctggagtgctgtggcacgatctcggctcactgcaacctccatctcccgggttcaagcgattctcctgcctcagcctgctgagtagctgggattacagacgtgcgctaccatgcgcagctaatttttgtatttttagtagagatgaggtttcgccatgttgaccaggctggtcttgaactcccaacctcaggtgatccgcccacctcggcctcccaaagtgctgggattacaggcctgagccaccgcacctggcccagacattttttagacagtcttgctgtgttgcccaggctggactcgaactcctgggtccagttgacatccctcttcatccttccaagtagccaggactgcagggacatgctacctttattttgggttctttgtgtcctaaaccctgtatgatctgctccatttgtaacacagagaacccaggtgccctctttcctgcttatatttctttggggcctcagtttacaaggcaagtctgcctttgtggagatagactggggtctgggatggaaagacctgggtttgggtctttgctctgccactgcataaactcagcaagtcacttaacctctgtgacttctcatttccttatctggaaaatgggactaacacttcctgcttcactgggtggttgagaggatcaaataagatagaaaaggaattgctacgtaacacctaaagcaaggcccaactgctagttgtggctgctgctgttacttggagagaagaaatgaggccccagatcattagttcatatgacaattttttctttttttaagacggagtctcactctgttgcttaggctggagtgcagtggcgtgatctccacttactgcaacctccgcctcccgggttcaagcaattctactgccttagtctcctgagtagctgggactacaggcacgctccgtcatgtctggctagtttttgtattttagttgagacggggtttcaccacattggccaggctggtctttaactcctgacctcaggtgatccacctgccttggcctcccaaagtgctgggattacagtctgagccaccacgcctggcccatatgacaaatatttatgaagtgttttccacagagtagtatggaataactctgggtgtgtgcaagatgaactgagctcagtcacaatacttttttttcccctaatgttaagaattattggctgggcagggtgactcattcctttaatctcagcactttggaaggcagaggtgggaggatcaggtgagcccaggagtttgagaccagcctggatgacaaagtgagaccttgtctatacaaaaaattagctgggcatggtggtgtggacctgtggtcccacctacttgagaggctgagttgggaggatggcttgagccctgggaggttgaagctgcggtgaaccttgatagcgccactgcactccaacccaggcaacagagtgagaccctgtctcaaaaagaaaaaaaataaaaaataatttattttagggggtcttagtaaagaaagacccccaaaagtccatgattttataggtcgaatgaggtgaaaagtggtatcatgataaataaatttgtttaaatatcataaaaagttggtctaaagaaaaacattgggtaaataattatgtgagtatgatgtggttatgaccaaattgtaaagatgatcagtttcttaagtctgggggacaggcactgagcagaggccgtggtggggaacaggagcctgtcttcatggctcttactggccactgggcaagactcagatagcaccaaccaaccagtcacagttgtgatgtaggatgtgactgtgaatgacatccctgctgcccgcttcagagaaagggctgccacttgccagagaaggaatggtgataatgagggacagccagtccctaagtggagatccctgaaagtggtgaatatcttagaccagagaagcccagagcagtttttttaccaccttgtatggctggttttccagtggctttactggtgccccctcggaggacaggggctgtaggaagtttgttattacttccttattagtgacagctgcagtcatcctattgtctcagaatttccctggcatgtaaatggtaggataaggggtggtggtaagcagatggggggcattttgaaaacgaggcagtgtcagctcccacagaaggtctaattttaaacatgcaaataattttcagttccacttttccttcttcctgttagagggaagttgtcccctgttgccatttctgaaacttgggcggacaatgtcgttattgtgttacaaacgatttgcgtctccagggcaggagttgggtgatatttttctgggagcctgtgccagggcgtagcccagtgttatctcatggtttctgagtgaatgagtgagtgagtattaaaacttcatatcaacatggagcctataacacagtggttctgaatctttcttgggggggaaaagaagagatacaagacccctagagagtatagagagtatgtaaaagggaagaatccttccccaaaagggaatgcacatatttacaatattgtatccaatttcagaaggtttttttaaaatttttaattttattgttttttttttgagacacggtctcagtttgtaccccagcgtggagtgcagtggcatgatcttggatctcggctcactgcagcctctgcctcctgacctcaggtgatccacccacctcggcctcccacagtgctgggattacaggtgtgagccaccatgcctgaccatgactagtgttttgatgtgtggatttactacaatttatttgaccattctcctatcaatggacactttagttgttttagtacacctccctgtcccgtcacaaatcatactttgtaatgtttctggtggatatttcttgtaaccttcacaagtttatctgtagagtaaatttctagtttcaggattactggattggaagatgcatgcatttaaaagtgtgattgctgttgtcaggttgtcctccaaaagtgtcccctcagtttgtacctgtatccataggtttggagagtgtctgtttctccataccgtctcatctgaaatgaaaatttttacatgtttgctagtctgaaaggtgaaaaattgtatcttgttttttttttttttttttttttttttgagacggagtcttgctctgttgcccaggctggagtgcagtggcgctgggctcactgcaagctccgcctcccaggttcatgccattctcctgcctcagcctcccgagtagctgggactacaggcgcccgccaccaagcccagctaattttttgtatttttagtagagacgaggtttcaccgtgttagccaggatggtctcgatctcctgaccttgtgatccgcccgcctcggcctcccaaagtgctgggattacaggtgtgagccaccgcgcctggccgtatcttgttatttttatttatatctttaattttgagttagttgagttttttggtcatttgcctctgcttcttcttctttttttgttttctttttttttttgagacagagttttgctcttgttgttcaggctggagtgcaatggcgtgatcttggctcactgcaacctccacctcccaggttcaagtgattctcctgcctcagctttctgagtagctgggattacaggcgtgtgccaccacgcccagctaattttttgtatttttagtagagatgggacttgttccttaggaaccatgttggccaggctggtcttgaactcctgatctcaggtgacccacctgcctcggcctcccaaagtgctgagattacaggcgtgagccactgtgccaggccccattttttgttttttggttaactccctgttcattaaaaaaaaaaaatctatatctatagatagatagatatagatataatctttgttatcaatttgtataagctctttggaaattagtccttcgattgtcatttgtattgcaaacacattccccctcccccatgccaattattttagatgtagcacttgttccttaggaactcagagataaataagaccctagggtggtgaagagagcatagaatttggaacaagactcctttgttggagtcttggctctaccacctcattagctgtgtgatcttgggcaggtatcttgacctttctgatccttgctcttcatattccaaaaatgctaataataggagtacctctgacacagggtagttggagaagctaagtgtgatcatattatgctaaaattccttgtaaatggctatggaaacataaacacagcattttataaaataccacgaggtattccatttactgaagagttacatcagaagagtatttctgattgtgccactgcactccagcctgggcgacagactgagattccatctcaaaaaacaaacaaacaaaaaactagccagtcatttataagaatgagttacagctataggtgcaggcggtaaatactctccaagatatctaaataaattaaaaggctatgtagagaacaatgtatatataatgttacctttaaagtgacaaaaaaaggtgaatatagatacttgtgtatcagaagagagaggtattccatttactgaagagttagggcaaagaccataatattgtaattatcaataattatgaattgtcaaaattatgtcatgaaacctctttttttcttttttttgagggggagtcttgctctgtcacccaggctggattgcagtggtgtgatcctggttcactgcaacctttgcctctgaggttcaagtgattcttctgcctcagcctgggattacaagcatgcgccaccatgcctggctaatttttgtagttttagtagtgacagggtttcatcatgttggccaggctggtctggaactgctgacctcaagtgatctgcctgccttggcctcccaaagtgttgggatttttttttttttttttttggagacggagtctcacccagtcacccaggctggagttcagtggcgcaatcttggctcactgcaagctccacctcccgggttcacgccgttctcctgcctcagcctggctgggactataggcgcccgccactatgcctggctaatttttttgtatttttagtagagacagggtttcattgtgttagccaggatggtctcaatctcctgacctcatgatccgcccgcctcagcctcccaaagtgctgggattacaggcatgagccaccgtgaccggcggaaagtgttgggattacaggtgtgagccaccgcgcccggccccatgaaacctcttatattgggtttgagattaaatccacaatggattgtgtgtattatatatacacacacagacacacgcaaatgtattaaaatgtataatatgaagcagtggaacttccctgatagcacaatttaaatatttcctttttgacaaacgtgcatagttaaataaattaagtgaccaccaggtgtgactgaagagtggccagtgtctattcctagccccgaaggagcacagggatattgactgtgtcccttaaaaaaaacaaaacaaaacgtagggctttctttgtattggtttgaacatttctctttatcttgtgacctggccaactctggctatggctgcctcctgtctctcggtacattttctgtggcggtcaagaggagttattttaagccaccaatgggaaagtttaaagacataatccttggctgtaattgcgggagacgggaggctgagagtctgtgctgacttgccacctgtttccacggcagcaaggtgattgtgcatttcctgctgctggctgaggggccagcaaattttcatgtcgttgtgtcatggggaagttttcctgtctcaatgagagcacaccgtgcttgtggtcttgttcctgtgaccaggacatggagaactatggggagattgttctgggtgtgaagggaaattgctggccagtgcttagtgcacgggctttggagtcagagccaacttctccacctcctacctgtgtgaccttgggcctatccttctaatgcttggagtctcttctgtcctcatctgtatgatggggataacaagaatacctactttataggattgctgtggaggattaaatggatctgcatgacaaatgcttagcatgaaaaaatccctcaacagatattggctgctattttattatcttattgtgctgagacactggcataatttacaattcaaaaattaaatttttttaatcttatactgtagtttacaaggccctttcacatatatgagcttgttcaatcctcacagcgtccttgagtttgtcattgttattgccatttaaaaaggtatgactcagagtggctgtaattgacttgtccaattcaggtttcatctgtcttttgcagaataataatcatgtacgttcatagtataggccacctctttttttttttgttttttaagacatagtctcgccctgtcacccaggctggagtgcagtggtgcgatctcagctcactgtaacctccgccttctgggttcaagcgattcttgtgcctcagcctcctgagtagctggcattacaggagcccgcccaccatgcctagctaatttttgtatttttagtagagacagggtttcaccatgttggccaggctggtctggaactcctgaccttgtgatctgcctgccttggcctcccaaagtgctggaattacaggtgtgagtcaccgcgcccaagtataggccacttttaagaattactcagagttagcttataagaggcgaatcagtggagtcctccagtttggttcacacataattattaggttgaaccatataaagttactgtttttggtcctgtgaatattagtatttatatatggttccaatctgatatgttccagaaaatacacacttaagtaaagtttggaaaaccaaatcatagacttacatactgtaaggcggtgtatttgaaactgggatgtaaaatcaatttagtgagttatgacctgcattaaaaaaatggtagaatatcagagtttgctggtaagtattgtaaaaataccagagtttgctggtgagtattgtccatttcagttatatatgtgcgcacgtgtgtgtggtgtgtatgtgtgtatactaaattgcatataaaatgaatttcttatcatgggttcacctgttgccagaaaacactggaagtcactgttccagggaatggaatggtggaagatgcctggtgggggatggaggtggattctgtttccagacacagtaaaaaaaaccagtataaagtccccaattatgcattgtcagtgtctctatgtgtagctggaaaccattcctgcagcaggtaagcaggaagaaccaaattgtcgagaggcacttcaggaagggaagtgggccgactgaaagctttggaggcctgcctttaagtagctgcttttctggaaacttcagggtgaccagcctagtgaacaagctatgggtcagcgttgtgtgttcctttggtaaatggatttggtagagagctaacactactgcatttgtagtttatttgtttgtttgttttctttttgagacgagtctcactctgtcacccaggctggagtgcagtgttgcgatctcggctccctgcagcctccacctcctgggtttaagtgatcctcctgcctcagcctcctgagaagctgggattacagatgtgcaccaccacacccagctagtttttgtatttttagtagagacggggtttcatcatgttggccaggctggtgttgaactcccgacctcaagtgatcctcccatcttggcctcccaaagtgctggggctatagggctgagtcaccgtacccagcctgcgtctgtagtttaaatgataacttaatgaccaccatccagtagctgaggctctaagagggaggtctgaatagtgggtgactcagctcagccctgcctgacctctagctctaggctgtgctgtctctaggctccggcactgatttgcatgggcctgaatgaaccttctggagattgttagcccaactggctgaaggatcctgatccccaggttaatttgattcccatcaaacagttcatttttttttttttttgagaggcagtctcgctctgttgcccaggctggagtgcggtggtgggatcttggcccactgcaagctctgcctcccgggttcaagcagttctcctgcctctgcctcctgggttcaagcagttctcctgcctcagcctcctgagtagctgggactatatgtgcaggccgccacacccggctagttttttgtattttagtagagacggggtttcaccatgttttccaggctggtcgtgaactcttgagctccggcaatccacccgctgcagtctcccaaagtgctgggattacagttgtgagccactgtgcctggcctttttttttttttaatataaaaaaattgaaaatacagataaaaggaaacaaaattacctgtaatctccactcatccaggttaactcctggtacctttttgatgcgatttctttgtctttttaaatgcatgttctgtctatttatactacaataggataacctcctacatgtgctttgtaacttacatcttttaatttttaacagttgaggtgggccgggcaccgtggctcatacctgtaatctcagcaccttgggaggccaaggcaggcggattgcctgagctcaggagttagagaccaccctgagcaacatggtgaaaccctgtctctactaaaatacaaaaaattagtggtggtgcacgcttgtggtcccagctgtttgggaggctgaggcatgagcatcacttgagccctggaggtggaggttgcttgagtcctggaggcggagtgagccaagattgcgccactgcacttcagcttgggctgcagggtgagattctgtctcaaaaaaataaataaataaataaataaaataaaaaaacaattgaggtggatgtctccctaggggtaccccaggaagccacaggataaaaagcaggcatcttgctggagggtctctgttgctcagtagaaattattttgtaatgttttttgaaaaccacaaacatggacatattatggactggataccacatttgcatcaggatttttttttcaaccagtacagtacataacaaagaaatctctaccctgcagaccctctgggggtgtgagagcgctccttgctattctcagggtcaatgtatggcaatctgtgaaggactgacaatatattgcaaacgtttccccctgccagtaaatattcttcttttgtataactgttagctgttgcatccattccattatgtggaggtaccttaatttatctaataagtcctgtgattagtcttatagtttgttttcaaaattttttttgtcacgataggccctattcagttgactttgtgatcagctctgaacatataatctggtgattgccttaagataaattgaataataaaagtaacaatagtagctaccatcggttgaatatttatcatcaactgttgtgagcacgttgtacatattaactcatttaatcctatgacgtaggtatagggaaggaaactgaggctcagaacctctgccagctagttgtgggcttcctttgaggcacaggggagctgaatgggagggtctacataggacagggcgtgtctgagtccaggaaggacagctggacttgggccagtctcacaggtgggaaggctgtctttctgtgaggatgggtgacttgttgacctttgatcctcagagccctgatgcagcaggagtgaaatgattcccagagccacagaaaacaagagtatctttgtcttggattttagatcctggagctatcaggtggtaagaaggctgtctgacccagattaagtgatgtcatggtatcatgttggggtgtgggccttcctgttgtaaattatttgggatttcatagagatcgaagtcatgtgtggatgacatgacttcaggatgtcccattagaagaggaacgtgggggtcaggcgtggtggctcacgccagtagtcccagcactttgggaggctgaggcgggcggatcacgaggtcaggagttcaggaccagcctgaccaacatggtgaaaccctgtctctactaaaaatacaaaaattaacagggtgtggtggcacatgcctgtaatcccagctactcgggaggctgaggcaggagaagtgcttgagcccgggaggcacaggttgtggtgacctgagattgtgccattgcacttcagcctgggcaacaagaatgaaactccatctccaaaaaaaaaaaaggctgggtgcggtggcttacgcctgtaatcccagcactatgggaggccaaggcgggtggatcacaaggtcaggagatcgagaccatcctggctaacacggtgaaaccccatctctactaaaaatacaaaaaaaattagctgggcatggtggtgggtgcatgtagtcccagctactcgggaggctgaggcaggagaatggcgtgaacccgggaggcggagcttgcagtgagccaagatcgcaccactgcactccagcctgggggacagagcgagactctgtctcaaaaaaaaaaaaaaaaaaaaaagaggaacttgggaaagagcatgggctttggtgtcagcagaagcatgtgtccagttccatgctcttcccttatagctgtgtgaccctgctatctgcacagggacttgagcctctcagaatctgttactgcatctggaaaatggaaatctggaaatgtcactgcatctgtagcaacaaccaggccattttgttactaggtttaagtgagggaaggcatgtaaggcactcagtccagatcatggcacttagtaggcctgagcacatttgctcccacctcagtgacctccttgttaacacgacatctcctgactttggggctgcagagtgatgcagagcactggccagtgttgccatgcacccagggtgcagggagacctgtcttgcaggtgttcaaacaacttttgtcagcctcagtgtcagggacttttgttgcgtagagcagtcaccaaatcctatggtgagaagagaaatcgttggagatgggggtgcaggggtggaagctcttatttcagaagacctgttgtgaggtaagactcagaccctcagcttctatccggccacagagtttgggaccagcctttcgatgtcttttggaagatgcacatggaatgcttagcctttgctcttccctggaacctggcttaggctttgcacctatcccaccatgtggttggggtgagtgaggacaacttcttttcctccagaacatggtttctccatctcagccctattgacattttgggctggataactcgctgttttgggaggctgtcctgtgtgccccgtaggatgtcctgcagcctccctggcctctgcctgctaggagccagtagcgccccctcccccacagacaaaaatgtctccagatattggcagatgtcccctaaagggcaaactacccttgctgtaggtaatacttgctttgaagtactggtgtggatggcctatgccctggcagtcttactaggtgggactggctgtcctctcattctcatgggattggcctcatgctggtagctgacttcctccccgtgagaccgtaggtctaaactaacaaggtttacacatgtgacaaacatccaggttgccagggctcaaaagagggttcacatcgactcccttctcattcactgagtcctttttcgggagctttggccgagtttgtgctgcgtctgggcatctaggtgtcgagttcttccctagtgttttcagcctcggcttcctcctctgtaaaatgggagtaactgatacttttcctgtctgggtgggaaaggaaccccgtgctaatgtgattgatggtgtggtgctaagctctgctgcaagggatgtgaagttgagggaaaggtttaccatttattaggagctttgagaccaagttccttccacacaagagatatgccctgtcaaagggagatcccattgcaaagagattcactgccaagttccccctcccactagctccctggagcaattttcagcttttagagtgtttagaggcctcagggtgtaaagcgagagagagaatgccttccagccagcgagagagaatgccttccagccggtgacattgagaatagcaggaaagaggcagaagaagaaactgacttgaagggtgatgccagccaggggtgagtggagtgaggtaggatttgctttctgaaaactgggatgtgcacacaacctatcaagaatacttcactttgtgaggcccaaaaacagctcctagcacagtgtagagcagacttggtcagaacttcaatccttgatttttttttttttttaacccgaatttcatgaggtttttctgagacatccactggactgtcatataccgtgtgctgggctctcattttatccttacaattattatgttcattttaaagacctcatgttagctagatcagtagggtgactacagtttacagtaatctactgtatatttcaaaatagctagaagagaacaatttggttctagcataaagaaaagacaaatatttaaggtgatacatatcccaagtacattgatttgatctttacaaattgtgtgaatgtattaaattaccacatgtgctccaaaactgtgttcttgaaaaaattatcacgcccattttagagatgaggcacagagaggtggagggacttgcccagatccaggtatgtggctctcctgtaatctcgcttctattgctttgtgatcagcagcaacttagtagctttcaaagcttcaattttcttgtgtgccaaatggggctaataaataccttagaggattgtgatcaagattccgtgaaaaaatgtatgcagtgcccccggcaaggtgcctggcatacagaaagtgctctgtacgcaccagctgctgtcattattattgtttcaactaccagtgatcataaaggatgcctgctttgatgagcttttccaggaatatggactggtctgccctgatctacttgaataatctgtctcaggccctattcggtaaatacatgtaggaggtgcagctgccagggaagggagggatgttacctggagaggacagagtctgaagttcaggaaatacagcaagagccttcctcagggatgaaacatgtgatcttatggtctgactagcctcaagccagctgagctcattgccatgcaacttggtagttaatgattgctagtaagaagtttaaaaggatcatcccctcaaagaatgtcagagttggaaaagaccttagggacattaggctaggaaagacaatgtcctagtgagtgactgcttgggccctgtatagaagggattctcagatcacttgggatgtcctggctcagcaggaggctaaggtgggatcaattagtgatgtctgccatggccacaagagaggcaaggagtggcacatgtgctgtttatttgctgtctttggctgcagctgaggacactgaggcccaagacttgcttgcttactggacgatcacccaagtcattaaaccacaaaaatctcttttggaaggaatctgttaagaatgtctgattataagagttgcacctttgagcaagtattttttgcttgatagtcttcagtgaggaggaactgtcttcaaagagcacattctgtcttttggcaattctcccaattagaacttagaccactgaggtagaaaggccttagaagcccctttaagtgggctcttctcaactggggctgcacctgagaagcttttggaaaataccagttggaggctccctccccagaccagtggattctggatatctgggtgtatggacacctcttgcccccattggtgttttattttccaagctcctcatgtgttgttaatatgtagccagggttgagaaccactgagaccaaaactctttggaaacagagacccagaaagggagaacatgattgtctatgggtatgtagggctagtggcacaaggagaaggaaaactaggggggaaaaggcctttatcaaatgccacccatatgctagtctcttttactttcatgccgagattcttctttttttttttgagtcagagtctcgctctgtcacccaggctggagtgcagtggtgcgatctcggctcactgcaacctccgccttctgggctcaagtgattctcttgcctcagcctcctgagtatctgggagtacaggcttgtgccaccacagctggctaaattttttgtatttttagtagagatggggtttcaccatgttggccaggctggtcttgccctcctcacctcagctgatctgcctgccttggcctcccaaagtgctggtatgcctggcccttttttttttttttttttgagatagggtcgtgttctgttgcccaggctggagtgcagtggtgtgatcacagctcattgcagcctcaacttcctgggctcaagcgatcctcctaccttacctgcctgagtagctgggactacagatgtgtgccacctctcctgggtaattttaaaattttttttttgtagagatgggggtctcactatgttgccacagctggcctccaagtcctgggctcaaacgatcctcccgtcttggcctcccaaagtgctaagattataggtgcaagccacctctcctggcttgcttctttcccgtaaattgaggtgtgttattccactgcttaaaagcctacatggcttcatatcgctgttagtataaacccaaacagtggtctgcaagactctgaaccttagatcaggatgatcagacccctccctcccctccaccctccgacctcatcctggctacccactccctgttcacagactacagtcacctggctctagtacaacagacacttgaacctaccccgcccctctccctcagggcctggtactatcctcctcgctccttcttatcactcaggcccctctatcccatcatcctccttcatttcctcccatccttatcacctactcatttctgtctgtctccccacctcttggattatgagttcaggggagtgggaccccctatgtctgatttccttatgtgtaggacagagcgtgcctcaaaagcatgcttgcttggtgaatgaattgaaagaaccaccctgacatggagctggtattatccacaggttacaatggactggacctcctcttccagtcccatataattttttttttttttttttttttttaaattttgagacagagtctcactctgtcgcccaggctcgagtacagtggtgatcttggtttactgcaacctctgcctcccaggttcaagcaattctcggtcctcagcctccccagtagttgggactacaggcatgtgccattacacctagctagtttttgtgttttcgtagaaacaaggtttcaccatgtttgccaggctggtcttgaactcctggacttaagtgatctgcctgccttggcatcccaaagtggtgagattacaggcatgagccattgtacctggccccatatcacttcttattatctcataatattcttaccttttgcagtgacagccccaaagtgtgtgtgtgtgtgtgtgtgtgtgtgtgtgtgtgtgtgtgtgtttggggtggggatcataataatcctgcaggtggggtttagctctggtgaaaagagcacagatcctttgatttgggtttgaatcccagcacttcctcttactaagctgtgtgatcttgggacattactaacctctgtgaggttcagtttttcttggctgcaaaatgtaagcacaatactaataagtaactgacagatgctgtgcttctgccagacactgtacccagtgctttgtgtgtattggctgagtgaatcctcatgacaccctaatgaggtaggtctcttctcttcttgctttcattttacaggagaggaaaatgagatgcagagaagctaagcaaccagcctgaggccacacagccaatcagttgagagtcagagttcaagcctaggctgcttgctgccagagtcagagtgttaggtaggactttatgaaatcatgcccacaggccccggaacaggtagtggtgcagacacttggtaaaccgtagttacccctcccactttgacatttactctcctggtgacatttaagttttctgactgttttgttgttcaagttggtgacaaaagtaccaatttcctgcctgctcacttccaaacacagcttctgttgatgagaactaagggagtacaacttttcaggccgggggtgtgcatggtgttttgggccttggtgctcaggaagtgtgggcactcccttaaattttttaaatgggcaaatgagtgcattttcctatttaaatttttttttttttttttttgagacagagtctcgctctgtcacccaggctggagtgcggtggcgccatctcagctcactgcaacctctgcttcccgggttcaagtgattcttgtgcctcagcctcccgagtagctgggattacaggaggctgccgccacacctggctagtttttgtgtttttagtagagatggggtttcaccatgttggccaggatggtctggaactcctgacctcaactgatctgcccacctcggcctcccaaaatgctgggattacaggcatgagccaccatgcctagcctcactcccttaaatttttaaaatgggtaaatgagtgcattttcccatttgaaacattttctgcttcaaatccttattgagcactttgtgctaggcattgtgactatgatcagtataaaaaccccaagaaaacaaaaaaacaaaaacagtaattcactgtcctgtcacccccaactcatcaatcctttgcttttccataactggttacctgggtgcttttcttcgttgtgattattttttattggaaatgcagatttgtgactgtgatgggcctgaggtcaggtcaccttgctgaggcgagtttcctgggcggctttgccctgttttgataaacagaagaatgagcagctggagctgcatttcaagtggctgctttagttgaggcaggcaggcctcagtgtttatgtgacaccgagcagcttcaaaatgagcttggtcatttaaaaaaatttattttttcctagttaggtaacagtggtataacaacattaaaagaaatgtagaaactagagaaaggaaaaaaaaaagccctttatcccccccatcacaaaactattataatttcaaaatagttacaagtacaatgtattccaagtggcttcttatttaagataattatattcacagagcagggaccgtttcaggtcctttaatgctgaaaggctaaataaagagaactttttattttttccatgttaatacatggatgatattaaccatgatgtttaatagctacagaatactgcatgaaatggatgtactataattcatttagcctttttcgtatttagagatttaagcagtagccaatttttcaccattacaagtggtgcaaggaccaatatcttcatgaatacagcattttctgtaaagcagaaattctttcttcaggattaatttccagatatctttctggtattagacacataccacttgcctaataacgttccaaaaggaattcattgtttacattgctattagaacatatgagattgcctgtttcattatgtccgtcccagcactgggtattatcattaaaaaaaaaagattttaaatttatttattgagttatttacttgagacagagttttgcttgtctcccaggctggagtgctgtggcacgatcttggttcactgcaacgtccgcctcccaggttcaagcgattctcctgcctcagccttccaaatagctgggattataggcacccaccaccatgcccagctaatttttgtatttgtagtaaagatggggtttcatcatgatggccaggctggtctcgaactcctgaccacagatgatccacccaccttggctcctcaaagtgttgggattacaggcgtgagccaccgtgcccagccaatattttaaatttaatgtttacatttgcacacatgccaattgggcttcatggtggctgcctcacaccactttttgtccgtgtgtgagactcacatagaggctgttttctgtgatccttttttaaaaaataattacatttttttaatgctcagggaaaatgtcaaataattgtttatgttttgtactgaaatctgcactggtctgatggtacccagaaaaactcttaactgtagccagaaaccagctgagcctagttgtatgcaacctgactgcaaaggtcatcaggtgctctcattttatttttagagctatattttagctctaacgtgattgttgggtgaacacttgcagaatgaaatatgactgacacctaccagctgtctacacattcctggttatatcttaggaaggcagtgtgtgctagcaccttgggaagagaatgttgagttcaaatcctagttttgccccttgcaccaataccttgatcagattcctcccctgcgtcctccctaccctttcttcaacttcacaccttagtttctttacttgtaaattgggttgatagtgggctgctgtcagaattaaggacatcgttttgtcaaggattttgcatacaggaagtcatggtgacagctgttgttactgttgtcctgaggagtggggacaggagaggaggaaaacaggctggtccaggtgtctttccttaaaggaggctccagcttagttggggagatagatgggctggtcagagtttcaagtcataggcagtgcaggcctcaaaggaacagccaggacttgagacaagaatcaggccaagtgagtaactgttgctgctgtggcagtgaatgttagcagcccaggcctgcaggggggaagactcatttggggtacagtgagaggtcttgctgggcaaatgcagggtgtttgcggcaaggtaggctggggctggacttggaggatgcctgcgtgatttagattctatcttgtagagaatgaggtatcatggaaggattttcttttcatgttgtaaatattaatcattttattgttttgtatttttgatggcaatataaaaataccagctttgttgagatataatttacatacagtaaaattcatccatttagaaagtatacagttcaaagctgggcgcagtggctcatgcctgtaatctcagcactttgggaggctgaggtgggtggatcacttgaggtcaggagttcaagatcagcatggccaacatgatgaaaccccgtctctactaaaaatacaaaaattagccaggcatggtggtgggtgcctctaatcccacctgcttgcgaggctgaggctggagaatcacttgaacctgggaggtggaggttgcagtgagcagagatcatgccactgcactccagcctggacgacagagtgagactctatcttaaaaaaaaaaaaagcatacagttcagttgtttttagtatattcagaattgtgcaaccatcactgctgtctagttccagaatattttcgttactcacaaaagaaaccccatgcccacgagtgctcactcctgatttctccctcccccacctcctggcaaccaccaatttgctttctgtttctgtgaatttacctgttctatgtatttcatgtgagtagaatcatacactgtgtgtccttttgattctggctatttcgcctagcatagtgttttcaaggtccatccatgttggagcaggtatcactgctttgttctttttttatggctgaatgatatttcatcacagagagataccatgttttgtttatccttttatgagctgatggtcgtttgggtcatttctactttttggctattgtgagtgacactgctatgaacgtttgtctaccagtgtttgtgtggccacgggttttcaatgtgggaggattttgaactggggagtggtgtttggagcctttgggtggggtgggctgtgaggagcctgtgtgtgtgtctgcccttactgggctgggtttagggcaagcttcatgtgcttcctttcttttaagggactctctgagacagggttattatcccctttttgcagatgagggcactcaggctcagtgaggttaaataagctgcatggctagacaatggcagatagcagccctgtccggctcttagccagcttgcagccacctgcccctgctgggccaggcgattgcagtggtcttggctgggaggggcccagaggctgtgtggtgctggagagaggcagcaggctggacctggttgggcaaggctgagtggttgtgggataagaggagatgtttcagagcagcacccacagaaccgctgtgatgggagaaacaagacttcgagttaggagagtgggttggactcttggtgcagcctatgtgaccttgggctgatcttgtctcttttgagcatcactttcctcatctggaacctggggctcttgtggcttcctgcctctctcaagggtgattcgggaggaagagtgggagagagagagagagagggagaggatggaggcgagagaggtggagtgggaaaggagggcagaatctgctagaacctgcagagctcataatctaggggcggggagggacatgcagcaggtgcaggcaggtgtgggaggaagtagcctggtcatctggatggacatccctgcccattcagagaagctctgaaccctgcaaaagctcccacgtggaggccagtgagctggttataatccagagactgtcagtttttcctagtacatatttggacctgagcctttgtttctgcaaagagtctggtactgactcacacagtgtcagcagcccccttccatcccctggcacacccctccctcattcctactgagcattaccttaaaaccagtgaggtctttctgggtcttaaaggtcacccagtgtccttgcctatctgggcctgtctctgttcaagtggcaaggcggaccatcccctttatcactgacttgcagcttgcctgggttttgtaaaaagcttgtcattgccagttagaaaataaagacagaaacctcccctttggcattggtatcgtgatgacttgctcttgttctgactctattttgctggcttgttatgagtcagtcatttttttttaatgaaatgaatacctttgtcttaatatgaagctaggcatatatgataaaggttagatgatttttcaaatatgaaatcagaattctacccatactcccaaattagagagcagtctgatgtgttcccctttactgtgaccagtggcttcataggggacctagttatgagtcctgtttcttttttttttctttttttattttgagactgagtctcgctttgtctcccaggctggagtgcagtggcgcaatctctgctcactgcaagctccgcctcccgggttcacgccattctcctgcctcagcctcccgagtagctgggactacaggtgcctgccaccacgcccggctaattttttgtattttttttttttttagtagagatgggttttcaccatgttagccaggttggtctcgatctcctgacgtcgtgatccgcccacctcggcctcccaaagtgctgggattacaggcatgagccaccacacggggccaggcctttttcttttcttttttttttcctcactgtgtcacccagactgtagtgcagtggcacaatcttggtgcaacctccgtctcccaggttcaagcgattcttgtgcctcagcctcctgagtagctgggattacaagcatgtgccaccacacctggctaatttttctatttttagcagagatggggttttgccatgctggccagggtgatcttgaactccagacctcaagtgatctgcccgcctcccagaatgctgggattacaggtgtgagccactgcacccggctgaggcctttttcttctgtgcgttcctgctgtcttccctccaggcagcagcaagctggtaggagctgtacttgtgagttgacatcatgatgtacagtcactggtcacttataaaactgggcaggcccagagcaggaagggtcattgagggtcatctaatgcaaaccgtttactttagagatgttgaaaccaaggcgcagagaggggaagtgacttgcccaagaccacacagctaatatcactgtgagcccaggttcctggctccagttcctggttctttctgcccccttcttcccgacactaaagatacagtggtgagcacacagggtattcagtaacgtatctatttttgacctgtttttaatggaggctgaattgggcttttagggttgagttctgacacgtgccaggtgatctgctggagggaaatctgttacttctggggaagagttgaaggtgtcttctgaactctggaatctgttttgaggggaggctgagcccatgcgtggacccttaggctgagcccatgcctgcttcagatgttccacacctttcaccacaatttatttatttatttattttttgagacggagtctcgctctgtggcccaggctggagtgcagtggcgtgatcttggctcactgcaacctccgcctcctgggtttaagcaattctctgcctcatcctcccgagtagcagggattacaggcatgtgccaccacgcccagctaatttttgtatttttagtagagacggggtttcaccatcttggccaggctggtcttgaacttctgacctcgtgatccaactgcctcggcctcccaaagtgctgggattacaggcgtgagccaccatgcctggcctatttatttattttttatttttttgagttgaagttttgctcttgttgcccaggctggagtgcaatggtgtggtcttggctcactgcaacctccgcctcccaggttcaagcgattctcctgcctcagtctcccaagtagctgagattacaggcatgcgccaccacgcccggctaatttttgtatttttcatagaggtggggtttcaccatgttggccaggctgatctagaactcctgatctcaggtgatccacccacctcagcttcccaaagtgctaggattacagtcgtgagccaccatgcctggccacaccccggtttattgcatttgcttctaatagagaaatcaacccagtaaacaaatgaattattgttagcaaaactggggggtgggttgggaaaggaaagtagttccttctataataaaacttgctgatatttcgttgaaagtcattgtcttactcatccttgtataagataagtcacacaatgagtggtatcagggttgcagggtttccccctgtgaggacacaatgggatgaaccgtgtgtgggatggtctgttaaagaaaaacaagaagccatgtgttggaaacaacctaagtattgagcggtggaggattgctgaaattgtggactactatgcagtcattaccaacgcactgaaaaaatgttccatgatatggcaggatgtttatgctataagaaatttaaagacgcgagcttcaaagtaaagtataaacctaatttggtcaaacaggctgggcgcagtggctcacgactgtaatcctagcactttgggaggccgaggcaggtgggtcgttggaggtcaggagttcgagaccatcctggccagtatggcgagaccccatctctactaaaaatacaaaaactagctgggtatggtggctcatgcctgtaatcccagctactcaggggtctgaggcagaaggatcacttgaacctgggaggcggagggtgtagcgagccgagattgtgccactgcactccagcctgggcaatagagcgagactctgtctcaaaaaaaaaatattggttaaagaaacaaacgttagacttgaagccgtgctttatatggatatgtggtgcactataatgtggtgcttaaaaagcaacttaggcagacctgggccaagtctgggctctgccacgtaactgctatgtgcccctgggcaagtcactggatctttcccagttcaggcttctcagctgttaagtgggactagtaccttatctctttgggttgttgtgagaattaaatgagctatctgggctttcagagaaagggcttcatgtgccgtggctctgatcagaccaaacaagttatctactgctctaagccatcaaggccccccatgcctgttggatactgttgagttatttgggttggcatgtagtgcagcgtttctggacatacatactctggggactccccatcccaaatttcttacagtctctccagtgtgccacacgctttcttgccactaggtccttgcatgtgatggagtaactcttgtacctctgtctccctaaatagacggggttctccaaggacatcgtgccacagggcctggtaacccagtaggtgctcagtaatttatttatttatttattttttttgagacagagtctagctctgtcgcccaggctggagtagagtggcgttatcacggctcactgcaacctcccactcccagcttcaagcagtcctcctgcctcagcctcctgagtagctgggattacaggcgggtgccaccacgcccggcttattttttatatttttagtagagatagggtttcgccatgttggccaggctggtctcaaactcctgacctcaagtgatccgcccgtctcagcctcccaaagtgctgggattacagggtgaaccactgcgcggcccattaggtgctcagtaatttgttgaatgaattgaagacatgggacttgagttaggcttttattattattattattttttgagacggagtctcactctgtcacccagtctgggagtgcagtggcgtgatcttggcgcactgcaacctccgcctcctgggttcaagtgattctcctgtcttagcttcttgagtagctgggattacaggcatgccaccacgcccaggtaatttttgtatttttagtagagatgaggtttcatcatgttggccaggctggtctcgaactcctgacctcaggtgatccacctgccttggcctcctaaagtgctggaaatataggtgtgagccaccatgcctggcctattattattattattattattattttggagatagggtttttctgtgtggctcaggctggacttgaattcctgagcccaagtcatccttccgcttcagccaattgagtagctgggattacaggtgcactgtccctcccagcaagttgggtctttaaataaagagtggggtttggtgagcagggtgggtgcactgttctaggaggtgggcaggacagaggtcagtggtggtccctactgcctattcagggaccagggcccctgggcaaaggcagagataacattggcacaatctgcctttcagctttcattgtcatgcgggagtcaccatgctttgtaagacatttaatctataagacttgattagttttgctacctttcatagcttggggctgtgtatgcctgtttgtaagagagatccatccagatcaagcctgtgcagcaataatgtatgtgcacaaggcctcttgtgttgtgctgatggtaagataggagctggacttggaggcaggaggtggcctgggttctgtttctggacttaccacttactagacgggtactcttgagtggagtcacttaagaaagtaatgccgatcaggggctcagagtgtcccaagtgttttctcttgccttattctcattaaacagaagtacagctcagaatatgatgggccagtcttatgtgattggtgttaataaggcagtagagagttgggggtactctggcagaccatgagaacctgccctgtttgaaggagaatgctgcctcctcttcctccttttaaaattcacacatatgatgctcactaagtgtctggcacccttttttctttttctttttggggcagagtcttgctctgttgcccaggctggagtgcagtagcacaaacacacctcacttactgcagcctcaaactccctggctttaagtgatcctcccacctcagccttccaagtatctgggaccacaggcacatgtcaccacacctggctaattaaaaacatttttttgtagaaatgaggtcttaccaggtcgcccaggctgatcgtgaactcctgggctcaggtgatcctcctgtcttggcctcccaaagtgctgacattataggtgtgagccactgtgccccgcctcagtttttaaaaatacttgcttaaggagagagcactgaaggaagatttagatctgctctgttgaagtgacagagtacggtggtttccatttatgcgtattttgtagttcggatggcttcttgtggggagtcctgtgagttcacacttgggggcatggtgtgggggacctgtgaagtgggtgttctggggtgagtgcgatgctagtcactgtcccagttttcttctcatttctttttttgtgagtgcttggctagtggcagccttgcagatcagctagttttgacccacatcctccctctaagtggtgctcattgaattgagccacagccccaaggtcatgttttcaaggttggcatttgggaggccttgtcagaaggtcttataccatattccagtcacccaaagtgctgcccgccatgcctgttcgttcagcaggatttccctgagcacctgctctgtgccaagccctatgctaagcaccaagggagtaaatatggagggcagtgtccccagagtccaggaactcgtgatctagtcggggaggagaggggtacctactctgtcttttacacagcaagtgtaacctctgaagaatgatgttccaggaggcaagagcaaccctggcggactggtggagctgggaagggaaagatgcttctggaggggccttgggagaagagtcctccagggtgagccccttgagagaggtttcagagctctcatccatcttcatatcctggcacttagcccaggcactaaaatttgcatatttttgatggcaattaaaaaaatactagctttactgagatataattcacatacagtaaaattcacccatttaaaaagtatacagttcaaggttaggcacggtagctcatgcctgtaatcccagcactttgggaggctgaggcaggtggatcacctgaggtcaggagcttgagaccaacctggccaacatcgtgaaaccccatctctactaaaaatacaaaaattaaccgggtgtggtggtgtgtgcctgtaatcgtagctacttgggaggtggagacaggagaatttcttgaaccgggtgggggaagttgcagtgggctgagattgtgccactgcactccagcctgggcaacagagtgagactctgtgtcaaaaaaaaaaaaaaaaaaaaggttccattcaagatgtcaagccccacgggactgagggtaacatgagggtaacagacaggtgatgttaaattccatttgggctcatgttcacccccaggccccttattttctttcaaacacatggaatgggcatttagaactaggaagatcatgaatctggtggctgtgtagatgccataccaggtatggaccacaggcttggagcgcagcagcatacaggggtcagaggtcaaggccagtggtctatcagaacccagttcctgcaggagccagtgccggtactaggtagactcagatgactgaatggtcctcgggatctgaaggccagtgggggagatgaggcctggcctcccggaagtgctcagtaaacatttgttaatcatttcctgcctagggaagctctgtggtatgctcaggagaatcttgcttctcatgggggaatgggtggttgtcatttgggtggcctgactgccagcctgcttgctggctctctgggagttggggtggtggcatcaacctgcagaggcggggcagtggggcagctcacggctgtgtgggtaagtaagcagtgagcacagtgagggagctgttgccaggagcctcttggcttagtgagccaagcagaaccatgtgatgcaccctgtgggcggccacctggggactcaggacatgcacccagatccctcctcccctacccacttcaaagaaagtgctgccctcccagtggtgatgaagaccttccgctggccccagcctctgggatctggcctttacttgggtattcatgtggccctgggggttggctttgctgaagttgggcagagcaggtgggttctggaatgtgcaggggcaaccagagtgtccatctgtttgggtgaagccagctgtttaggtctgaaggatctgtttgatttttagaaacatgatgtgttccagagttagtaggtggtggtgatggagggtattggcgtgaagagtgtggatgctcttcgttcctttgctgttttgggactatctctctatggggtagtggcccctttccttgttaggatcatttagaaccccctgggatcatgagaatgaatgtgggtctatccttccttctgtgtgaggaaaaggggaggtattgtggttaagcaagtttggagaactctggcctgaacaaaatcaaacagatgtctttcttgcaggacttagaagaaacttaaatctgttggtaactctttaagagggaaggggatataaaacccttgttttccctagatttttgttttactctatagctgtctctttttagaagcatctcatgagactaatgtttttaggaacctgctgtaggaaattcatttattcaaaaaatatttgttgagcatctgttatgtgctagtgactgctccaggtgcttgggatacagcagtgaccacctccaaccaagatcccgctttcaagaacttccattctagcagaagtgatgaactcatttttatggagcacctactgtgtattaggcatgtgagttatcacacattatctgctttacccctcacaacagcctggtgaggtagatggactattttattttattttattttatgacagtgtttcactcttgttacccaggctggagtacagtggcgcaatctcggctcactgcaacctccagcctccaccaggttcaagcgattctcctgcctcagcctctcgagtagctgggattacaggcatgcgccaccatgcccggctaatttttttgtagtttttagtacaaatggggtttcaccatgttggctaggctggtctcgagctcctgacctcaggtgatctgcctgccttggcctcccaaagtggtgggattacaggtgtgagccactgtcccaggccagatggaccattttaaagattaggtaactgagctctaggggtcaagagacttggccactttggcagctgcattgtcgtttttggattatgtcatcaaattgcaaggggaggtggtgaaataaggaatttctgcaacagaaattggagtctgcggtggggatgctgcaggccttagctgctgtatcactgtgtccgtttatgaaggcccgatggagaagaggctctgaatcaggccgggaaagaggtatttctctggaacaactggtttgtttctgtgttatgggcaccgagaagcgtgtggctcatcatgttttcctttggctttggttactaagcacctgagagctagatttgtggcccatcttgacacttctgcaggatgggaccatatggcatgcatttctatgtgctgatcttaccccaacctcccgccctccatcccgctttattattttctctatactcatttttgccttgcctggttctcttgtttgttttattcttttgtgttatttgtattattctaaaccaccacatatacttggtgggatggagctgggtatagttaaattttaaaaataatggtgagggccaggtgtggtggtttatgcctgtaatcccagcactttgggaggctgaggcaggtggatcacttgaggtcaggagttcaagaccagtgtggccagcatggtgaaattagccgagtatggtagcgtgcacctgtaatcccagctactcgggaggctgaggcaggagaatcccttgaacctggtggaggtcggaggttgcagtgagccaagatcatgccactgcactccagcctgggcaacagagtgagactctgtctcaaaaaaaaaaaaaaaaaaaaaagaaataatactaatgatgagatgacttgcataagatcccccagctactctgtggggaagtcgggctccaagccagctctcctggccccaccctctttccaacatactcagtgcctttctggattaggatccactgcaaggttcctttgcagtgggagccaggtctgtttggcttttgcagccattgtgttatgggttccagtggaagctgggctggctggattggaggtgttgaggggcttggattgacctaagtgtcacctgtggctcaagcaaggctctggactgtggattccttcttggtgagggctgttcagcctcacccaggagagaacccatacctctgcttcttgcttgtgaggcatcaggtttcaagcaggggtcagaccagatgagcactgttatgttcttcacagctgcttcccactcgttatcctcatagtagcccagggtagaaaaggagaggatgagtgggtggtattgatgaagaaacggagacctacagaggtgaaatgacttcacccaccaggtgatggctgagtctgcaacccaacaaaaaactctggcttgctggcatttctcaggccagacagttccaatgtgaacccacggtaccttctgcgggagaaaaggtggcatgggaagcaggaagagcctaggatttgggagttggatgccatggacttgagtcctggccactactatgtgcatatggggaagtcacttttctgagcctcagccgcctcatctttaaaatgtgggccctaatttctgccctgccagcctcacaggatggtcatgagaaactgaatgagaagatgaacatggaagccttttgtctggcattaaccacatgtgcctgtgtgctgggttctgtctgcattgtgctaatgatggtggtgatggtattaatagtaataatagtgaacatttaaggaacactgcctcctataatagtcaccatggtaaactttacatacattatcttaatgaatgcagaaaacaagcagatgagcagggaccgtctattattttcccatttatttttgtttatttttaattttttttttgtagagacagggtctcatgttgtggcccaggtcttgagctcctgggctcaagcaatcctcccacctcggttccccaaagtgccaggatcacaggtgtgagttacctcacctggctgtattttcccatttttacaagtggaaacagggggttcaaaaaagtttatgtaatttgcttaaggttgtagagatgttacatagtggagtccagatttgatcccaagtaggtgaccctactgtggtatcactgctatcagattggaaacagcagaagtctaggacctttttggtttggttgatgacatctgtgcacatcattctggtaggtaggggccatctgggggcaggaagttgggtgtgggtaggggttggccctggagaggcaatagaagctggggcttggctggataacaagcctggcacactgagtttgtctctgaggtttagtttctcacctgtaagatgatgatataataatgtgcctcatgggattaaagaaaataagagatgcctagatacttatacattgctataaaaatgtctgtgttataagagtgacatggcattccacaaaatgcagtgtagatgtaaattagttggaatggtgacctcacccctgctaggtagcactggcttatgtcccacctgagagtagtagcatctgagggctagccacactgaacaagccacacacctgacctcagcatcctcttctgtgaggggaatgctctctgctcttctacctgcatgcaccgtgtttgtggaagtgctctgtgtaggacagggaaagcaccttgcagagagcaagggcccactggctgcagagagcctggtgggtgatggaccagagataagggtgagggacagtttagagtgtcacagtttctcatagagctttgggcagtgacaccagtattagtctcaggaccatcattgactcctggttagtttttctgttttcaaaacactttatcagctgtaaagcacttaaaaatgtaaattagttcctgcaaaaacaaaatgcacaaaaaatgatggctctgccaggctgggttgggagatgaatgtgtatgcatgtgtgaatggattcatttctgatgataaaaatactttatgcttatttatgtgaaacttggaaaatagaggaaaagtataaaattgaaactaaaagtcatccataatccttctaagtagctttatcatttaatgttttagtatatttccttcctgtttttttttttttccttaattctgggtgtatgcaaaggattttgtaaccctttacattctggaaactgttcaacatgacttcttttttttttctttcaaccaatttgtggagagtccattttgcaaagccttagcacagtgccaagcacaagctacacacccgggatgctgctgaatgcagatgagagcatgccagctctgctgaagttgggggctgggggcagtggatggctgtgagtggtgtgaagccccgggccacagtgaagaccctggaatggctgagagactgggattccaggagaccgaggtttgaggggaggcttttcattgtttgattagctctttttttcttaccacatgtaagtcatcataatacttaaaaaattgctgtaaaaagcagctaattaaaaatataaatacagtctttttggagactagaaacagtcacaagagaagcagtttcagtgagaaccagatcctttgtcagtgtcagcgagggggaggggcgtcggggcccagccagcaaatccttccctccgaactgggggtgcggaatgtggcactccctttagttagacttgatgagctttggatttgagtaagtgacagccccttttatttcctgctttgttctctcccaggtaccagttgaccacagttttcattcatgcaaatggaagctgacagctgcccagggagggttagatacctgggaggatagagcagaggccctccttctccccgacccctcgcctctgcaggctggtggggaggggggcaggggagtcgagttaccctctctccacgctttcttcttgtgtatgtgtgcgtgtacgtgcgtgtgtgtgttgtgtgtgtgtgtcttgggggatggagaacccctctcaggagggcctgtggaaaggctggggtaagtggagtgagcccgtgggtcctgcccttccaggctgccaagagtttaagttgctgcctcccggtctctgtgcccttttcctgcctgtggaaggccctctctctgtttaggaacgtggatgtggcaggggctgggcgggcacttggcctttataacaacagaagaggattttcagtgacgaggaagcatcccgcccttctggttccctgtcttccacctggccccactgcgacagcctctccaggcctctgacttcactagaatctgcccctccaccccaccttcccccgaaccccacctcctttctctgagcctgagaggagttaattgtgttagagtgcactgagaaacctccaggaaggggccctagtccctgtgttgcctgttcagcaatcacatttgctcacgtctagaaagtacaatataatgactcaggttaaggggtgaaaaaatgtggtggacattttgccagggtactgtgttaactgttccaaggtatcaccctgtgtgagactcaggaacattcagtgttttggtttcccccctattgtactgaatgccggcagctttccccttctaattatttatcttaataatttgaggaaagttgatttgctttttaaaaactggcatccaagcgtaccctatcgcactgcacacagctgagagattaaggcagttctttagaattcctagtccgtgttgtgtacacagcgataggctggggtagtggttctgggtgcaactggggacaggcgaggaaccataaatttggcaggaaagatttgtgttggtaccctgttatatttgctttgcatcacatattgtttaaaaagagcgatattttcgttaaaggaaaaggaactgtgtatttgagataagaagtagaataaaatgaaatgaatagttgggtttcgtcctgtggccttcaaaatggcgttatttctgagatccctgtttctatgctgttccagtatttatacggaacttataaaatacaaagtataggcatgtcccgagatcctggcgaggctgtaatttatagtgttgttctttttcttttgttttacagagctgagtttggtgaaacttcaggaggttttagctagtggcgatccaaagacattaaatattgctttgtgggtacgtctccaccttgcgtcttacttggtgactgttcagtggtaggcaaatgtcagaacccagtatgcaaatgtggaagtggacagatttgagtcagttatctcagctggtgttatgaaatacggaaatttttggcgttggtggtggagggcgttggcataggaggcgtgaatgctctttgtttcttgctgttatgggagtatctcttgattgccccatcatcttgtttggtgtggccccgtttccttctagaagttgagttccctgggcttgtgagaacccttgtacatctgcctccattaaactcacatttggagatctcgtaaatgaacgcagtgcagtccgggggcagagtgaaggctcagactgcagccggacatggctcagttaccctaggtgggttagcagctgagcaggtactggtctcaaaaccctctgaagcgaagctgcctgtcgattccacagttgccagcttccagcatggagcttctggaagtatcacggactgagttgggtcccaatgctggatgtccctactcttcctcctgcccctcccacgtttggatgggcaaatgcactaagaacagcccgtgggcaagtgaatgaaaccaaaaagcagcaagggatttggacagtccacctcagagtatctgactttattttgaggggcatgtgtcagagttgggtgaagaaagagattctcagatggagatagagaaagatccccaaaagggcaggctggctaccagtgatttatttttatttttcttacttttttaagagaatgcagggcattttactcttctgtggtaggagagtagactggccacagcccagcccagaacccttaacaaaaggttaagctgctgggcatggtggctcacgcctgtaatctcagcactttgggaggcagagatgggtggatcacctgaggtcaggagtttgagaccagcctgtccaacatggtgaaaccctgtctctactaaaaatacaaaaattagccgggcgtgttggcatgtgcctgtaatcccagctactggggaggctgaggcaggagaatcgcttgaacccaggaggcggaggttgcagtgagccaagatcacgccattgcactccagcctgggcggcaagagcaagactccgtccctaaaataaataaataaataaataaataaataaataaataaataaataaaataaaataaaataaataaaaaaagaggttaaggtttatacgcaggccatttctaatagatgttatggaagccccaggttttggggcatcagggttggaaaggaagccaaaaatgggtgtgtccaaaggacagatgcattgagaatgggttgtaaaatttcagccattgtgtagattaaccagcacggcaccctgcccctcagccattgtgtagattaaggagcactgcaccctgcccctcctcccccaagcatgcagcacctgagaaagaaatctgacaaagatgctttaatatgagtctagcgctttgagcctttcattgtcatctccagtgcaattgtctgtgggttttgttttgttttgttttgttttttcatttttattggactttgctttgccttttaagggaaactctggatgatatacttcattatttcacttgtcagatggttagtaatatggtattgccattcctgacctaaggcagcaagtgattccttctggcaaactctttaagaaacatgggcatggagcctggctgcctgagttcaaacccctgctctgctgcttaccagttgggtgaccttggtcaagttacttaatctccgtgcctcaatttcctactctgtaaaatggagataataatagaacctgtgtcattacattattgtgggaattaaatgtgttagtctacgaagaggggtgcctcaggcccatggtaaattttatgtaagtgttggttgtatataagatgatgaagtccgggcgcggtggctcatgcctgtaaatcctagcactttgggaggccgaggcaggcagatcacctgaggtcaggagttcgagaccagcctggccaacatggagaaaccccgtctctactaaaaatacaaaattagccaggcctggtggtgcatgcctgtaatcccagttactcaggaggctgaggcaggagaatcgcttgaacctgggaggcagaggttgcagcgagccgagatcgtgccattgcattccagcctgagtaacacgagcaaaactccatctcaagaaaaaaaaaaaaaattaagatgatgaagatgcagcgtggggccatgagaagagtcctggtctggtgagtttggaaacctggcttctggcctgtttctaacactgtatgtccttgggccagaccctttcccctggggtgctgatttcacacctgtaaaatgaagaagtttgacttgcacagtgcttttcttagactgtggtaaggggtggatgtgggggtagtgccaagaccaagtgaaagaggcttctggacctccatccttgcttcagccagagcagcgtgggttcatttcatttttggattttggtttgtgggaagaaagggttctcttgccggtgtgtgtgtttctgataaacaaagaagtgtggaagtggctgaatgagatgacccaaggactctttctgggaagatgcaggaggaagtaggtgagctgaggggaagctggtggggataggcctggtggggcctggggagaaggatttgaaggctcaagtcacacggtgcaggatgggactcaatatagggtgggatagggcggtgggtaaaagccgttacaattttgtccaaatggtatgggctgatttacttattagggaggtacaaatggcttcgtgttataaagtgtcaagatccttatttggataaggcaaccagagtgtagacgagagagtaagagtaagaaaacaaggagaaaaatgagtgtcttaaggatgtagaaatttagtttgctggaagtctctgcagcctgaacaaaacagctgttaggtttgccagaacttaaaccagagggtgcctgccagtggttcatattcttgctacctcttcctcctcttgtcttgtttttcctttccattctaataatcacgatgagtttccctgacatgcacgccccttcattcatttgtatgatcacttagagatgaggagctgccttgccaggtagaaaaaccattctcaggatgaatctttggctttctgaatcagagttttctttgggttttagaacttcattcttattaaagtgggaatttaccggccgggtgcggtggctcatgcctgtaatcccagcactttgggaggccaaggcaggccaatcgtgaggtcaggagttcgagaccaccctagccaatatggtgaaaccccgtctctactaaaaatacaaaaattagctgggtgtggtggtgcgcgcctgtagtcccagctacttgtgaggctgaggtaggagaatcacttgaacctggaaggcaaagattgcagtgagccgagatcacaccattgtactccagcctaggcgacagagtgagactcggactcaaaaataaataaataaataaataaataaataaataaataaataaattggaatttaatatctcttatcatttcttcaattccagtttttattagatccacaacttttttggtcaaaaccagaattttgattatgtgtgccatcctaggctacctcaccatccaaaaatcctcttggaaaaccccacgcttatcaggaaaaggagatggaagtgaaaaaataaaaatatatataaaaaaaggaaaacctagtgttagcaccccttatccagcaggccccccacctggacccccacctgtattcacattcctcccacacttacagtcagtggcttcattaatctctaaggttccatgttctgctccccaaatagactgtttgctcattgaagacaggcaccacacttacattttttttctttctttctttttgttttgagatggagtctcactctgacgaccaggctggagtgcaatggcgtgatctttgcttatttcaacctccgcctcctgtgttcaaggaattctcctgtctcagcctcccgagtagctgggactacagacgcatgccaccacagccggctaatttttgtatttttactacaggcagggtttcaccatattggtcgggctggtctcgaactcctgacctcaagtgatccacctgccttgcccttccaaagtgctgggattacaggcgtgagccactgtgcctggtcttatatttcttttctatttttctaccctgatcaaccttttcttttctatctctctcactgtttctacgatcaaagtagtggagtcagtttccttgcatctgtcccaagcagccgttgctaatgggaatgagtgtcaggcactgtacatcagccctgttttgaaactctgtgcctgctgcctcattgactagctggagagtgttgaacatttggttgtagaatgtatgtggattgctgagtttcacgcatgagctgtgttgtcatttcattcattctgagtggcatctgcgccagggctacctggagtttttccagctccccaggcctagcaaaggcagggatcctgtctcattcagctgcatttcttgagctgtgcttagaaggcctgccacacagtagggaatcaggaacagtcgcgtttacagagctctcgggtgatagaagggaaagtaaaggtatattaaatttcttctaggcttgctgcctaatcccctaaggggccttctcatttctttcagcagtgccatctggcaggcctgagagtatatgggaataagtggggtgctggatcttgtgggcaggctatgggatctgggaaaggggttagcacctgggcctggagggacctggaatctagggggggcatacatctaagctaaatgtggctgtggcttgcaaactcagaggcctttcgggcagcctggtgaaatgataaatgggcagttgctgtttattctcagtcctagagattaaaaagaggtgcccccattggaaactggaggttacatgttctacccaaagggagcagctgccagtcggcttcttgcgatgtgaaagtacagccccagaaaacccaggttaagtgatgtcccctaatttttaaaagttggcaaccaattcaactataaaatcatgcctgctggcctctgagcagtaggcagggctggtgtatgccggaggccaccaggggacataacacctgccatagggtcagaataggtgggtgttagtcaccatccagatggtcagataccggaattgccacagaaatgaacatgacatgcagagcaggcagagcaggtgccaaaagttggtatcaaggaggcgaaggtcaagttctttgcccaccagaaagccttctgttccttgtctccttcccttcctgcacctccaaggactctccactgctccctacagcttaagtccaaatttccctgtctggcattcaaggtcttccataccttccttacaagtgccctttaggcgctctaaatggcgcgtcagctcctatgtgtggcctcagcttagcagtccagtgttccctccccctgaatccctccagactgcccaggctgcatctgcctcagacagccgggtgttcccaagacatgctgcactttcttccctctctgatttgctcatgctgctcctcttcctggaatgctcatccccccaattatggaaatcccactccccactcatccttcaaaaggctctggacaaaaggcacattctccctgaagtcggctaccctcccgactctgtaaatttggaataaatcacatctttcagcttctatagcactcaccctgcatctccaccacagcccttatgacatagctgttgagaaaggtctgtcttccttggtagatgatgaggtcattgtggaaggttcgagtcttacttactgtgtccacagcatttggctcagggcaacagtcaacagaggcttagtgacttagacacttgatggtagagtatggaaaactgattctcatgaggaaggtgcttaaggtctttggtaagcctgggaaaggggcagttggctggaacagagggtgtgagaggagcaggtaaagctggatccagctctctttcagcccaaggcaatacctaaaaccctatctctgacttggaaaggcagtatcctgctgtcttcctgctgtggccatgagcctcactggggcttgacttgaatgttaggactttttttttttttttgagacggagtttcgctcttattgcccaggctggagtgcaatggtgcgatcttggctcaccgcaacctctgcctcccaagtagctgggattacaggcgcccgccaccatgcccagctaatttttgtatttttagtagacatagggtttcactgtgttagccaggatggtctccatctcctgaccttgtgatccgcctgccttagcctcccaaagtgctgggattacaggtgtgagccaccgtgcctggccatgagtaggttctttagtggtgatttgtgagattttggtgcacccatcacctgagcagtatacactgaacccaatttgtggccttttatccctcacctgcttcccaccctttccctctgagtccccgaagtccactgtgtcattcttaatgcctttgcatgagagggaaggctttttaaagggcccttttcaaggtttgaaataaggctccatgacaatggcctgatttggatgggtcttggaatacccttttttttttttttttttttttttttgagacggcgtctcgctttgttgcccaggctggattgcagtggcgcgatctcagctcactgcaagctctgcctcccaggttcacgccattctcctgcctcagcctccagggtagctgggactgcaagcacctgccaccgcgcccagctaatttttttttgtatttttaatagagatggggtttcaccgtgttagccaggatggtcttgatctcctgaccttgtcatccgcatgcctcggcctcccaaagtgctgggattacaggcatgagccaccgcgcccggcccggaatacccttaaaatatagccagaaagggctgaggatgggtaagaacccaggatatagagtcttcccataaaagggagggccatcatgcaagatgaacaacttggtcctgatatggatggggctagaatctccgtattgttgctaataaggtggaactgaatcccctccctgttccccaacacaataaaacttcagtgtcgtctgggtgcagtgactcacgcctgtaatcccagcactttgggaggctgaggcaggtggatcacctgaggtcaggagttcgagaccagcccggccagtgtgatgaaaccctgtctctactaaaaatacaaaaaattagctgggcatggtggcacatgcctgtagttccagctgctcaggaggctgaggcgggagaattgtttgaacctggcaggtggaggtgcagtgagcagagatcatgccactgcactctggcctgggcaacagagtgagactctgtctccaaaaaaaaaaaaaaaaaaaaaaaaaaaaaaatcttcagtgcagggcctgtctgctctccagggaaggctgcagtattgtcaggtttgtttctttttccccacaaaactgcttcggagagctcttaggtcccaagtttgcctgcatccagggtccagatgcttccagggtccagatgcttccagggtccaggcagtgagtggaagtgaaggaggctcctctagtgaaagaaaaaggcatccagtgttaatagtatttcttcccagttgcatggggcttgcatattagagataaaggaaacatcttagctactactgagccataagtggtctcacctttcttgaaacataaggccgtcttggtttgttgttctgttttgtgcttttcacagaggcatggacactgaaagacgtttctctgacagtggagatataggactgaagagtgacatggcttgcagagcactacctgtccccctaatccacactgtcctctctcctcatgggcagcctgagaatgtggacccaaggtagcccatcatgcagttcttcatgaaatctggaaatcttggcatttcatgggaaatctcatcactgctaaagtaggcttagatttgttttaaaaccttgtgtgggctgggtgcagggcattttactcttctgtggtaggagagtagactggccacagcccagcccagaatccttaacaaaaggttaagctgctgggcgtggtggctcacacctgtaatcccagcactttgggaggctgaggtgggtggctcacctgaggtcaggagtttgagaccagcctggccaacgtggtgaaaccccgtctctactaaaaatacaaaaattagccaggtgtggtggcgggcacccataatcccagctacttaggaggctgaggcaggagaattgcttgaacccaggaggcagaggttgcagtaagcagagattgtgccactgcactccagcctgggcaacaagagtgaaactccgtctcaaaagcaaacaaacaaacaaaaaaccttgtgtgggtgaatcaaacacgtctgcaagcctgattcagcctgtagcccaccagtttgcagcctttgtttagatccgtagtggagaaagaggttaaagctacaagttaggacccctgaaaatgaaagatggtttggaagtgaatctgaagtaaattgtcactgtatggtttcagaccgttttctggtagtatgtgctgtgtgacacaggttgtccctgtgttgtgcagtggttttgagcacaacattggccctaggcctgcagtgtggggtgcaggccctctgctgagggctgcagatgctgccgggagtgcagtggatgaggtcctgcccgcacagcctcattcggcgttgatacccatgcctggaggatgtgggctcatcttcttgggtcaggtgagcctcttacacctgtgttcattgcttagctcttttgatgtcattgcatattggttcaattacttttcccttttcagagccatgaataataactatgattttgctagagggaaaaaatgaaatgatcaaggtaatgcatttacatgttacataaaattcatatcatacagaaaggcagaaggaaaacagggagaattacttgttcccttttctctcttcccctcccaattcctttaacaggaagaatgtctcactagtcatgtgatctacagcaaatcctttaacctcttcaaacccgcatctcttatatgttacaggacagtaataaaacttaactcatattattgttattttttatttaatgtggattaagttagttggtatgaaattctccaaatcctatgcatatataaagggtgctcatagagcttttttcttcttttttgtatatccaggatttctttagcggtcttttgtaattatagtaaaagcactgaggttagatttatgggttttttttgaggaggatagactgaatccctttcccgcctcaaggctatagtgggtcggcacagtttgtgtttgctaaacatatctttagctgcgtaagagaaagaaggaaaatagtaaagatgaacagtactgttttctacttgaagttctagttggcccccactcccttccatgtaggaaccttagcttgctttccacaccctcccaccactggactcacaaaggcccctgatgagtgcctccggtaagacagggggaaatttttatcttaattagaaaaaggcttagtatcttgattgtatgttctctggagccagtgatagagatagtataagaaattctggacattcaaatgtaaaacagattaatttgtaggaatgttggatttttatctggacagatgttttgtcttttatggagttggttgggattaagaagtgggggcagggtcatgttggtattttatttttgctttgggcttatgttacttaggattaactttagctgtgtataacaacagcaacaaatcagatttatagtcagttaacggaggcttaagtgatgtaaagttttatttctctctcacatagaaattagttagaggtagtagtttagggctcttagaggccccaggctgtcatattctacctgcttacacatggctttcaggatctaggtcacctcacagtccatgatggctgctggggctccatcccccttgtctgagtcatatgttggcagaaggaggaaaggcacagatcaagaggaggcctttcagctgggcgcggtgggtcacctgaggtcaggagttcgagaccagcctggccagcatggcgaaacaccatctctactagaaatacaaaatttagccgggcatggtggtgtgtgcctgtaatcccagctactaggggagctgaggcaggaggatcgcttgaacctgggaggtggaggttgcagtgagccgagattgtgccactgcactgcagcctgggcaacagagcgagactctgtctcaaaaataaataaataaataaataaaataataaagaggaggcctttcctgctgcatcagctctctctgagcagcgttcctgggaagttccatggaacacttctgcttatctcattggtcataactcagtcagatgcacacactgagctgcaagggaggctgagaagtatagtctcttagtcccagatacaatatgtataaaattcagaacaagggtccttttactaaggaggaggaagagactggatgttatggatatgggcagcaagcagtgttttcaaagtactgaaacagattgtagaactttgtaaactggctgcctttctactcctctgctcacctctaaccaaagagccacctaattgttctgcatggtgaccattgcctgttagattcttggtgaatagattcctagcctcatcttttgttatttttatttttttaataaatggtagaatgaggatgcaggaaacttggaaaagcagagtcaaagttcaactagcacaggagcagaaggtaaattctgttggcttatagaatgagcccagaccctggtgtcagaagacctgggtcagttctggtctgtcctctcctgggactcagtaaagtctcttggctctctgagctttccacatcagtaagatggggaatgacaacccttatgggactgcagtgaggcttagccaagttggtgctgtggaaggccctactggattccaaagcatgatacagatgatgaatactttatgtggctgaggtgcttccagcaggcacgtgggaagcatccatgtaagattggggtcatgcaaaatggggtgggatcacatcgcgggatgaagcacttggatgcaaaggcctgtgtggtccagcctgagtctggctcaacacacagggtcggatcctggctgcgctccttactgctgtatgtacagatttggctcagagggaatgcaggattggcaacatgcatctagtctttcttgtggtctcctggtgcctctcatggtgtgcttattcttattctgctacggagagtgtgacttaagcatgtaatttgcatatagcgtggctcctgaatgcaagccactaacccattattttacttagtaagttccagtgttggggcttgggggatggtgtgtcctttgccagtgaatgcttatgttggtacatttcaagggttattttgcttatgcaccctccccacccccgtcaacgttagagcttagcatcatatgaaaggcagtgtccctgtgactgtatcatagggttgatgaggatgaaatgaagtaactgcaggcagtgtccagcccagtgcccagtgctctgtccaggctcagtgagtgacctttgctgctgctgctgctactgcgtccagctggctacatggggctggtggcagagggtgactcagttctcagtgtgtcttttcctgccccctgccaggttgcttcccctagcctagttccctttttttgtgaaatgctcatccctcagctctggacttcaatgtactgttggtttcaaaaccttatgaaacacaacatcaatgggggaagggagaagagagaagctgagaagcctaacccaactctgacagctgagcggctacagaggacttctcagttgggcttcaatacttcttaagaactttcaagttaggcctcagatgtgattttgtttgctgactttctctttgctaccttggcttctatttagttaacaaatctaggccgggtgcggtggctcacgcctataatcccagcactttgggaggtggaggcagaggtgggtggatcgcctgaggtcaggagttcaagaccagcctgaccaacaaggagaaaccccatctctactaaaaatacagaattagtcgggcgtggtggcacatgcctgtaatcccagctactcgggaggctgaagcaggagaattgcttgaatctgggaggcggaggttgcagtgagccaagatcatgccattgcactccatcctgggcaacaagagcaaaactccatctcaaaaaacaaaacaaaaacaacaaaaaaccccaaatctaattcattcattcagcgtgcacaatttattcaacacagtttgttccaaacactggggatatgccccaaacagaccaagttccctgtttcatggagcttacgtttggtggaagagagacaaatatagaaacaaaagtgtaggctgggtgcagtggctcacgcctgtaatcttagcactttgggaagccgaggtggggagatcacttgagcccagaagttcaagatcggcttgggcaacatagtgagactccgtctctattaaaaaaaaaaaaacaagtctaacatcaggtagacttcagggctgtgaaagaagtgacatagggtaagggaatacagcgtgttgaggggatgggtgctattttccaaggaaagcccctcctggtggggggccataggaaacagctggtgcaaaggcctggaagactcactggcatctttctggaatagcaaggatcagcttggtgggaagtggaatgagctgggggtggagtggggtggggtggattttggagtctgagcttgagatacctgcttggagatgctgagcagtctgcaggaaccaggagcccggagctgagggaggacatgaaggctggaattgtaagtttgagagaaatcagctttttgaagctgtgggacggggtaagatcaccgtcatgtgagaggatgggactggccaggtggtgcatgtgtccaggctcagcggatgttcctgggatacaagtacctgttcatcttgttgacatctaatctgtatctgcgcatagtgaccaaggataagccactgagctgctccaaacgtgtgctatgggatggattaactgtgtgggtgtggaaatccctcagaatgatgagacagggagcagtggagaggaagacagtcgatcattgatcggtgagcctgtacttgagatctggcctggatagttgtgatggtaggtggtacccacaatgatggcccttcaggggatttgaagattgtgaaggaggaccaagaggagctgtttggaccacctgtgatccaaggcgggaactaggaagacacctaccggaagtctttgtggatcttttgggattggattggattagcagatacagagcgtttgacctatagtaaccagctgactgttcagcaaacgcttcacttcctaaaaggcttcttctttccaaggcaaactggggcatgtgaggaacaggaacttacaagagcttctagtctgaactccaggtgctgacactgttaacagttgctgagtggagtccttctcacttgggtggaaagtaacctgtaaacttggcccaagtctcccttttcctgtcctttggcccatgctgttctggtgctagatgttggctctggcctttgcactgaccatctcctcgagatggcacgtggggaggatgtgctgtgttgagaagaacttggctggataggcaaagacttgagctagaaaaagaacaagtggttattcatttggtgcttccctttaaccagggcctttttttttcttttattttaaaggaaacctttaagaaaggagggctctcaggcctttcttagaatttaggtctcagttttacatcatgggattctgtttttcttgggtttccattagaagattaaataacatagtggctatgaaagcatactatagatactaggaactgttgctttgattgtgttaaaggatacctctattccccaggtcctttattgattcatcttatttttatttgtataataaatcattagaatagtgcctggtgctctattgcactcacttgcatatactgtataaagctttgtacatattacttgtttagtcctcacagcagccctaggaggtaggtactattattttgctcattttgcaggcaagaaaacaggcacagacagttaaataaggtcacccaactaacaagcagtagagctaggatttgaactgggggagcctggctccatgttctaggttcttcaccattatactccaaggcctgtcggttttcccatcaatctctactgaagaacaatggcgatggccatactggtaattgttgtgctttatatgctgtgcactgtgttgtgtatttcagatgcacgaatgagaatcttcatccccgcaagatattaagagcccgttttacagaggaggaaatgaaggctcagagaattgagtaacttgcttgaagtccaaagctgaggagtggagccagaattcaaactcgagtttgtctggcttccgaatcctgctatttcctcagcacagtggccgtcctccaaggctgtcacatgttccttccctggtgattcacggcacctggctacctccttttagactcactttgtggcccatggcacccagttgtgtcatgacaggacagtggctcccatttctccgggcctgactgtgaggccacatgagccaccccagggaggccagcagagtcagagcttggctttgaaagctgttaatcgacctgagcccctccatgtcccttgctccattttaagcctagggctttcctaaagcaccgcagatctccttttcttgtgagaagagattaggcagatgtatacatacacggtaatgtgcaagtgtctagtttcttgtcagcatcgggatgagctgtttgtagtgaagagcctgggcctggtgagcccccgggatgatgggtggggaccatctgtgctctcctggaaaggaaattgtggtttctttcttttcttttttctttcttcttctttttttttttttttttttttttttttagtttatgggaaagggagacttgtgtctcaattgagtctttgtggcgttgtattacagagagtcacagaaaatgttctatgtaaatgactatgtgctctgattagagcctcaatgggcaccattgtgtcatattgctattattggcgattgcaggatactaaatgatattctcatcaggctgaaaaacttcagtgttagcagtgaaactcggggttaattatactgctctgaattagagcatggaattaagttgtagggagagtaagcctattgctttcttccccctctgtcttcctcttcaagattcttgctgggggtttgatcagaatagtttttaacccatgttctatatctgtactactggcattttgttctccatgagttactaccccatttggggttgggaaacacaggaccaatttataggacagtgggagaaggggagacatggtctacttaatagtgcattcttctcagtcaatagctgggtaaaaaatagcatgaagattgaagtcttaggggaatgctggactctctagaggggcctctttaatttagctcttgtctcttctgcctttgaattctcatctcttctgatcctgactcacctctttgaagaaatgacacactgacctacatcttggctgaaacagatagaagagtctatctctgttctgccccttcttggcattcccagcacagcctccaagggagtctgtcccagagctgaggcaggccctctcgggttgcatgccattgacttctcagctttgttttaactgcagagtttccagtgctctgctcttcttgaattgctcctgattgtcaccttcttgcattcctttctctcatttctttttctgtaaatttcatgtcactggtatcaggtttaaagtcgtattttttaaatccctttcaatgttacgtgggttgtaaatgtaattgttaatattatttaaaaatttttgaaaagtgatttttagtggtggccttatcatatctacatattattactccaccattttgggatgtttaggtcgaatcctggttttttcttcttttgctgttgtaagtcatgtatattggcaattagcctaggagagattcctagaaatgagttcactgagaatatgagcttaagagaaagtgaggatttaaagccagatctgtctgccttcaaatccagcgctctttatactgatgtgagttctcctgtcttttttacctatcagaattctagaactctcccagagaaaccaggcagatactgctccacaccggtgagctgcttctcacctgggtagtctagggtggtttgctccagaattgtatttctgctttttctttttttaacttggcagtggttaaccattccctggagcagcaccaggtaagtcagcttgtatcagagtcatctgctttacctgacatgagcacacgttgtcatatatttgcacatgcagatatcatatgttaaacaatatcacattgttgaagaaaattacactggaaagcgtaaaatatagtttggatgccatattgagtgtaacttaatccacccgattcagaacttttgtagagtgcctcggagttcctatttggaaatatcagttagcagttttagtcagtagagtaacatattttctatatttatgatatatcaaagagactttctgaagcagaaccctgattgactcaagagtcttttccaaattctgtattctctcagaaccaggatttaataggaggtgggtggggggtggtccttggtcaaactggggaaaagcctcataatgagattgccaaagcgcttacagcatttgaaggctcagagagatgccgtggtcaggaagcttgtttgagtctgtctggaagccagtaagtcccacagaatacctactgataatcctgtggaataagcagcatatggaatgttgctgagctagaattaaagtccacacacggccaggcgcggtggctcacgcttgtaatcccagcattttgggaggccgaggtgggcggatcacttgagtccaggagttcgagaccagcctggccaacatggtgaaacctcatctctaataaaaatacataaaattaggtgggcgtggtgatgggcatctgtaatcccagctactcaggaggctgaggcaggagaatcgcttgaacccaggaggcagaggttgcagtgagccaggattgtgccattgcactccagcctgggcaacaagagcaaaactctgcctcaaaaaaaaagaaaaaaatatattccacacacctagtttttcagccctatacaggctgaccccatacctgccatctccttttcacttcctgttctttctggcctccgtgagtccacgtgtgcccttgtctctgcttgctgtgcctttctctttcctccacgttgctaaattccgtccatttttcaaggctcagttcagatcatccttctttgctttatcattttacatactgtgtatggtttggcctcttggtctgctgctctctgtgtctgttgtatggagcgcttttctatctggtattacggttatttgtgtgcatgtcttttgattcatctacttgaagacaagagctggtcttgggctgccattcctgcagtgtaggctctcacattgccttgcacgtagtaagtgctcagtaaatgcttggtgaacaagtgttcatggcgtaacttaatacttccagtggtgagagttcctgtcaagagtgttggcagtgaagttgttccccttggcaatttctatgctgatctcgggttactgcatgagacacagaatctgcgtttccctcccttcagcatcactggggaggacagccttactttggagttttttttctgatcagttacatgatggtttcatctttaagactactgataacaggcagctctgcctatggagtagccattcttttttttttgagatggagtctcgctctgtcacccaggctggagtgcagtggcatgatctcagctcactgcaacctccgcctcccggattcaagtgaatcttctgcctcagcttcctgagtagctgggtctacaggcgcacgccaccatgcctggctaatttttgtatttttagtagagacggggtttcaccatattagccaggctgttcttgaactcctgacctcgtgatccacccaccttggcctcccaaagtgctgggattacagacataagccatggtgcccggtggagtagccattctttatccctttactttcctaataaacttgctatcactttactctaaaaaaaaaaaaaaaaagactgaccaggtgtggtgactcatgcctgtaatcccagcactttgggaggctgaggcaagtggatcacttgaggtcaggagttcgagaccagcctggccaacatggtgaaacccccgtctctactaaaaatacaaaaattagctgggtgtggtggcgggtgcctgtagtcccagctacttgggaggctgaggcaggagaatcacctgaacctgggaggcagaggttgcagtgagctgagatcataccactgcactccagcctgggtgacagagcgagagtctgtctcaaaaaaaaaaaaaaaagaaaaagactattggtaacaaccctcatttttttgagcacttgctatgctgctaactgctttatgcacactatttctttaatccttaacactatttctttaatccttatatctacccatgagatagggttttgttattcaggcagtggcaaaacctgcggcttagagaggttaaaaaaaaaaaacaacaaactgcctcaaacaaagtcatatagtaaatggcagtgctggagattaaatttaggtctgtcttgttctgcagtccatataccatataactttgccaaatacaacactatggtgtgtgtgtgtgtgtgtgtgtgtgtgtgtgtgtgtgtatgcacatgtgtggcctttattgaacactgtggtgtgtgtgtatgcacgtgtgtggcctttattgacttattgaattgatcctgaatcttccctactcctttcctgtctcttttctctttctgaataacatcatttctttttctctactggacatggtctctgtgggtttcacccctcacccctcttatttttgaagttttattgaggcactggttgaggctttagggctcccactgttaagtttgacagtaataggtaagtgtccccccagtctcccttttgccctttctttttttttttttgagacagagttttgctattgtcatccaggctggggtgcagtagtgtgatcttggctcactgcagcctccgcttcccgggttcaagcgattcttctgcctcagcctccccattagctgggaatacaggcgcacaccaccatgcccagctaatttttgcatttttattagagacgtggtttcaccatgttgggcaggctggtcttgaactcctgacctcaagtgatctgcccgctgcagcttcccagagtgctgggataacaggcgtgagccacaccgcctggccgcttttgccttttcttgacattgccaatgcatcctgtccccgagcgtctctgagttttaagtctcagatttgttttctttggagacaaactgcaggtaggtgttacttctcaccgaagttcccagatagcacaggctttgctaaacaacacagcaccaggaactccatcatagagaccgcaggatgctgtgtgcgcgcacatgcgtgtgcacctagtgagatgtaaacatttacctggagtaaaagaaattctttccccagagcccaaatttggctagtctccttatgtacacagctttgacagggattccatatgttttgctcatctttgcttttttgcagcctccacaaatttattttccgtaccactgccactaaacagagttgtttctaaagtgcagatctggttgtgccattccaccgtcaaaaattattttttggctccttgttgccttcagggtgataggacaggtgactgctcacctctccagcttctcttactttctttcttcttcttcttcttcttttttttttttttttgagacggagtctttccaggctggagtgcgatggtgcagtctcggcttactgcaacctccgcctcctgggttcaagcaattctgctgcctcagcctcctaagtagctgggattacaggcacctgtcaccatgcccggctaatttttgtaattttagtagagatggaatttcaccatattggccaggccggtctcaaactcttgacctcaagtgatctgcccgcctcggcctcccaaaatgttgagattacaggcgtgagccaccatgcccctcttacattcttttcttctgttcactacagccgtggagagctccgggttgtcctgcacatgtgcactgccctctcttttatggaccttttaggctggctgcaccctccgtctgtgtcaccctcctgctcctcctccacctggctagttcctgttggccacttttggaaattcatgccagtccagtccaccctgagtacatcctctttctgtgtcactgagctcactatgctgggttttatctatgtctccctcgcaactagatcattcacgtcttgaagttaggcatcatgcgttcttcatttctgtacctcccaactcaatgcttagcacccagcaggggctcaagactgtgtgtggaatgaaggattcgtgtgaaaatgcagggagatggaaggctgagcgtttctgttccttgaccattcccgggtttgactaataactctcatacacactgctactcattgaaggcctactgtgtgcatgcattccatgtgtgctatacagtttatttattgttaacccacgtagaattcccagacacatagcgttactacaaacttcatcacaaaaataaagaaaccagggccctgtttctctttgtttctcagatgagaagtctcaccagagttgactgtggcttctgagcattatgaggcacatgtaggatttaaagctgaaaggctttatccctgagactcagggaaatatgacaatcttttattttgttttaattaatattttttgagtcagcgtcttgctttgtcacccaggctggagtgcagtggtgcaatcatggctcgctgcagcctcaacctcctgggttctagcgatcctcccaccttagcctcctgagtagatgggaccacaggcacgtgccaccatgcctggctaatttttgtactttttgtagagatggggttttgctgtggtctcaaattcctgagctcaagcaattggcctgactcagcctcccaaagtgttgggattacaggtatgagctaccgcacccagcctgacaattttttaaacagaattttaggtgcttgggccctggaaggttcccagttgtccaactcttgaggtggggggtgggtggggggtggagagagagagagagaggaaggcttttccttctcaaatagtttgcatttacacgaaggccacggtgtacttgtttattgaatcaataaagatacaatctctttgaatagttcagaatctgatatccctgttagactgagttcaccttttgtgaaggacacaggactgctggatagggtgttgcagcaatgaggagttatgttataaggggtctcttcagtgtctttttggtcatatgaattttatttgcccagtagaacatgactgatgaggctctgaatagtcaaagaaaacatctctcttatgttctgctcatgaatagaacactctgtgtcctgaattgttgctccactggggccagcacgtggtgtatttttctaatgtttgaaccaatgggctttttcattttggggcaatcaaggtaaagattttctggtgctcctgtgtgacagggaaagcatgtcttgtattttctctctctttcccttctgtcttttgagtttggaaaattatattttgagttacatgactaattacatgagtaattttagcaaatttactagaaattgatgttctgccaatgattggaaatcccttcctcccctccactcttctaaaccaaaacagtgctgtgtcctgaagctagaggggtgagtattcagtattggagtacagcggtttagaacattggagacatttacaaggataaatctatggccctgggttctgactttcttttgcctgtgtgtgtgtgtaggggtgtgtgtgtgtgtgtgtgtgtgtgtgagagagagagagagagaaagagagtaagagagagcgagctgggtttggggctgggaaggaagaatgattgattaggaagctgttgtgcagagtagaacaggacttcctgaaatgtaagacccaaagaaacatagatagccatattttccagtcctggaatcagactcaagtctgataaaaggttttcttttgatttgtgattctgataatatgaaaagtcttacaaaagtatagaattgtagctggtaggctgctttatgagaaagaaaataaactcccacagagtgggcattgacctgggagatctggagcctggtgcaagtgcagaccatggttttcacaatctttgatcactttccttttgtgttgaactttctcttttagctccatatttataaatggggtcatatttagccagatattttatttttatttttatttttaaagagaggcaggatcttgctgtgttgcccaggctggagtgcagtgccatgatcatagctcactgcagcttcgaacagggcacaagccatcctcccatttcagcttcctgagtagctgggattacaggcaggagccacatttcctggcttctagttgggtttttttgtttctggaagaacagaaccatactcctcaggccaggaagacctaggtagagcaagaccagcaacctcttggctagagggctgtgggagctgagcatcagtgagtgaggggaaagcagtggttttttgtcttgagaagaagttcagcgctcagttaaccagaacaagtgccacctgtataagacagcagacggtcaaagcagaagagggaaggaaatggttgaataattctttttttccttttgttccttctctgccctgagtctcccccacccccaaagagatatctcaaaatgtcaaggtccagtgaaatggacggtgggatccttgaggaggggtctgtggggtgggggtctctgaaggggctaagccatggtgggctaatggctctgtttaccgagtgcatgccctatgcctggcattgtgcttctttctcgaaaccatcctacaggtggaggaagcgggggtttaaagggagccagcagccagcgactctctatcttacagcttctaattggctttgaaaccacacaggctgctgctggaggaacctttgacatcctcagtgtgcagccctctcccctccctctgaagggaggcatactccttcactgttgctttgacactctaggatgttccaaaactaggtggtcagcttactcagaaggctctgggcatttttcctcctgcaggagggactgcgcacatgcgaaagacatgaggaagctctgatgctcagggctgtgggggctttggccttggcccgcacagccttctctggtatagtgaggtctccttttgggtttttcacttgtgtttgttttgaggcgtatgtgcttcatatggttgaactcattcctcgcccagctggacatagagttgactgcctcagtgggtcccacctcgggggtgggaaatgtaacctcatgagggccactgtatggttgggcagattcacagctgctctgaggtcaggcctggcaggtggcgagggcctaagaggaattggatcaccctggaacctagctggggctaggatggttgttgcatgtgattttcagcaggactctaagggatctccaaagctggttggctggctagcgaggttgggcgagggaataactcatttgcttaacttttcatatgtaacaactgggttttgggtttcacaagagacaaggtaggcaggcaggctcaggtggttctgtataccccatttcatacatgagaaaatggagacttgtttcagatcgtaaggtagttggaccgcagctactcttccaagactggtattcgttcctctactctgttaaagccagagagaggatgcaggccaagtcaagtgaccaaagctaaaggggaaggaagggctggctggacttagcagtgaccacagacagagttgaagccttcacggttggcgttggccttgttcactgctgtgtgccaagctgctgacagcatctggctatcgcaggttcgtaataagtgtttgctgagtgaatgaaagaatattggtgttggggatgatctctttttcacttgctcagcaccttccagaattttgttcttctctttgccactcccttttttctcctccctgggtaacacctcttattgcaggagtaggatcaggttttgagtagcacctttggggtacccattcagttcctcttttcccccgtaattatgggatttgggattgccctttgggagaattaggtaactttaggttctgtatgttaatttgaggcctggattttgaacttccttctgatgcagatagaccttggaagggagtccttacttagaacctctttattttatctcctcactgggagagtagatcccagacaggttttgggaaccacctggtgtccccaagcgagcagaggcagagttgggcttgaatctcctccttcattgcagtgctttctctgccctgatcccattgggtgaccctggactatgaatatggattatgagtgggccctgagagtgatcagagacatccttcaagattgaagctgctttggttcctgccacatggaactgagtgggagaatgtctcaattcaggatggtgggagtgtctctttgtccaagtaataaatggaaaccgtttgctcccgacttttgcagatatcaagggcttgtctttccagagtttggttttcttcccttctctccgcctcccttttctctgcccgcctgtggttttgagcccctcatggctatctgggcagtgatgggtggaagggagctggtgcagtattcgagtagagaagttctgctgcagtgagtgtggggcaagtttcccagacccttgttgggtcagggcaggtggttgtggcccagttgtttggccttctgcaggctgcacccctgccctgctgcctgccagtggggtgagggcctggccacctggtacttaacaagtttggttctacatgtgttcccgtgagtggaggacaaaatgaaaatacctcctgatcgtgttcaaccattagttgaacaaccatttgaaatggttattgcaaccatttcagagttttcttctgtttgtgatgtcatctgtgccttataaggggtgacttgctaccttatggagcacctaggttgaggcccgggttgagcacagttccatacgttagctcatttatttattttgagacaggatctcacttctgtggcccagggtggagtgcagtggtgcaatcacagatcactgtagccttgacttcccaggctcaggtgattctcccacctgagcctcccgagtagctgggactacagctgtgtaccactatgtctggctaattttttgtatttttagtagagatggggttttgccatgttgcccatgctggtcttgaactcccggcctcaagagatcctcttgtctccaaatcgcttcgcagaagtgctgggattacaggtatgagccaccatgcccagccaagttagttcatttaatcttcacagtggtacaatgggctaatatctctgtcttataggtaaggaaatggagactaagagctctttgccaagggttgctgtcatccatttattcatcaacaggtagttattaggtatctactctgtgctgggccctggcctgaacttggctttggtggatgagactgacaagttctctgttctcacagagctgagagtctggggataaagatcccttattatggtttcttttgtggtgttgtggggagagggtgatgattagggtttgggtactggagagagaattaggattttagctcattttactcaaatgctttatattgcaccatgttactacattttcccctgtgcttcccccctaccctatgtggattattacagtttacttgtgtgtaaacttaggctcagagaggctgggtaacttatcccagcttgcacaaaagaggacctgaatttgagcagaccgtaggttgaattctgtccttctatgctgcctttctatgaataatatgtttacatatatatatatatatatatatatttttttttttttttttttttgagatagagtcttgttctgtcacccaggctggagcgcaatggtgtgatctcagctcactgcaacctctgcctcctgggtttaagtgattctcttgcctcagcctcctgagtagctgggattacaggtgcgcaccaccacgcctggctaatttttgtatttttactagagatggggtttcaccatgttggccaggctggtcttgaactcctgacctcaggtgatccacctgcctcggcctcccaaagcactgggattacaggcatgagccacagtgccaggccttacataaaaattgtttaaaaagcagtttgcagaagaattatcaatccttttgttaacattttggtgaactcttgaacacattttttaaaaagttgagagttgctaacaagtaaagtgaagtcctgtgcctgttgtaatttggactgaggagtgtgagttgtcttggtctaaaggtcagagtgagggtctctgcctgctgcaggggtctcccggttagggttagggtgaaaagctttttaaaataaacctctcaaatttgttgtcaacattaacctatggtaattttttttttttttcttttttttgagacagggtcttactctgttgcccaggctggagtgcagtggtgggatctcagctcactgcaacctctgcctcccggttcaagcgatcttcctgcctcagccccccaagtagctgggacgacaggcgcgtgccaccatgcctggctaatttttgcacttttttggtagagacagggttttgccatgtcacccaggctaatctctggtaatttttaaactctgctcaaagttttagaaaacataagtctggaaattccaagttgagccactggtgacttgtgagcatgagtatggcatgggattgggggtggggtggggctgacgtggcctggggcagatgccgggtggttctgtttggaaacagaagttccactgcacatgcagccttcacgtcttgtgggggcttttgtgggggctgtgtacttcccagtttggttattagtaactttatttggttctggtcattaacggcttttgggggcgttttgggggcctgtttgaggcccctgaacatgcatttttcagttgtcgttgtccatgttattaaaaggatatgttggagggggttgcagtttagtctgctgctgtttcgaatccttttctttgatagtgtttgccttcctcccaccaaatgctgcactgagagtctctggtacctgggtccctccttcccttgcctttgcttgggaggtcagtgccttcatccaggacatctttgggcatacaggtaatcccaagcagctctgctcagttgttgataccccttctcacagaacctgatctgcctcagctctccttgcctcctaagtggcagtgccccgctgctgggaagactcctctctctgctggatgcttcttcaggcctgctgctgcacagcttacggccatgatgactgctgcagtgcagaaggcatttcagttggctgtttgtttttcatgcattttgtgtttgtagtgtgctggccacgggagcactctaaacacattatgggccgggcgcagtggctccggcctgtaatctcagcactttgggaggctgaggcgggcagatcacttgagcccaggagttcgacaccagcctggccaacacggcgaaaccccgtctctactaaaaatacaaaaattaaccgggtgtgatggcgcgtgcctgtattcccagctactagggaggctgaggcaggagaatctcctgaacctgggaggcagggactgcagtgagccaagattgtgccactgcactccagcctgggtgacagagcgagactccatctcaagaataaaaataaaaacaaaaataaacataaaaataaacactttatgtacacaatctcacatcactttcacagtcttggaaggcagatatttctgttatcctcattttacagctgacgcctatctaaggcttgtataaaagtcagtcactgtccaggctcacacagccaatgctggagggctgtgtggcacccagagagcacagttgctgcttggaataaaccttcacttatagtccggagcagggtggttctaaagctcccttagctttcccactagtaagcttccaggttctggtacagtttctcagcctcggcactactgacgtttggagtctgatgagtctttgttgtgagcgctgtcctgtgcattgcaggatgttaggagcatacttggcctctatccactagatgccagtagcacccccctcccaactctgcccagttgtgacagccaaaatgtctgcagacattgccagatgtcccctgggggacaaaatcttgcctaattgagaaccaccgagtcatggcaaccatttcaaaccctaagccaggatgtacgtggagatggagaaaggtacaacatttagaattggtactgttggctgggcacggtggctcacacctgtaatcccagcactttgggaggccaagacgggcagatcacctgaggtcaggagttcgagaccagcctggccaatgcggtgaaaccccgtctctactaaaacaaaacaaaacaaaacaaaacaaaacaaaacaaaacaaaacaaaacaagtcgggtgtggtggcgcacttttgtaattccatgtactcgggaggctgaggcaggagaatcgcttgaacctgggaggtggagattgcagtgagccgagatcgcgccattgcactccagcctgggcgacaatagtgaaactctgtctcaaaaaaaaaaaaaaaaaaaagaattggtactatcttagaaaacctggagcaccctgctgctttaactgcagccctctgtgtgggcagacagattgacagtgggcttaatgtggggtaacctttcatcatgaaaattaaattacactgcaggccttttgtagccctcctatatgaaaccctcttaaaatattttctttttgcaatggaagcttgggggaaaaatcatagtcttagatttattgaagttttgtggataaaagcactttttattaaaaagaaccaggtgaaaactagaagggcctcttttgagtctgctgacagacacgtggagaatatatagtcagcggaacattcctgtgctttccgtaaagctgtggatgaacctgcctttcaggtttcgtagcctcttcagtcagatggtttgagaatgcgtgttttgtggtgtatgcacacagactgtatgagtttgtttttttacacatgactagtaaacctgtcacattttgtcaaatgtgattttctttctttattaaaatagattttatttttagagtagttctaggttcacagcaaaattgagcagaaggtgcagagatatcccatatacccctggcccccacatatgcacggcctcccccgttagcaacacccccaccagagtggaacaatcaatgaacgtacattgacatatcactatcacacaaagtccatagtttctgttagaattcatgcatagcattctacattctgtgggtttggacaaggtatgatgacatgtaactgtgatttcctcaattcaatatgtatagttcctgttcacacatttcttcacacatttgttcctcagtgctcaaatgcctgctgtattccaggctgtatttgaagcccctgagcctttatttggagagttcattgaacattagagcatgcagtttgctgagatgtcttgtacttagaaaatccaatttataaaaaacctcaaatagaacagtaaatttagggaattttttttttctgatgataaaattagataactctgttgcatggattctgtaaaacacagctccctcctgttacgccatgaattgggttcaatttacaacacccctttaggcatactttttcagcaacacatgtctgagccgaggtgcactgtgcctctttctgtagcaggcagcttttagggggtgtcctagtggtcttatgttttatacatctcatgggagtggctggtttctaggaaatagctcacttgccagttttggtaaccctaacagagctgttttgccaaggcgtctggtgaatatttctgtcttccagtcaggactaatatagtacttttcagaggtgatagccagttaactgatgactttttttttttttttttttttttttttttgagatggaatctcgctctgccacccaggctggagtgcaatgatgcgatcttggcttactgcaacctctgcctcccggattcaagcgattctcctgccttgcctcctgagtagctgggattacaggtgcgcaccaccacgcctggctaatttttgtatttttggtaaagtcagggttttgccatgctgctcaggctggtgtcgaactcctgggcccaagtgatctgctcacctcggcctgccgaagtgctggcattacaggcgtgagccattgcacctggccgtgttttctgttttttatttagaggaagtcacttgatcatgcttttccccccacccatggcataggaaaatgattcttttgctgattgtgctgattaaatgtgatgtggaaaaacctactcctggtgttcagagaggttttccaggtcacagtggggtgggtctcatctggacatcagaatcattatgttaatgataactaagagcagttgactgcttactataagccagccactgacctcagggcattgcataactggcttcctttactcttcacatcagccctgtgggcttgggagtgagacctctacctagtttttaaacaaattacataaactttttggggctcagctccctcatctgaaaatcagaaaatgatacttctctggcattttgagcatgagttcaggagtcagacttcctgggtttgaattctagcttcttctatgactttgagcaaattactttaactttgctaagcctcaggtttctcgtgttgcataggcagatgatagtcatatctgaatgtaacgagaatcaaatgcaacctgggacacagtgaacacttggtgaacgttagtgccttggtaacagtgatgatagtgacaataaagatcgatgatgatgatgatggcgatggtgcttaacccagtatgaaggtgaagtgtctaagcttcttgagggcagagttttgtcttcttctgcactttctttctagtgtctagaattgcctgtaggtttacccctggatcccgtcaggatggggctaaatttagaatttttggaaagatgtgagctagcccgtctacagtgacatccagctcagtgtgtatgtttggtctgtgaacatagtagaggcatgattcaactgtgagtttgtgctgggagcatagatggatgcttttcaggctcttgaaatgtgcaagtgtggttcccttgcagcaggcattgcctctccctcgttaatcaagatcttttccttgccaggacttcaggagatcctggacatcctctggagcccaggggtggcctcacccgctccttgctttagcctggaatgcaggccctcaacattccagccttgggttagtgccagagctgtgaaagcagggcaggcatttccaccttgcttgacaaaggcttttgctctctgggtggttgggggtgcctctgaagccaggcgagaccagagatctcatgggtttgtgtttcttcattgatacttttaaggggagcaacttaatcagtgggaaaccagatctcaaaggatgggacagataaacgcagggtacagagaagagcttgggggagtgtcaagcttatttgcccaaaagggctgaccctaccttaccgccattaatacatgtccttcatgcatccctgggtaacagggaagtagtaccaaaaatcttacagtgcaataaacacttggcagaaatggagaaactagtaatggctgagcagctgtgccctctccaccacctcactatgcagtacgtgggccaccagccgctaggggcctggcagccacagagatgagggaagcatgctgaggaccctggtgtggagttggaggggtcatgtcctctgaaaggtggccaccactcatcgccagcccttactgtcatgtgagaatgtggctctgtgtttccagatattgtttttttttttcccctccaacagaagcaggaaatataaaaaatttatataatatatataaaatatattatatataaatatataaatatataaaaataaatatatattatatatataaaaatatataaatatatataaaaatatataaatatattatatataatatattaaatatattatatataatatatttatataatatatataatatattatataaatatataaatatataaaaatatataaaatatataaatatataatatatattatatattaatatattatatattatatataaatatataaaaatataatatatataaaatatatataaaaatatatgatatataatatatataaatatatatgtataaaatatatattatatattatatactatatattatatataatatataaaaaatatatataaaatatatatataacttcacggaaactctgaaggagaggtcaaatataatattatatattttatatatataatttatatatatataaaactatatatatatatttttgagagacagtcttgctgtgttgcccaggctggagtgcagtggtgtgatcttggctcattgcaacctctgcctcccaggttcaagcgcttctcctgcctcagcctcccaagcagctgggattacaggtgtgtgccaccatgcctggataatttttgtacttttagtagaggcagggtttcaccatgttggccaggctggtgtcgaactcctgacctcatgatccgcccaccttgacctcccaaagggctgggattacaggcatgagccaccgtgcctggccaggaaattatatttttatgagaaatattctgttgtttaaattctggcacctcgttctttttttttttttttttttgagacgaagtttcactcttgtcgcccagtctggagtgcagtggcatgatctcagctcactgcagcctctgccttctaggttcaagtagttctcctggctcagcctcccgagtagctgggattacaggtgcctgccaccacgcctggctaatttttgtatatttagttgagatgggggtttcaccatgttggccaggctggtcttgaacacctgacctcaggtgatttgcccgccttggcctcccaaagtgctgggattacaggcgtgagccatggcgcccggccctagttcacaaaatatatatggccaaacaaaacatgtctggggctagacttggacagggggccccattgtgcaacctcttatatagcaaattagagtttaccaggaagtttctgcccttcaggccctctgctctcacagaaactctatgaaggagaggtcatcttgtctatgtttgtaagaagtcacattgagagaaatgacatcttagctcctcttatgtgccaagtagtttgtctgcgttatcttcttagattggctccatctctcaggtgaggaaacagacttggaaaggtgaagtgacttgcccacctagttagaagcacatcatcttctgattcctgtctcatttcatttcaccgcttgtttgccctctctgtggtcttgcccacggacttgtagtccctgatgtacgccaggcctctcacagtgtggcccccgggattcccttttatgaaaaaaagttgagcatgagctgtaagttagagtaggttttaattctgtcctaccacggagtctgttttatatgagaacaagttatttaactcctctgagtgttaatttcctcatttttttcctttctttcttttttttttttttaaagggccagtccccattctcacagggtgtttggaaggagtaactgaaggggggtatataaagccgctggcagccaggcatggtggctcacgcctgtaatcccagcactttgggagcctgaggcaggcagattgcttgagtctaggagttcaagaccagcctgggcaaacatggtgaaaccctgtctctataaaacatgcaaaaattagccaggcatagtggtgcatgcttgtaatcccagctacttgggtggctaaggtgagaggattacttgagccagggaggttgagactgcaatgagctgtgattgcgccactgcactccagtttgggtgatgcagtgagatcccatctctaaataaaaaaaaaataaataaagcccctagcatggtgcctggcacatggtaggccctcaaaagatgaccctccaaagtggccaggactcaccatgcattcagggaatatggattcttttggtggcagcaggctgcatttttgcctggctgaatgcctgcaagcatgggaacttttgatgcaacagtaatccttggggtctgaaaggccccaaatctcccgccagatctctgaggttaacatccagtcaaccttttgcttttcattcttggcctctttcctcctcacctccaccagtgtgacagtcatatcctctctatgtttctggtaagttctggccttgagggctggtcttatgactgacaagtgaagagcagtgccaccctctactccacattctcagaagcgtctctaggttccatactttaaggcaggctagcttccaaggcatactgacagacatccctgtgcagtcctgggggcacgagggtcccattccaccctggggcttcagggtcaggtgaggaaggtagatccctgaagttgggtccagaaaaggccactgggctagcctgtctctcgttctggtcactgacctcaggatccagcaggacgctgctagcttgcttggctcagctctgcgagtgctgggagcaataagcagtgctgaaaacgcgatgcatttcaacccaaagcactctgatccctttccaggctttgggagaatgttttttccagctcggttacttgctggcatgcataggtcaatatacaaggtgttctcagagaagccggagctgaatgttgacttttgtgctccctggggtgtgttctggggaggaagtgggttttcaggttgtggtgcgtgtaggatgtggtctgggatgattagtatcacacactgtggataaagttaacacgcattgtggagcttttttcctcttttgtacttttgggcgaaggtgcctcaaaagcagctttgtttatcaaggaggtgcccttgattctgtatgcatttttaacatctgaatagaagttagacgcacacataattgctttacttgatgcagtaaatacgtttcagccagataatccataagaccctagttcagatcctgactttgatccctcttagttgtgtgagctctcaccagtttacttgacctcactctctgagcgtcagattcctgagtgtaaaataggtacaaaaactcagattgttgtaaggtttcagtgagttgttgcgtgtaaagcatttagtatacagttcttgtcacaatgtttagtaatggcagctattatcttaactattagagcggcagtttggcgtggcactaataatgatgatggtgacagtttcactgagtgcttactacctcagctattcttccaagtactttgcatcacttagctcatttaaccctcacaataaagcgataaggtaggtgctgttctaatctctgttttacagatgctaaaactcggcagccaggtgtggtggctcatgcccgtaatcccagcactttgggaggccgaggtaggcggatcatctgaggtcaggagttcgagactagcctggccaaaatggtgaaaccccgtctctactaaaatacaaaagaattagctgggtgtagtggtgcatgcctataatcccagctactcaggagacagaggcaggagaatcgcttgactccgggaggaggaggttgcagtgagccgagattgtgctatagcactccattctgggcgacaagagcgaaactctgtctcaaaacaaaacaaaacaaaactcaggcacagagaggttaagtaacttgcccaaggtaacccagctcataaatatgaaaagagcagggactttagagtcagaagacctgggtggcacgcttgcatgccgtgtcctggtggtgtggcctaccgcagagtgactgactctgattgccttcccaactgtaaaatggtgctaatgatacagaccgccccccattgcctggtgtggtgcgcggctgtgagtgcttaataataggtgcttaggcatcatttgctaattaactgactgtgttaggttattaggaagttccagtgggctaataaaagctctgggtaaacgttagttgttcttttaaatgtcctgaggtgcttatgattggagtttaaacagcacacctgtttttcagatttcggaaccacttaagagaggcacagtgtaaagaaggtggagatgagaatatcacctttactcctgatacagtcttggagaatgcagcttagttgtggggcagcattagctttctgatatgaagctgagattaggtggatgtaccaggccagtcacgggcagccttgggtacccagaggccttctcacgtgggtcgaggcaggtggtggaggtggtggcagcggtagcccccataatacttctaggtggaagaacagaccacctgagtgagagaaatcactcctgagccctgggggagaactgtgtggaggggcagatgggagcctggagttttgagggaaaaaaaactttccttttggaagccagacgtagggaagaagcatattgatcacaatgactattaaagaaagctccccaacaccccagcaaaacacccacaaaacaagaaactacttctgccaatggttctagccagttttcttcaccacagttcatgactgcttcatccttttaggtgatcacacccaaaacttttgggtcttcctgcctttttttttttttcttttgagaccaagtcttgctctgtcacccaggctggagtgcaatggcacgatctcggctcgctgcagcctccgcctcccgggttcaagtgattctcctgcctcagcctcccgagtagctgggattacaggcatgtgccaccatgcctggctaatttttgtatttttagtagagataggctttcaccatgttgaccaggctggtcttcaactactggcctcaagtgacccacctgcctctgactcccaaagtgctaggattacaggcatgagctaccacacccagcctttttttaaaacaaaaccaaaaccaaaagagacagggtctctggtgtgcagtggtgtgatcatagctcactgcaccttgacctcttgggctcaagcaatcctcctgcctccacctcctgaatagctgggactacagatgtgtaccatcacactcatctaattaaaacaattttttttttggtagagatgggatctcgctatgttgcccaggttggtcttgagaactcctggcctcaagcgatcctcctgccttggcctgctaaagtgctaggattacgggtgtgagccactttacccagccttgggtcttccttgactcctgactctcaaacctcatattcagtccatctgccagtctgtgggttcaatcttcaaagcaaacccagaaccttactacttctcacctctccccagccaccgctctggtccaagccaccatcgtctctcacctggattagtgcggggctctcttcctggtctccccacttctgcccttgtccctcttcagtctatttctatgaggccaccagaattatcttttttaaaaactgaagtcagatcatgttgctcctctgctcaaagccccgcagtgattccctggcacgccgaggggaaaaggcaagatcctcccaaaggcctgtacgatctgcccccggcagctccctggcctcttcattttgtgcctcctctgccccctctgcagagccacactggccctggtagtttctagaacacgtcacgttcatgcctgcctctgggctttgcatgggccttcttcccaggcacaacgtggggctctccccacttcttccaccctacagagaggccggccctgatcagctgttttataatagctcctcccgatcagtactcctgatcgctccctactgtgctgtgccttttttttttttttttttttttttttgaggcagagtctcactctgtccattgcccaggctgtagagcaatggcgtgatctcagctcactgcaacctctgcctcccgggttcaagcaattctcctgcctcagcctcccgagtagctagaacacaggtgcccgccaccacatccggctaattttttgtatttttagtagaggtggggtttcatcatgttggccaggctggtctggaactcctgacctcaggtgatccacctgccttggcctcccaaagtgctgggattacaggcgtgagccactgcgcctggctgctctgctttttacccatagctctggctctaatatatgacactgcccctccctgaattagaatggaggctacagggggatgctggtctgttagttgactgatgcatcttcagcacttaagacagtgtctggcacagagtaggaacagaatatggtcctgtaacaaatactgaaggttgtgctctgtgcacctgggatagagcaggagcaagacacatcattcctgccctcacagggttatggtctcctaggtgacaaggtagtgcacacttccataggtcttactctgggacaagtactgtgccaaatgcttcctcccagccgcctgatgaggtagctactgttagttatcaagtctgatttacaggtgaggcaaagaaaggataagtaattgacccaaggtcacacctagcaggtggtgaagctgagccatgggtcttggcttcaagaatctgtgctcttacccaccatacctgctgctgccggattcaaacccgaattgcattaaggaatcatcataacctgtttgattgaagctataagggaactttgagcatggtgaatggggcgctctatggaaaaggggttctgggaagcctctgtggaagggaggttttgttaagtgaactcccctggtaaacggagtgattggcccccaattagcttgctgttcggattaactgtaatacatcacactttcgaaagtgaagatatgcctattttttcccctctaggtctataaagtagatttttgccattagtaaaatttaaagtgattgggggctatggttactgagaattcaagaggtagattgacgaaataatatttgaatgcaattttattttttgaaaaatgttttcgagatgtcctgtttttagccaggaagcaaactccaggaaaactctcttttccattaaagtgtggatggtgtactgtaaacaaagactagctctcttgagctgccacgtttctataacttatagaaacagaagctgttttttttttctaaagatccaaactcatgttgccacacaaacaacaaaataaaccagtgtgttccaaaaacaagcatttgctctacccacacgcacagttggaaagatgcaggtttgattgaagaagtcggaagccagtgaggtaatggcagattcttttaggggctcctgttaattttagtaagcttggaagaagcttctaggttgtttagtgtttctattagaaccatcacctcaacgaatttgttattgtagagattgattaggggatctgcttcctttgagcagccaggatcccccagctccagcttctagcctgcttttcttcctcatctctactctttcagaataatgcatggctttcaagtcctgtgtgataggtggcttcttagcgggcctctgaaggggctgagatttgttcctggggctgagactttgttcctttgagggtgcagaggctgctacctgctcaggctgcccccaaattgctcttgtgtgcagtgtgctgcttggggaccagtcctggctctgccaccatggcggacactactggcttcctcttaatctcaatctcttcttctcctttctttcttttttttggagacggagttttgctcttgttgcccaggctggagtgcaatggcgctatcaatcgttcaagcgattcttctgcctcagcctcccaagtagctgggattacaggcatgtaccaccacacctggctaattttgtatttttagtagagacaggatttcactatgttggccagtctgatctcgaactcctgacctcaggtgatccgcctacctcggcctcccaaaatgctgggattacaggcatgagccactgtgcctggccctcttctcctttctaacacaagcctgcttctcagtttcacgcacacataggagtggccacctgaccctgtgttggcaaatgattgcaggctgttgtcaccggtggggctcctggaaaagccctctatgggggattgactctggcatgactggggtgtggatgctgtgctcagaggtgctgcagtaatggttctgctgctgctgatagtaacacaggcagtgctgtgtcatgcacagtaatcctgtaagggagatactatcatgatctctgttcggtggatgaggaaacagtctgaggaaaggcacctgacctgttcaggccacacactaagtacagagctgggatcctggcaccagcatttgctctcaccacctctctgttatgtacctctcacacaggtgcgagtcccaccccagaggggccttgagaggctgcaagtgtcctgggtgggctgcctgcttcaggaggacttattattggggaaaaataccccccctacttattactaagggccgaatgctttatgttcacacaacaactccatgttgtgtgactttggacatgttccttaactttctttatcttggtcttctcatctctgtaaaattgggatcataatggcaccaacttatagttttttttttttttttttttcttttgagtcaggatctcaccctgttgcccagactggagtgcagtggtgtgatcttggctcagcccttgggctcaaacgatccccccacctcagcctcctgagtagctaggactacagacatacaccaccatgcctggctaattttttttttttttggtgggttttgctatgtttcccaggctggtttctaactcctggactcaagtgatctgcctgcctcggcctcacaaagtgctgggactacaggcatgaactaccatgcccggccaaacttctaggtttcttaaaaaagtgcctggcaggccaggcgcggtggctcatgcctgtaatcccagcactttgggaggccgaggcgggcggatcatgaggtcaggagatcgagaccatcctggctaaaacggtgaaaccccgtctctactaaaaatacaaataattagctgggcgtagtggcgggcgcctgtagtaccagctacttgggaggctgaggcaggagaatggcgtgaacccaggaggcggagcttgcagtgagctgagatcatgccactgcactccagcctgggcgacagagcgagactccatctcaaaaaaaaaaccaaaaaaaacagtgcttgttgttcttttgttgttattgttaaaggatcattatctcattatcaacaacattggcaggtaattgagcaactgtttgtctccttgtcaatgtggagatagaaaattgcctacgaggttggacaaggtgctggagcagcgtcaaggaagagagatcgaacaagaagactgctttgcccttggacagctttgtttctgaagcactttctcatattctcccatttaatcatcccctccctgccaacttttccaacaggtgcatacttaggtagagctattctttatcagcctggggctaagatttgttcctgggcaggttatctttgtctctgcctggatagaggcaggggcagtagagttgtcatgcattccagactactagctatgcagaagcaggagcaaggtaagagcagatttgtatgaatgagggtgtcagggaatatcttagatgtccatttagttgttaaaaaagagaactgatgcctatatttcaaaacccaactttgatctggatgcagtggctcatgcctgtaatcccagcactttgggaggccgaggtgggtggatcacctgaggtcgggagtttgagaccagcctggccaatgtggtgaaaccttgtctctattaaaaatataaaaattagctgggcgtggtggcacacgtctgtaatcccagctacttgggaggctgaggcaggagaatcgcttgaatttgggaggtggaggttgcagtgagctgagattgcaccaatgcactccaggctgggcaacagagcaagactccatctcaaaaacaacaacaacaagaacaacaagaacaaaagaaaaaacccctaactttggagaggttatctcctgaaaaggagggttttggtctctttctcgcactgctctaaaatagtgactggcacatagtaggtagtcagtaaatatttgttgaatgaatgaatgaatgaaaggtaattggccttccctgctcagttctcattaaaaattctggttttcacatatatgggcagtgtcccaacaggctgctggggggtggccgtttgtgatggcctcaccagtctttcccagagagggaagtgcacatttttaggctacttttgctctgactgatacacttggctgcctaacaaaaagccagagaagaactaagatttttagcatcattcaaaatgcttgccattccttttgctttgtgaaatcatgagctagttattttgagttcacataaaggtcagaacttgatctggggaaggaggttccccttggtttatgtgaggggaactttttcgcccttctgtttattttatccaaaggcttctgtttttctcccaagctaaaatctggcatttgttgtagaaagttctcagcttatgtgtgtgtgtgtgtgtgtgtgtgtgtttttaaaaagagctcatattttggctttagttttgattctcagtgattttttttttctgcctgagagttgattttctgcttcttcaaagtccagctctcaagtgggtgcctaaagttgtttcgttttagaggtgacttaatcattttttaggcctttaagtgctgctcccagcttgtgtttccttctgtttttagtttttatgtggggcagggtctccaaagtacacgggctcttttccccacccctctaccctcattttaactgtgcatcaaatgggtcctgtttcttcttcatgtataattttgtgagtcagggaaggtggtgaaggcccttgaaccctggctttgtcatggcccttccttaaggacctgaaggtctcttctcctaagggctaggttggttcagaaagtgagaagggctggaccttttgtggggagaggatacagcagggtccgaacagctgggctgacaccgggcagcagcccagcagcagtcggagctgcagggtcagctcaccatgggctgaacttgggcattgcctgtttaggcagagtctgcccgagcctttcctgctccctgagaatcctcagcatgttttcctgctgagcaaggagtgaggaatgaagcccactacgaagcccgagctgcaaatgtatttatttatttatttatttagagacagagtcttactctgtcgcccaggctagagtgcagtggtgagatctcagttcactgcaaccaccgcctcctgggttcaagcaattctcctgcctcagcctcctgagtagctgggattacaggcgcccaccacgggcccgagaactgagtctcgcccatctaatttttgtatttttagtagagacagggttttgccatgttggtcaggatggtctcgaactcctgacctcaggtgattcacccaccttgaccttccaaagtgctaggattacaggcgtgagccactgcgcccggctctgagctgcaaatttaatagggaaactgaaggaagaggttctccacagcaccagtggggctgagacctgttttcctcaactacctttttttttttttttttttttttttttgagacagagcttcactcttgttgcccaggctggagtgcaatggtgcgatctcatcttactgcaacctcttcttcccaggttcaaacgattctcctgcctcagcctcccgagtagctgggactacaggcatgcaccaccatgcctggctaattttgtatttttagtggaaaagcggtttctccatgttggtcaggctggtctcgaactcccgacctcaggtgatctgcctgcctctgcctcccaaagtgatgggattacagatgtgagtcactgcgcctggccaactgctttggtttctgagtcctccctcctctaagcccgctcagtgtgtgtcattcctgggaggcggtggctctcccaggaccccatgccgaaatctgccttcttcttgtcttcattcccccacctggggtacccctcagtgttttcccattacacagattcacgtttacatgttctagaaacatctgtaagtctttttcctgtttgtaaattgtatatcctctgttagattaaaaaacttttaaaagtaagtgtctttctctgtggtgacctatttgtgtggcatagtataggttacaaagcccttttcatgcattgttttacttataagtaatgtttatagatgataccgaggtagaccctatggggtgcttactatgccaggtctgttctaagaatgttatacacattaccttactaacccaccccaaccatccattgtgttattgtcacccctgttacagggtggagagaagaaggcagagagaagtggaatgacactcctgaggctaggcatttgccaagtgaggtctgggatttgaacccaggcagctgaacttcagaatcctggtgtttaaccactataccatgctggccttcatgttattgagcaggataaggaattgtcactcttgacttgtttttgaaacatgaaaacccttctcttaaattcaaaagtaatacatagctgggcacggtggtgtgcacctgtagtcccagctacttaggaggctggggaagaggatagtttgagtccagaaatttgagactgcagtgagctctatagtcatgccactgcactctagcctgggtggcagagtgagaccctgtcaaaacaaagcaataacaaaaaaaaccaaagtaatgcgtattgcagcaagtacttaaataatgtagatgcataaaagcaaaaagtgagaatccccactcctcctccagtgctctgagatagactgaagtaactcttcagggatgagtgtaaacacaagggatgtcctcgaagactttccacttggaaagcttgtgtattttatacattaagtatcataaatatgtagttaccctaatgggtccccgccattgctctgcaggcagtgggctgaggttcaggagttaagtcagccccagggcacagggtggtgcaacagaagagcctgagtcgaatccagatctcccctctccactgtgactgtttcctgggaaactagtcaggggctggttttataggaattatccagtcgtattattattattattattattattattattattattattattattattgagactgagtctcgctgtgtcgcccaggctggagtgcggtggtgccatcttggctcactgcaacctccgcctcccaggttcaagcaattctcctgcctcagcctcccaagtagctaggattacaggcttgagccactatgtccaactaatttttttatttgtagtagagatggtgtttcaccatgttggccaggctcatctggaactcctgacctcaggtgatccgcctgcctcggcctcccaaagtgctgggattacaggcgtgagccaccgcccccagccttccagtcgtattcttgacaaatggttttccatgaagttgtggacaccttccagggtcacaattaaatggttaaatgagtcacgattaaataatgattgtgggtacctcccagagtttcaatgaaaaagggaattaactttggacacagacagaataatgcaaatcttcagttttggtttagaaaatctgaaacctgcagtggggaatacagaaaagaaggaagtagaaggagtctgtccccaaccccgccccttccttttttctctcctctggagagagaagggattaggaggcctcctggaaaggagtccctttcctgtgatcaaactcaccccttccctccaccagagcaattacagagcctccggcctggaaccttcctcaccggcctggaggagacaccattctgcggacaatggggggaaggaaaggaaagcaatgccgctgccaatggtgcggatgacttcctcaatgccagacttgcttgcactttcaaagtccctcctcggaggtcccctggtaggacctggagataggatgtgctttcactctttacagactattgtccaggaaagaaagtttcagactttcttaggcagggaagggccctctgactgtgaatttatttggaaatttgaaagagaagagagtcttatcctaggaagtgttctttttctttccccctggatttgacaggccaggcaacagcaattatccaaaccactgctctgcaccaagaggcaaaccacaggaaaaagaaacccgaacaagcaaggagaatagaagttccccaaagcatgccttcttgtttttctcagaggacagtcttttcattcatgttttacagattggtccaacaagtgcagttcttctagtctcctatctagataagcaggatattagaaggaataggagaggcctgcaaaaagctatgatagggtggaaataggataggagaaactgaaaaaaggggaggcgtgcgctccaacacctccatagcccttggggacgggcttagtttctaatgagaatacagaaggcccatgtctcaataggccccgaaaaatattaatccagcccaatatgaacagtctgctaattatatgactgggcctgcttaggagatcagggcaatattacattcagagtactcagtttaggaagatgacacagtgtaatacatacagatttccatcatttcttttattcctcatttggagaggcaacagggctgagatagacatgttagcgatggctagattgattgatttattgactgaatgaatggcctgctttaggcagcgggaacactgaatgaacattttaaaatcagctggtataggtcaggaactgtgcaggttgctgggaatgggtagatgaaaagacattgctatggtttggctgtgtccccacctaaatttcaccttgaattgtaatccccatgtttcaagggtgggaccaggtggagataattgaatgggggggtggtttctcccatactattctggtggtagtgaataagtctcacgagagctgatggttttataaatgggagttcccctgcacaagccctcttgcctgccaccatgtaagatgtgactttgcgcctccttccccttccaccgtgattgtgaggcctcgccagccatgtggaactgtgagtcaattaagcctctttcctttataaattacccagtctcaggtatgtcttcatttgcagcatgagaacagactaatacagacatggaccttggctgtagggagtttgcactgtagtgacggcaagagctcacgtgatccattttaagatagaagagcgagctcaggcagaggaacacagagccaggatggtccatgcacggaatctggccctgcccttactttctccaggagcatgggctgggtccctctcctccctaatcctcactttgctcatgtgtgaaatgtagatcaagtaagttctacactcagaggtctcttgtgaagattaaatgagaaaaggcatggaaactgcctttgcacacagcctggtatatcctgatgtctgctgatactcttatttttatgttccttgacattccaaatctgccccagggagaattccaggacagctctggagaggaagtgatctttgaatccaaccttgaaatcaccctaggagatgcaaagaaggtgacaccagttaagaataagatgtgtacccattttcaaatgttcttttttttttttttcagatggagtctcgctctgatgcctaggctggagtgcagtggggtgatctcggctaattgcaacctccgcctcccgggataaagcgattctcctgcctcagcctcccgagtagctgggattacaggcgcctgccaccatgcccagctaatttttgtgtttttagtagagatgggatttcaccatgttggccagactggtcttgaactcctgacctcaagaatccacctgccttggcctcccaaagtgctgagattacaggcatgaggcactgcacctggcccaaatcttctcagttctaaatggctgtgataaaaactacattgataatttttttttttttttttttttggagatggagtctcgctctggtgcccaggctgaagtgcaatggcgcaatcttggctcactgcaagctccgcctcctgggttcacgccattctcctgcctcagcctcccgagtagatggggctacaggcgcctgccaccacccccggctaattttttttgtatttttagtagagacggggtttcaccatgttagccaggatggtcttgatctcctgacctcgtgatccgcccacctcagcctcccaaagtgctgggattacaggcctctgcgcctggccttgcattgacaattaatttgtttatggaaagccagttatccaatgatggtgaacaaatgcaacttgactgtataatacttattttggttttggaccaaagtcaccattaaatatgccaagttcttgttcaaggaaacagctaatgtcgtggacttgcatctcatttgtagttggttctccctgaaaagtcagtggtgtgggagaaatgatacttagtcaaaatcatcagtgaaaatcattgcttggatcatcccaaaatataatgaacaaaagtgatatttatctgccacattgagaaacattcaccatatctcaataagctctcctcagccagttggtccttttgtggttgaaaaaagtgccatatctttggttgggcatccaataaaatatggtatttaggggctacctgtatggaaaatccatatccttaaaggttagctcaccaggaggatgttgagaaatggcacaaggggctgggcgcggtggctcatgcctgtaatcccagcattttggggaggctgaggtgggtggatcacttgaggtcacgagttcgagaccagcctggccaacatggtgaaagcccatgtctactaaaaatataaaaattagccaggtgtggtggtgggcgcctgtaatcccagctactagggaggctgggcaggagaactgctggaacgcaggaggcggaggttgcagtgagctgagattgcaccactgcattccagcctgggtgacaggcaagactctgtctccaaaaaaaaaaaaaaaaaaaggcacacaggaattgggttgggactcagtagatcagtagatttagatctcccagcttagtctcatctccatagtgtgggtggagtagtactcacactatttaaattatttttatttcactacctgaatcccctcagcaagtatagtttaattcacctgagtaatacgcttatgcgaggggatttctccatgggccttttgtttttgctcctgctggtgatctgattttaaatgtgaacgtgccattgctaagagtttttgttctatgtattattctgtgtggaaaatttcttaaatgggattattgaagtatacttcattatttatcttctggcaatttatcaacaacagcaaatatcattcattattgtttggaggacagaactatttttatattctttaattaaaaatggctttgacattttcaaattcagagggaagttgataatttagtgctgtatgataggacctttagttggtctgaatgtcacataattgtacaaattgctgttaaagtatattattacttattttctgagaggtagagggacttggttatcctgggattgcataattattggttcactagaactacagatgagtgaaaagaagggttagatactctctagttcacttttcttccagtgcagggaacattctatggggttccgaacagatataataagctcataataacagtggccattgattgaactctttctatcaaacaatgtgaaaaacattagtagaggtgatatcttagtctgcttttgctgctgtaacagaatacctgagactgagtaattttttttttttgagatggagtctcactcttctgcccaggctggagtgcagtggcgctatcttggctcactgcaccctccgcctcccgggttcacgccattctcctgtgtcagcctcccgagtagctgggactacaggctcctgccaccacgcccggctaattttttgtatttttagtagagacggggtttcaccgtgttagccaggatggtctcgacctcgtgatcctcccgcctcggcctcccaaagtgctgggattacaggtgtgagccaccgcacccagcctttttttttttttttttttgagatggagtctcgctctgttgtgcaggctggagtgcagtggcgccatcttggctcactgcaacctccacctcccgggttcaagcaattctcctgcctcagcctctccagtagctgggactacagatgcatcacgcccagctaatttttgtattttcagtagagacggggtttcaccatgttgtccaggatggtctcgatctcttgacctcatgatctacctgcctcagcctcccaaagtgctgggattacaggtgtgagctaccacgcctggccatttttttttttttttttttttgagacagagtctcactctgtcacccaggctggagtgcagtggcatgatcttggctcactgcaacctccgtctcccgggttcaagcggttcttctgcttcagccttttgagtacttgggattacaggcacctgccatcatgcctggctaatttttgtatttttgtacagacggggtttcaccatgttggccaggctggtcttgagctcctgacctcaggtgatccactcacctcatcctcccaaactgctgggattacaggtgtaagccactgtgcccagccccaagactgagtaaggggtgagcagaaattcactggttcacagttctggaggctgggaagtctcgtatcaaggtgccagcatctggccagggccttcttgctgtgctatcccatggcagaagtacagaagggcaaagaaagagggctgaacttgcccttttataatggcaccaaccccacccatgagggtggagtcctaatggcctaatcagctctctgagatcccatctgttaatactgttacaatggcaattaaatttcaacatgagttttggaggggacagacattcaaaccatggcaggtggcaagaagtatcaaactactagatccttgggattgtgctttgtactggggtgtattttttccaacaatcctaaaaatcatttgaatagagatagcaatatatatcttacccatttggaaatgcacagagattcaggagtgttcacatagaaacagaagatcattggcttttgtccattcccaacgccagtgatctgtttttcttgactctttttgatctgtgtttctgaatgtgttgatatactgcgctactggtgtgcaggatgattttaaatgttgcacagatgaacattaatagtcatctattttaatatgtattaggaaaaagcccataaaacaatgaagcccattaaaaccccatggtttcttggatagtattacatagggtgaagctaattttatttcagtaaaaaatatgcaggtcaatttaaataaaaaaatagataatagtataaatggcttgtggctacagtaaaaatgatgatggtacttgaatgtccaaattaatttaagtgatatatgtgttcatagataccatttcattttaacgtggttctgctggtcagaacagtcttacgatgggggtggtctccaggcttcaccttgtgcccactggctctgtttggttcctctgggctcacacacagggagctacgtatgtctctctcatttcctttggtatgttctctgggttaaatgtccccagctatctgatctgttccctgcgggccttggccattcctgtcctggcctttactggcagtctctattctaaaatgtgggcatcccacatgaggtccagcttctcctgagatccccggaggtgcagctgctgtgatggtgaccttgtttagcagatgctccctgcagtccaaactcccacccatcgtcctgccctttgatccatttcccatgaactgcttacctcagttttctcatctgtaagatggagagataactgtaagtgcttagcacagtgtttactagcacagactactgctattactgtcaagtcacttttcctttgctgccaataggtcattttctgtttatggcttcttcagtatgaactgatcaactgtaacttgaaaatttccagacttaggacttttggactcatagtgaaaggatcctttcccaattcccttgatcggtttttcctttaaaaaaaaaaaagatatttgacatcttttcactttcaagttcagtttctcttctcctttttttctgggtgatggtttattatttaaaaaatttctatgtatatgtgatttaaaagtaaacccacgtagctgaaaatgtctcataggtttttcttgcattttcagttgacccattcactttgcaaatctttagagtattatatttaagacagcttgcagctgttttcttatatatattttacatgacaaaattatatttaaaacatattaaactttaaaaaaccatagtttataatttataagccatgtagcatatttctatttttgagacaggatcttactctgtcacccaggctggagtgcagtggctcgatcatggctcactgcagccttgacctcctgggctcaagtaatcctcctgcctcagcctcccaagtagttgggactacaggcacatgccaccatgcccagctaatttttatattttttgtagagatggggtttcaccacgttgctcaggctgtaatttttaaaaactaaaaaaagaaaaaaaagtgtttacaggactttaaattgagaaacttaaatatctttacatattctgtgttcctaatttatttttgcagcagtaattatttcagctgtctttagtattgacatgttggaacctcggattaatttgtgcatggatatatttagagccttttacttgacaagaatcatgtatatcatgactgaatttgtaatttcccagcatgagacccaaattaatagacagtatttagattctaggcaacgatgcattatataaaccagcatcatttagggagtggcaaagactctctccccaccagttctgtgaacttgggcaaggtgtgtaatctttctgagccttaatctaattagaccctttctcctgtaacccagagggggtgttagtaaagttggtgtgaaaaaagtcaattattgtactgatgcaatttgggtgaaactgtgaagttcagtgttcacatgatggttgtggagacactgaaccttaatccttaggccagggattcaaagttttttttgactctcatgttgaacgttgtctaaagtgcagtgtgccctagtttttaggtaattctgagaattctaaggcccttgctggaataattaatgagaatatgagatttcagcaaattagggccaggagtcagtgctctcagcatggaagaatctcacctccaaaaattttatgtgggttttacacattaagcaagcataggtgaggtgcagtgaaggggaagtgatggctgtcagtcgtttggccaggttcctttgcatacaggggagctagtgggtgtataccagctgagacagctgaaggaggagaacatgaagaatagttggaaactattgaacctccaagatttttctgtctttgttaacaactagcagttacatgctagcattatttatttatttagttagttagttagttagttcttgagatggagtctcactctgtcacccacgctggagtgcagtggcatgatctcagctcactacaacctctgcctcctgggttcaggtgattttcctgcttcagcctcctgagtagctgggattacaggggcccgctaccacgcccagctaatttttgtattttgagcatgttggccaggctggtcttgaactcctgaccttgtgatccccctgcctcggcctcccaaagtgctgggattacaggtgtgagccactgtgcctggccttatttatttatttttgagacagggtctcactctatcacccaggctggagtgcagtggtgcagtcatagctcactgcagcttggaactcttgggctgaagtgattcttcttccttagcctccccagtagctaggactatagtgccaccatgcctggctaatttaaattttttttgtgtgtgtgtgtgtggtggagatgggttctcactgtgttgctcaggctggtcttgaactcttgggcttaagcgatcttcccatcttggcctcccagagtgctgcgattacaggcgtgggccaccacacctgtcctgtgctaggctcttaacgtccttcccagatgttatgtcccttcccttggtggctgctgctttctgccacattttaccttgcctttccgcaccttctaccatgtctccttttccagcctcattccctgagatgtagccggagttccagttcagccaacctgcccgttgttttctctcctggaactgggtgtttgagcctcctgcatggagtgttcttccttcccagctaaagtcctggtcatcccatttccatctgaaaggcccccttgttcatgaagcctctcatggtccttccccctaccccagccaggtatactttctctcctcttggaattaccctataggaagaacatggtggcttgacctgggttccagtctcacccatctgtttacctggggagtgatcttgagtgggtcaatttatgttctcagtgccttacaaaatggggcagaggatacctaacccccaggagctggtgtggctggggtaccttacacagggcctgactgtagtagcttctctccaagcattggtgtcttacctcttctgtttctctaatggtgttttgcacattcattgttgtattagagtttgtttttttgtcttaccttgttttaataaattataatcttatgggagatgacactgtcttttctttgtttcatatataaaaagtgttttgctgatatacgtagaatcaagttggtctggagttactctggataagggatgaaatcagggagctcttgtgttcaaaggggccttcttcccttttttggttctttctcctcattttttagcttccatttttacttcctttagtattgagaaagtaccaggctcacttcaaagagttgacttcaaagctcccaccagctcagacatacttgccactgaagcctgtaggaattggcatcaatggaagaccctgtggcggttgcatttaagattttttttgggacttctatttttataattcttttaaatggtaaagggggagggttacaaaatatctgcgcctttaagatatcaaacataagccagtgaagttccaaaaaaaaaaaaaaagatgtcttagagaaatgaaaaggattttacaattggtagaaaagaacaactcttttttctttttctttttctttttttgtttttgagatggagtttcgctcttgttgtacaggctggagtgcaatggcgccatctcagctcactgcaacctccacctccccagttcaagtgattctcctgcctcagcctcccgagtagctgggattacaggcacgggccactatgcccggctaattttgtattttagtagagacggggtttctccatgttggtcaggctggtcttgaactcccgacctcaggtgatccacctggcttggcctcccaaagtggtaggattataggcatgaaccactgtgcctggccaagtcttttttctttaaaaaaaaaaaggttacttttactgttttgtcctagttacaagatcttaggacagaaataaagccttaacttgtatgtaacattttccaagatggctaagtggagttgcaggttacatagcagaaaacagaggcttgggcctgttgagacctcacacccagttcttcttggagctgtgggtgtgggctgaaagagaagacagggagattaaagaccagtgatttccctccatggaccctttgatgctcttgtttgttgactttttgaggcttggagtgaccgactcttccaggaatgagaaatggaatccctcccagttttgatggtcgtcccaggacatatttcctgaaggcctactctgtgtctcagcaccattccaggactccccccgacagccttacggagcgtgctacagtcttcctgatccaatatcctgccacctgcccactcattcaccctcggccctaccccatgcctttgcacgaatctttccagcctgagcagcctgagatgggtctttttccctgctccgaaatcctgacctcataatggctcatgaatccctattcaaccttcaagacctggttcaagggttaaatcctttaaggagacttctcctgatttttccccagctggttgctttgttctccagcgatttgtaaccttgtgaacaaatattctactcattttattctactggaatgatctatttacacttatctccctgcaaattgtatcctgcccttcaatggctaagtgaatggcataaacagatgctataggaattgagactaagttggagctgggtgatcagggaaggttttaaggaagagatctgggacaaatagctaaagatggattcagtgttttttttttctttttctttttttttttttgaggcggagtcttgctctgtttcccaggctggagtgcaatggtgcgatcttggctcactgcaacctctgccgcccagattcaagcaattttcctgcctcagcctcccaggtagctgggatgacaggagcccaccaccacgcttggctaattttgtgtttttagtagagacaggttttcaccatgttggccaggctggtcttgaactcctgacctcaggtgatccacccaccatggcctcccaaagggctgagattacaggcatgagccaccgtgcccggcctgatggattcagtttatgtgcaaaatttaagaggatgggtttcggcagttcaggttgttaggagacaagggtggaaaggtgtcctggagccctacagagatgggcttcaagtgccagccaaggtgtttgaccatttttagaagaggaatgagatgattaaagtggaacttttaggaagagtaggagtgagcgggatggatttaaaaggcggagtgagaggcatcaggaaggctgggtaggagagcattgctacagtctaggagggaggtggcaggggtgtagaccagggatcacaaagcaatggcttgccatctgcttctgtatacccagagagctaagaatggtttgtaccttattaaatggttgaaaaaatcaaaagaatatatgctgtgatatgtggaaattctgtgaaattcaaatgtcagtgtctgtaaatagttttttttttttttttttttttttgtggaacacagccatacttttcatttatgcattgtttgtggttgctttcacacaatcatgccagccctgagtagttgctgcagagaccatatggcctgcaaagactaaaatatgtacttatgtactatctggctctttccagaaaaaatcagcagaccccaggtgtagaccaaccagggtgaatgagtgtatgactggaaatgcaaagacgggcaggatcaagggacagtttagagcaggggtgtccaatcttttggtttccctgggccacactggaagaagaattgtcttgggccccacataaaatacaccaacactaacaatagctgatgagctaaaaaaaaaaaaatcacaaaaaatctcaaaatgttttaagaaagtttatgaatttgtgttggtctgcattcaaagccatggtgggctgcatgcgggccatgggttggccaagcttggtttagaggcggatgcagtacgggagagttttcccttctcttctgatgtaactccatgtcttggtggcggtgttctagatgtaggcatctttaggcaggggagtgtgcgtggaagggtgaaagggttgtgccttcatgacgctcgtgtgtgtgtgtgtgtttgtgtgtgtgagtgatgctgagctagtcttagagtaaatgcagacactggatggtagcgagttcagtgcagtttttatggagggacagcttgctgcctgctgatgaagctggacaagactgggtagtgaagtcaaaggcccacacctaactctgaggctcttgggggcaactgtgttgtgcagagaaggtaggagggcagaggaagaggaggagcggcccctgggagaatgccttctacccagctgcagcttctcaagggtgtgtttgcgtctgacctaaggtgttggagctctttgtttctggctgtgttcaggctttcccccgcttgcctttaggggaagctgatgactgctttagcgtaaagagagggccaggaggtcaacttccctacagtcccgtgcctgcttctgggttggggctggggagagtgctgcccactgaactctctaaatgttaaaagatacaaagaggaagcacagagtgaaaagggagaccccagaggacagcagaacatcccgaagcatatcccccatcagagaagaggcatgattttcacctggcttgcaggtgcaggatgggcatctcagatgctgtgagtctgagggcagatgcccatcagtccaggacagttcctggggacaaaagcctcttctcacctttagagaaattaagtcttattggtagaaaatattttagagaggttctggtctaagcctctcattttgcagatgagaaaccacccaaggcccaagatggatggatttatcaaagccggttggtactggaacttggatttaatttcaggtcttttattattactatggaacaaatcttaactttttcaagtgcataccatgtgcccggctatgtgctggatgtagatgctttatctgcaggtttaatcttcactacaactatgggaagtagctattgtctctcttttgcaagtgtgaagagtgaggcttagaaaggccaacttgcctgtgatcgggtaactcaagagggaaattggatcagagtccatctgagactgactccagagccaatgttcttagccaataggggcacataaaactgttctgagtggcttcctagctcctgtttccagtgtccaatccattctcggtttctgttcattcatcagatgtgcactgagtacctgcaagaagtcagaagggtgttgggttggtgaggacagattgtataccatcttggctttggccgagccaaacagaatgccaaagatcggcaaagatagggaatgattgttcttggcctcagctccacgctcccctcctctgtaaaactgcccctgacaccccggcaggattgaattcctccacctttaagctcccagagtaccttagctctgtctttagcacttcacactgtgtcatgcctccccttgggccctaaggccaagagcatgtgccatttatttttgtattcctacttctatagcccagtgcatattgggggcactcaggaattgctgagcgaataaaagaatgaatgaatacagacccagattgtcaatgattctcaaaccttattttacaaaagaatcacttgaaaagctggttaaagatcaaaactcctgagccctactcctggtgattgactcctaggtttggggtgggaccccagaatctgaatttcccggaagcgcccaggtgtttctgatgcgggtggtctgcaaaccacacttgcagcaaccctggcacaggtgcccagccttctggaataaagacaggaactaagcattaaaaatagcacgccattcatttgcttgtgccgagccgccaagtgccccctcctgccggcgacaggtccggatgtgggccagttctcagcccagggaaaatgaacagtgtcttctccgtggtgcccagaacagtctgagtcagtggaatgtgctggccagtcaggcagaagggaacttccacttcttttttaaaaccttggtggaaactgtgctggcaaggcaaacagggaggagaggaagctccatgtggggcttgggcttggcggacgacttggggctggccggactttgggtggccgccgaggaccattgctaaatatgcccctttcgtcctgaaatagtcacttccccggctggcttttgtgttggtcggtcgccacaaatgtgtggctgttgttcaaggaggcctcctgggatataaaaagagagaatggggccaggctgcggccagggctgtgtaggaagacaggagagctgccttttctcctgtcccaccacggactcattgtaagattcagagggagtggcttctgggccctgggtttacttttccatctgtaaaatgggtggggggaaggggcagcatcataaagcttctttcttctcctgaaagggatgttttaaggcccatgtcaagattgaacacagggctctgttgttgggctgatgctactgatgaagtctcaggaagctcgaagtttgtagttaactctttcagggtagatgtggtgaatagtctcttggtattgtgttgatggtggcccactagaacagaaggtcccagagggcaagggcttggtctttcttcttcctctctgtatccccactgtttagaactgggctgggtgcagagtagtctccataaatgtttatggggccaatatctccaaatattggcacctactaagcgtcagtcccatctctcttttgtcttcttcacaggtttaacttgctgtttgagaagaggcgatatgaggagcagggcatttttggaggaagaaactttacctctgttttcaacgtttcatccagtttctcttctttttacttatttggagacatggtcttactttgttgtccaggctggaggctgaagtgcagtggcacaattatagctcactgcagcctcaaaacacctggcctcaagtgatcctcctgctttagcctcctgagtagctgggaccacaggcttacaccaccatacctggcaaattttttttttttttttttttggagaggcagagtcttgctccgttgtccaggctggagtgcagtggtgtagtcatggctcgctgcagcctctgtctcctgggcttaagccattctcctgcctcaccctttgagcctccttaattttttatttatttattttttttttgtagagacagggtctcattatgttgtccagcctgatattgctatttttttttttttaatggcgatgtagtaatcttgctttgttgcccaggctgttctggaactcctggcttcaggtgtgtgccactgtgcctggcccagttgctctttacatggtggaatatcagaggttaaagacttggtaaaaattcatgcggtgcaataaaccatgtattacataataggggtgacacttgttaacttctcccaggctcagtttcctcatgtgtaaaataggtgaatagtatctaccctccaggagttgtacaaggctcatgtatacatagtgtatgtgaatgtgctgtatgggtgcaaggggttgcagaagtgataatgtgtgtaaacagatggtgtggttggctcattggaggggtggaggccctaagtgagatgacctctgaggtttactcttcctagagtagttggaaagcaattcagcctcagtggtaagctctcagctcttctagggcaggtccctcttccaccaccctgtgtctgcaagcattttggtattaagttgtttttctaaggctgggtgcggtggctcacgcctgtaatcccagcacttttggaggccgaggtgggtggatcacctgagatcaggagttcgagaccagcctgaccaacatggtgaaaccatatctctactaaaaataaaaaattagctgagcgtggtggtgtgcgcctgtaatcccagccagctacttgggaggctgaggctggagaatcgcttgaacccgggaggcgaaggttgcagtgagctgacatcatgtcattgcactccagcctgggcaacaagagtgaaactctgtctcaaataaaaaatattatttttctaaaaagctcttattttattgtgaaacacttaaattagcaaatctcaggcttgctgaataaggcttcccaggcaaaccacatcccacatgtgcaaatgtctggtgacacagtgcttcatttttttccactagtacttactactacctgacattatagtgtaagtttacttgtctatttgtgtatggtctgcctctcctatgagaatgtgagctgcatgaggtcaggacattgttttgttcactcatgaattcccagcacccaggacagtgtctggcatgtagtgagtacccagtaaatatttgtggaatgaatgaatgaatacttaagtgggtgggaagttcttggaccttagtctagacccatggttctcaaagagtggtcctgggactcttggggattcctgagatccttttagggatctgtgaggtctgtgaggtcaaagtatttttataataatagtaaactatttgtcctttcactctcattccctcatgtatgcaaatctcagtgaactgatattttccaaataaccaatgcataaggccacaaagccatgcagggtaaaaagagctatgaacaaaagttttctagagaagaatttggaggaaagagagtttattctagtgaacagatcgcaaactgggagatgctgcgttggtgtaaaatgaaggtgcattccagagagcaaagagagaatctagttttttgttgttgttgttgttttgttttttaaattttgagatggagtcttgctctgtttcccaggctggagtgcagtggagtggcgtgatcttggcttattgcaacctctgcctccgggttcaagcgattctcctgcttcagcatcccgagtagctgggactacaggcacttgccaccacgcccacacaccctactaatttttgtatttttagcagagacggggttttaccatgctggccaggcttgtctcgaactcctgacctcaagtgatctacccgcctcagcctcccaaagtgctgggattacaggcatggcagaatctaggtttttatagcaaaatttctggcccatgtccccaatcaggtttgattatgcaaatgaagggggcgggtcaaacttgcttagttctgattggctgacacagctgagttctgattggtgatacagctgagccctgattggttgatacagctgagctctgattggctgaagcagacgagctctgactgcttggttcatgtgagctctgaaagtcccaagtcaaaagggtgtggggttttgtgaaacttggagtacgtagtgtgacctctagtcagcaaatggccacttggctgtattttaaatttaggtacactttgctgcttggggtccatcttgaggggattgcctttttcaggttcatgtttgttcacagagccattcaaagtgcagtggatacattataaattgtacaattatttgtaattaaaaaaagaacaacagcaaaaaacccaaagtgcagtggatgcaaagaccaatggattttcatgtaacagaatatgaaaagttcaccgacacagtttcacattccacgatgcagagaagtttttaataactgccatccacatgttgagttttggtgtaacagcaaagaaaaatatccacaactactgaaaaggctgagaaaatactccctttctcaactgcatgtttttgtgtgagtccagaatttctttacattattgtaacagagtgaacgcagaagcaaatatgagaatccagctgtttcttactaagcagacattaaagagatttgcaaatatctaaaataatgctatctctctcacttttttttttttttgtattggaaacatcattttccatacaatgtcatttatgttaacaggtgacagatttatttatttttattttttatttttttgaaacggagtttcactgtgtcacccagccacccaggctggagtgcaatggtacaatcttggctcactgcaacctccgcctcccgggttcaaaggattctcctgcctcagcctcctgagtagctgggattacaggcacccgccaccacacttggctaatttttgtatttttagtagagacggggtttcaccatgttggccaggctggtctcgaactcctgacctcaggtgatccacccgtctcagcctcccaaagtgctgggattgcgggctgggattgcgggcatgagccaccatgcccaacaacagatttattataagcaaaagctctttggggtcctcaataattttaagagcataaaggagaccaaaaagtttaagatgtgctggtcaagacagagccctgtggactatggaagggattgaagccattctgtggatcctataggcttcttttctaagcgaatgattagtgtttattcagtagccctatgtcaggtggtttctgtatgaatgagaggtttgcctttccagctgcggcggggctttgggcaagttgctgtctctgtgctccttcgtttgctcatgtgttaaaaactggcccaggggtctgggggtggggtggtaagaaaatgggttgagtctccttcatctctaacattttcatgtttaattcttggaacctccacttgttagctctgttcactcctctgaaagagattggtgagaattgaaacagtgaaagaagattttagagaaaaggtgacatgtaaagctgaacaagggttgcctgtgaggcaggcaaaaaggacatttattatatttaaaaaaaattttttttttgagacggagtctctgtcgcccaggctggagtgcagtggcatgatctcggctcattgcaacctctgcctcccggttcagcgattctcctgcctcagcttcccgagtagctgggattataggcacacaccaccatgcctggttgatttttgtagttttagtagagacggggtttcaccatgttgaccaggctggtctggaactcctggcctcaggtgatccactcgcttcggcctcccaaagtgttgggattacaggcgtgagccaccgtgcccagcccagaaaggacatttatatgtggggaccactgcatcttgcagatgggtaaactgaggtagcgacaggtgaaggctcagttacattcatcctgggtcccagactgtctccaacctgtagcctgaagctttgtttccttcctccctagcccaggatgacagcagtgaccttccatgggatcttttcctgggatttattgagccactgaggtcattggcctcaggccacctgcgtctctcgactgaccagttattcttcaaggaagacactgtgtgtgtgtgtgttttagttgctcttctataacttccgggtgctcttctcagagcagcagtgctttaaaaaatgtctgtgtgtgtatttccccactttgagccatgaaatatgttcagtctgttttttttctagtccaaagtatttccatatcattgtgcacctgaggaaatgcatactttgatagaaaatggacaaaaaagttgtattggtagaattaaatgaactaatgcatgtcaagcactgagcactttgactcaatagtaataataataataataacacaatgtatcattatgatagtgttatatctctttagcaatcttgatagttgacttgtataattcacagtacagaagcttattctaaaactaaaatgctttggttctcctgtgtgccaggaacagcagtaaactttatgtcctaagattagtatggttggaaatgcatgtggcagtggttcccaaacactggtgtgcagatggaacacagcccgtgaagttttcagcggtccttgttaaaaagagataaaggaaagagataaaggataaagtgctgagattctcgtgaagctaaatgaagctaaataaacatccttcaatgagaatatgtccttcctatagtttttggaggaaaatatttccttttgtgagacaaaagtgttagtaggtggtaagtactttttatttagcatagtacaaagttgtggccctctgtcaacccttcacattttggtgtgtgtaatgtttgaaactgcattggtctgtaaaatcccaaacccaggtagataaaaccaagaagtgacagggctggaagggatcttaggaattagttcataaagaacttcaggctcagagaagacatgtgagttgcctaaggtcacacagcaaatctgaagcaaatcagggctagaaacccatagacgatggtcatgagcactggttttgagtcatccatttgaacacacctgtgttcagattctacctctgttacttatgagctgatttcttacctgtgaaagtgggatacctacccaaggggttcacgggaggatttaataagatgatttggattaggaaaaactgacaaatttccccttccttcttctccctgccttcccctcacctgttaataaatagatccttgtgaaaggtcagtgagcagcatcagccagaagggctttgttttcagcaaggtccctgcatgtatgattacaatcctaagtaatatcagctgttgcttgcgttggtttctcagctctctcttggtgatctctctctttagctgttgaatgagttcaaagatctaggaagagctttgaaacccctctagcagcatttctgtctccagtcccagcacaggtctttggaggatgagataaaaagggttttgcccagggtcaaatgctgtgtacacgcttggtcactcttccctttcttgagatgacatgtccccttcttggagacccaagatgattgacaacaataacattcctttacaacgttttcttctcatctagagcactgggaggctgccttttaacagagatatcacagagtagcaagcatgcagacattctcatgacatcctggcagatatcaagaccaaagaacatcccatgttccctcttgaaggcttgtaataactgccataaattatcttgtgggaatggagtggccctggcctaagctgtgctgtaccggactctcctggtgacagttttagtggctgcatatgtttgcagaagaaggaagcgtggtaacttggcaaacagctccaaacgctcctggcttgctgccacaggattgtccttgagacttgggcacagtgatgtgtgaaaaatgcccacctttgctcttggtgtccagtgggccttctatgggccctctatagaggtcatcacctggggattcctgactctggccaggtcctgaggtctttccatgttactctccatgttacttgagtaacataagagcttcttatggctcttatgttctgcaggacggatgaactaggtacccaggacaggtctgtttgtgcacaaggctgtctccttctccccctccttggtttttctactgaggctttgttgtgcttggctcagggtgatgttagcaaatgcactctccaccctgctgtgccacattaaggaaacgcatgttgtattggcttctgccaagtcagctcacatgctttgttttagtgactctgtgaagagctcatcatctattatttattcaggtaacacacttctatctcctaatttcggtgctactcccatttttcatccccggttagcgtgctgtgcgccaggagggctgcctgttgtctttaagaaccactttgaacatttttgctttggttatttattcataccaacatgttgttgttaaatgacgtgaaataaaaccccattttaaaaagaaattgtaaaaggaagctatgtcctgtgtggaaatcatgacaagcccagaaacatgttacaaaaacattaaccaggagcggtggctcacgcctataatcccagaactttgggaggccaaggtgggcagatcacttgagaccaagagtttgagactagcccggggaacatggtgaagcccatctcaactaaaaatacgaaaactatccaggcataatggtgcaggcctgtgattccagctactcaggaggctgaggcaggaaaattgcttgaacccgggaggcagaggttacagtgagccgatattgtgccactgtactctagcctgggcaacggagcgagactccatctcaaaaaaaaaaaaaaaaacaaaaaaaacccacacacaacaaaaaataaatattgcctgtacctatcacctgaggagcccattgttaatggttgtgtgtctttttagtcttttaaaaaatgtgttaaaaaatgtagttgtcataatgtccgtatataaatttttaagtggagttgatagatttcatttgaagggctgctgtgtcataaatgtaaaatgcttagcaaggtgcttggcacctggagctgttcacagtaaatggaaggaatttttatggagggtgtaaggtagagtgggctcctgagccagactgccctgttccaggcctggctctgctatatctggctgctagagcctcgagccagccattgaagtgcagtgccttcatttccccacctgtaaaatgggggtaattatcatataccccaaagtgctgtcataaggatttaatgaaatatcccatgtaagatccttagagcactgctgccggatggtcatctcatagtaggtattggttgttattattcaggaaaatgttggaaaacacatttttaaacaaagctggtgttcagtcccctccctccccccaaccaaggaaactctctttaattcccagtctgctgtgattcagtgctggcctgggagcagccctcgagggcagacacagcacttgtcccctacccagcacagcacctgcctgtgcatccttagctgatgaatgaggctcacagccccaggcgccctgcatccttcccttctttctggtaccctcttttgtctcctccaaacacttgctactcaggcttcagggaggaagtaggaagtaggaggtggtttctccctcccagacccccagctcacactggtcttgaagggcgtggcatctgacagagcccggtggctggttttcacgtgtctcctgaagccacccctaaggagaaggcttcgatgtcatcttctggtcagagccgagcacagtggtcctcttcagagacagatccgtgcagcaggatggcacctctgttgtcctcccagactagcagtaggtacacgtgggcttcgcaggctgttttctgccctggaatgctgctgttttttagacccagcatacctcagtgtcagagaaggctggtttgtttgaaacggtcagaatgtcataaataccttatgat[450 bp omitted]cgaggaggaaggcggggcaatgttaggagcctctgtgccttggagctgcaggcgagttgtctggtcttgggtgattcccttcctatgtttgcatctcaattttccctcttgtaaaatggagctgagagcatcccttatatcacaggaatgtcattaggattacttaaggtgttggaatgtttcctggcctaggggaagagctcagtagaagcttgctattgccctaatatcattactatcccagatatgcattttcttgttatttccctgttaggcgttaagtgtgtgaaagtgtgtgtgtatatttaaaaggtcaaagtaaaattctttagaaccttagggcaggatagctcttgtttagttaggggtgtttggtgactgctggagaagtcacctacccagctgatcttacaattactgtctgcttaaaggcagctcttgacttggccttctctaggggaaaaacatgtagtttatgcaacttttcttttccctttctgctctggatttgaccttttgttccttcaggtgattgaaaaaattcgaaaagtcacctgtttcctcagaattgctttaagacaagactaagtgaaccaacaagaatgaagtcagctttttggaaatacctcccaagaggccttgctctttatgcaggactgttatttcaaaggatggtgtcccctccccaaccataagaacgatccaaacctgttttctggggcccagagtttgctgaggataggactgggctgaagctttcattgctggtctgtggggtagaggtaagcctcccctgtgaagctggtaggttacatgctttggcaacatgaattgttatttctggagtcccctgggtgctgtttagaaatgcaggtaggtggctgggtgcggtggctcatgcctgtaatcccagcattttgggaggccaaggcaggcagattacttgagctcaggagttcgagaccagcctgggcaatatagtgaaaccccaactctacaaaaatacaaaaattagccagggatggtggtgcatgcctgtaatcccagctactcagtaggctgaggcaaaagaattgcttgaacctgggaggcgggggttgcagtgagccgacatcgcgccactgcactccagcctgggccacagagcaagatttcatctcaaaaaaaaaaaaaaaaaaaaaaagaaaaagaaaaaaagaaatgcaggtaggtgcttctagctactgctgtgggatagcaaggtagttaccaaactgataagggtagcatcttacttactgctgaaaaattcagtgtcttttttctttttttttgagacagagtcttgctctgttgcccaggctggagtgcagtggcgagatcttggctcactgcaacttctgcctcttgggctcaagatattctcttgcttcagcctcccaaggagctgggattataggcactcgctaccacacctggctaatttttgtatttttagtagagacagggtttcaccatgttggctaggctggtctcaaactcctgacctcaggtgatccacccacctcagcctcccaaagtgctgggattacaggcgtgaactactgcgccgggcttgagtttgactttttgaaaatattccacctataagtgaagttgtgcagtgtttgtctttatgtgtttagcatatttcactcagcataatgtcctccaggctctgatgggcacttggcttgtttccatgtcttggctattgtgaatagtgccgcaatgaacatgggcaaattgccgtgttgagttaaggaagctcttttccagtctgagtttgcaaatagcttttcatatatgagcgttgaatattatcaaatgcttttctgcattcactgagatgactttatgtatttaaaaaaatctgatggcctatattttctatttctaaactactcgtgtattcctggtataaatcaactcagtgtgttactctcgtttttatacatagctggattcgttttcactaatattttgtttgagatttttgcctcagtgatcatgtatgtgattgctctgtaacttttcattcacattttgtccttgtctgtcctggtatcaaagttatattggcttcatagaatgagggaaatgtttatccttctaaaaatatttagtagagtggtctaagatgagagtgtaagtgagtaaactttctcaatcaaatattttgtgatatgtttcaggaatttcattacatgtttggttcaatttttaaagcatttctttttattatttaaaacttttagcattggtgaccatccatgtgctgcttttattgccagcttaacttgtttttatgacatcttcaggaagaaaacctctgctgtctatttaatggagatgaattgttaaacttttaccatttgcaactacacgtctctatgagtcagacttttattgatcgtgtacaactaaatgaaacccggaaatgaaggaaatgtaacaagcgattttatgtattttttgtttgctcaaattgcctttataaaatagattgatactctataataagcaaatgttgtgaatttggaattttcaaattgaggcttactaataatgttaactattttatccgagtttatttgggtttcttataaaatgtaatttctcaagaagattttgctgccctaaaaaaaaaaaaaagaaaaagaaaaagacaaaaagggaagccactggttgctaatggctcctgcggctctgacgatcctcgatgaagtgttctttgattaagtgtcaagatgagtggtgcagacctttgacagacacatgattgtggttggagaaagcccagcattaactgctgaccttgccatctgtgagcaggtgttgaatgagctcagttccctcccagcccttctttttccctggtgggtcattggctcctgagtaagatagatgcatgcaatagaagagctgttaatagcatttactctttcttaatccttattaatcccattcatatttcagtgtctgaaacttggcaggatgtcaagaagccacagtgcaagtagggaaattgaacagcaaggaccaagtacaatgttcccctgatatttaatttgctaaaacatgtaagaagaagaaagttcttacattgttaggtcccaaagagagtgccactaagcaaccttgccaaaaccaccttgctggagcttcttattatctttttttagcgaatggcaataaagtcattttgtcaagctaaccaagtaccataatgagatctttgtggcataaattaaccgagtggggaaataactttgacaggggttgatgtccgaaatgaagtgttgtttgtctgatgtcaagcctgtggggaatttgaaccttgcactctttcctgataagacattaacctctgcatgggcttgctggcccaaccttttgattaactggacctattttcttgtagatctaatacaaggatttggagaaccccagtaaaatgctggagggacttagactctgatctctattgggatgtgtcaaattggagatttggtgggcttttctgctgtgtttactgcgatgggtgtgtgtatttgaagtctgtatgtggcctttaaggatgtgtttggggcgcagaagttctgggtaacagagaggctctcaaacgttagattttggattagactttgggtcaacttcagggtagcaagaggatggatacccgagaacatgttttctccgacttcctggcccctgtcttctaagttctgggtagtgatgggtctttggaggggcagccctttctgccatgtgaatctttgcccagccctgagggggtgagggctggccaagggagccgggccatggtcggagagaaggctgaggctccttgagaagcatttggagtttgagtcagttgtgtcttttaaaaaaattacccattttggacttgcctgtggaagcaattagagagatcacaggaccgtttctgattcccaattctgtccagtgtctattcagaaaaatagaaaacagtcaactggaacaggggattatttgagcacacacagagtcctgttgtctcagcagcgtgccctcagacaatttgccttttagtgaagtttaagcccatgaaaggaaataaaaagtgttttattagatggcaaagaaagatggactggacttatgagactttgagaatttttgctttttctttgttaatgcaaactttggaagagagcaactctttctgtaatgcaatttatttgtacaatgtggtagttattgttaatagctaataatgatcttcaactgggtaaaataccattgtgtgtttgagagggagagagagagagaagggtaggaggagagggagaatatcttttgttcaaagccaaatgttgctacttctgaagacgagtgcaccttatgggtatagccagctataatgtttatcaaacatatactttttttttttttttttgagatggagtttttgctctgtcacccaggctggagtgcagtggcatgatctcagctcactgcaacctccacctcccaggttcaagtgatttctcctgcctcagcctccctcgtagctgggattgcaggtgcacgccaccacacccagctaatttttgtatttttagtagagacagggttttgccatgttggccaggctggtcttgaactcctgacctcaggtgatccacccacctcggcctctgaaagtgctgggattataggcatgagccaccatgccctgcctcaagcatctattttgtgcaagagcttgcagaagttctttcctgccacagccgtggttggccacattgctcccccatgaatatgtggaaactgacacttcaggagaattggtggctcacccatggcattcagctagtgggttatggggcagagactcaaactcagccctgactcccacagcattgttctttttctgtaaattgctgacttactcagttgatcacagttcattgccgtttacagaatttgtctgcacccattgtgccttttaagtgtcgattttctttcctgaaagcacacaaagcaaagcacggctctgcagtgtgacccaccgtgtgctgtgtggacagatgatgctggtcagcaggcaggaaaacgatctgccaggcgctgggggtggggcagaggattgttcttcctgaccttggtatgaaaaccgtatggagttcttagtgaggaaaatcactcttagcccaaattcctgcgaaggccgatgggattgtttttaagatttgttggattgctggatttgttgaagggagaactggaagaagctatcagaagtttacagggcatcggagggagacactccctttggccactttctccgccaaaactatcctggttttagcccaacagtttcccacgcccgcccccacccccacaaccttgtttgtttaaagaccattaaagaacgtcttcaatttattctggattgagttttcctcaaaccaaaccacccctcagttcaccccccagagctgttgaggcccttcctgggggcttgtggctgtggctgcctcagatcagagcagaccctgggctgcatcatccttccacattgtctctctaaagtacctgaagccagtagttctcaaactttggagagggttttgagtcacctcgagagctgataagaacagaggcccagattgaagttgaatagtgctgggcctttgtttttaccaagttccctggatggttctgctacctcctagcctgtgagaactactcctttgtgatttcttgccattgaaattttttctcaccttcttcttggcttgagtgctcttctgggttccttccggctgtccaaatcaaatttaattttcacacccagaccttgtccctgctctcatccttcagcccaccctcctgttccccattcagccagaccccctgccagtcagttcaagtgctaggcatggggtatcgagtctcaggccggtccacagacattccagcacctggtggtaagaggtgagtgctgcgtggacccactgaggaaggctctggctgtgctgggggaggggagtttatgctcgtcctcatagaaggataagcaggaattaagtgggcaaaggagggagtgaggaagctctcactttctaggtagtaggaccagcatgaaccaaggtaggggatgacaacatggctcattcagggaatttgaggtatgttgatacatggaaaaatgtacctgaaatgtgagtcctgcttttgtgactcaccctttcctttacataagcattgatttacatctgttgttttttaagatagtgtgtatgttgaaaagttcagaacaagatcaagtggagacataaaatggtaagatgtgaaaagttgttcttgccagattaaatggttccacctgaagaaaattttttttttttttgagatggagtctcactttgttgcatgggctggagtgtagtggcgtgatctcagctcactgcaacctccgcctcccgggttcaagcaattctcctgcctcagcctcccgagtagctgggactacaggtatacactgccaagcccggctaagtttttgtattttagtagagacggggtttcaccgtgttgccccaggctagtctcaaactcctgagctcaggcaatccccagcctcagccccccaaagtgctaggattacaggcatgagccaccgcacccggcctgaatttttttttgttttgtttatttatttcttggttttgctggcctttaagcaacccaagactagggggctttcactccgtccctagagagctcaaagggcctgacttaggggacacagtcagtgaaggggatgaatgaatgagtttcagatccaggtgttctggataagtcactttacctttctgggcctttttcctcaactccaaacagaggatgtcggtatagacaatccctaggatcttgtcccctttatgactgatcacacagttccactgcttgcccttgaggctttggtgtccgcgcatgcctattcagtctgacccacaagaggccaggccagctctgttccaggccctgaaaatcccattaaaactccactcactagcctgttccctgggggtgctgaatcagcatttaatggggaaggccacgagctaggctctggtgggtaggaagtgtgtgacttctcttacctcaacagtttctactgtaactagcgggataaggtaaatctatggaaatgcaaggcttatgccgaggctcacagagtgggccaggctgcataagtcctggacaccacagggcctgctttgagaaggcagctgtggtcccacagccttgaccaccaggcaccatcctctgttgccagtggacccacatttcaaatcattttatctctttttttttttttttttttttgagacggagtttcgctctgtcgcccaggctggagtgcagtggcgcgatctcgactcactgcaagctccgcctcccgggttcacgccattctcctgcctcagcctcctgtgtagctgggactacaggcacgcgccaccatgcccggctaatttttgtatttttagtagagacggggtttcaccgtgttagccaggatggtcccgatctcctgacctcgtgatccgcccgtctcggcctcccaaagtgctgggattacaggcgtgagccaccgcgcccggcctttatctcttaaataacctgtattcatttgttccttcccatgtcttatccaccaaaaatctccaattggaaattcagacaaggattgagaccctgtgttcttaaattgggttgattgaaatctagaaacaatgatagtaataacagagttatcttctctcgaacatctgcctcctgcctgatgttatttcgcttaattctctcaagggcttgaggagagtcctgccataatccttcctttcagaggggaagatcgaaatttagctcagatctcaagctagtaatcatcagaaccaggatatagaatcaggactagaccacatggtccctgctctgagctgctgcgggtccatccctgtggctctgtccagggtaaatggatgattcaggggaagggtcagcaaactatagcccatgggccaaatgcagccactgcttgtttttgggtggcccaagagccaagaatagtttccacatttttaaatgggtggagaaaacaaaatctacaaagaataatgtttcatgacacatgaaaattatgtaaaatatacatttaacgcttgtaagtaaagttctgttggaactcagctacagtcgttagtttacatatcatcgatggctggtttcgcagtacaagggcacagtttaaagcctgccaggcctaaaatgtttactgtctggcctattacagaagacgtttgctgacccctgatttagggcattcatgaggcttgatgagatgttgaaaatcagctgtctcctcccgtcactctcttctgattgtgggtaggctctggtgcaccagctctccagtgatctcctatctgatgctcagagttctttttccattgcatggatgtcaaataaaagtgtctgctttgtggcatttctggcttgagagtacctgcccaatgtgatttgccaaggtgccattttatcaaaagtcttaggatgactggatgggtttgccttgaatttgttttgcctttgctgatggttgtatttaggttatcattgaaagaggattgcagaacagcggcagtttcctgtgctgtctggattgaagttgaataatgccctaacttttaattgaaagggactgttgtaggcgggagactgtctaagagctgacctgtcaccaccacctgagatgtctgagcccacccttggactttcttggcacgtggggaagagggggcctgggtcctgggctcccacctaaactcagcagaccccactggcaggtgtgtgttgtgggggtgatggaggctttttggagggcattgagctccttgggtggaggtggggtggctgccttgggggctcagtgcagctctggccatgatggacagaaggagacaagaatgtagcttcttgttctgagaacttcagcccaagttcctcctttcatgcagcagaatccaagacactgacttgcccctctctgctgttgaggcttctgtgttgcagagataccttctggccctgctttatcctagtgaggcagctcacctctcccgtgtttcactgctcgaactctccttcccaaggctgtgctagtggtagtgatgacaataatagctactatttattgtgtgcccctcgtatgctaagtgcttcacgtagattatataatttaatacttgtcacaacagtcttatgaggtaaatactgtatatatatttaaaaagactatttttagagcagttttaggttcacagcaaaatgtagaggaagtttcacagagatatcccaagcaccccttgccattttctcttagttatgaaaatgatcaaatgggctgggtgtggtcccagcactttgggaggccaaggcgggtggatcaccggaggtcaggagtttgagaccagcctagccaacatggtgaaaccctgtctctactaaatacaaaaaattagctgggtgtagtggcacatgcctataatcccagctatttgggaggctgaggcaggagaattgtttgaacctgggaggtggaggttgcagtgagccgagattgcgccattgcactacagcctaggcaacaagagcaaaactctgtctcaaaaagaaaaaaaaaaaaaaaaagatcaaatagacttccaagtgcccatgtctcaggttcagtactgatcagcattttaccctcctttgcttcagctccctcctgtcattgctcattgctgagagtgggtaaggggctttctcaggttcctgtagctggtaggatcccgctgtcctcaaagttcctgcactcagtggctgacggtgccaggtgactcccccttttggggtccatgacatttgctgctgtttctaaagcccctactgtgtgctgctaatcccctcaccaagcttgcagagcggatggtaactgacaggtgaaaaaatgcaagaagttaggtcacgggtccggggacatcctgctaataggtggtggtgccaggcttcaaactcaggcctgacttcaagtcccgcagcttctctgccccaccctgtctctgtcctcctcacctctgtagtgtggtgggactcggtggggtggtcgtttgactgtgggaacttctgtttgcaaagccttggaaggacccaggtgactgcagatagttccgtgagaagcatctgggactgttgacctcactgctgatcttccttgtgagcctgtgatagggctaacccttggctttctggccagagtgtagacagagacccgattagcattttgtggtcagtcagaggcagtttgtgaacctggaacttggaagctggtttcctcctctgggagggatgtggagcctggggagccaggaaggcatggactgaatatacacccagctgggcagtggggaagggaggattccgtggggagctagccctgaacacagcaagcatttggtaaatggtgcctgttagctgtttttatccgtattctaaggtggacgagcggcgcaggagagaactggtaggattaatggagtggtttcattattcagatttaagtgcatgcagccagaagtcttcaactgaagaattgaaactctctgctcttttttgggggtcatggtggcagtgtgaggggctggttcatgagtgaggagaaaaggtagtggcaggcagaatggtacattttatattcatattgtgcacattattcacacctgacatgggccagaaatcctctcctaagagagacacttggaaagtaaacagtttgttaatcatttcaacccgtggactttggttgcagggtgcattttgatcaagggttacaaacaccaatgtcttcagggacatttggggacataaataaagggaatggacaaaaagatggaaaagcatactgcctctcagtctttcgcatgctcatgtttgatagagaaaatcaacatcgtgggggcagtgttgcttggcaactgccatttgtcctcagcgttggggtgacattactagggaatggctgtgaactccaagcacttccccccgggaagcgaggctgacactcagatccaattcatgtctttaatgtggccaaatgagaaagccagatgtatttctgagaagccaaaaaacaagatttaaaaaatgctatctccctaatttttttttttgagacagagttttgctcttgttgcccaggctggaggacagtggtgcgatcttggctcactgcaacctctgcctcccaggttcaagcgattctcctgcgtcagcctcccgagtagctaggattacaggccaccatgcccagctaatttttgtatatatatttttttcagtagagacggggtttcaccatgttacaggccaggctggtcttgaactcccttgaactcaggtgatccacctgcctcagcctctaaaagtgctgggattacaagtgtgagccactgcacctggcttctatctccctaatttttaaatacttaagattttaagaaacatcacaggtcaagcaatgcatggcagtgggctagattcagacaggggagcctcaatttaggacccccagatttatcatacaaggtggaggaagggttcagatagggacttggggattgccaactctgaccctctcttcagatgaagagattagccctgtggaggagtccaggatttgtattttagtcttggtactgggtgttctgggttgagttgctagaccattctgggacaagttgctagaccattctgggacttactttcttcctccataaagtcaaagggtaggtagatcacacatttttaaagtgtgctccttgaggtgtgtcaggggttccataagcatttgctttcagttttattaaaagcagcctgtactctcaaatttgagtatatttgaaattgtaatgagagcagttgctcaggatggagtgtggtggctcatgcctgccccacactttggaaacctgaggtggaggaaaccttcaggccaggagtttgagaccagccagggaagtatagggagaccccatttctacaaaaaacaaaaatattagctgggtatagtgggacacatgtgtagtttgaactactcggaaggctgaggctgggggatcgcttgagcccaggagtttaaggctgcagtgagctatgattgtgccattgtactctggcctgggccacagagtgagatcctgtctcaaaaaaacaaaaaacaaaacaaaaacaaattaaaaaacaaaacaaaccaaaaaaaccaaccaacacatttgcccaaatagtgaatcacatcaaattttaaaattcgctggaaactatctgcttcttaatttgattatacatcaattatgttcaaagtaaaaaacaaggtaatttgaaacagctgcttttatccaggtgtatacacggtgtatacatacacagatatgtatgaaatgtggaactctatacccgtatgtatggagttcctcctaagagtctttttgagaaaatagttccattgctaaaaatacccaatggaaacttctggcctgggatttccaagttcaccctcggctgtgcgtctcaaagtccacacagcctcaccaaaatagcccttctgggtacttttttctgtgtgttcttggaggaggccatcgtgcctccagctccctaaggcggaagatgagccagcggggatctttgcagggtggttggttctcgttccttccaccgaagccttccatggcatttttgggacctggaattgtgaattattctgcctcttccccacagtccctgatgacagcatgaagttcagagagtttatttgcagatgaggcagggaagccggcctgttctcatcttgctgtgcctgatgccttgtgcttggggcactgttcactgtgctgcctgctggcctgcttgtctctgccttttggatgggagataggccaccccacagtgccacacctgccttcagggaagcttttgggtgttccttgtctggcttctgggttcagtgggagggcccacccagcctgtcattttaatgatttaccttagaggagccagttttatagggagttgttggataatcttcacaaggcagataaatgggagagcaggaagaatgatggcctttcagagttgaaatctgtgctgctccaaatcccataaactgctatttgattttaaacattgcttgaagcggttcacattttggttaattacgtcagtgggtaaaaataactattgtcatatggtgtgtgggcttggctttagaaggataaagagtctattgttacccattgtgctattcagtcacttattacccatccttaaaagcccaacgtggataacagaaaacctggagagctttgtcacttgctgaaatccaagctgccctgtgaatttatccccaaacactgctccttttgagaaacttgtacaagctgccttaatttagtcaattcaaatgggttgatgggggctgttcccaaggcccaggacaggcaggggtttgtgacctgcagccctggaactgcctttgggtttcatggtctcagttgagacctgcccagggttgaaccagcttagtgctccctgggggtggttaagttcaaggacttcagggtccgattgaccttgggctgaatcttgacctggggctgtaagatgctcggtcaggaccttaacttttccaaggctcggtgtctacatctggaaaatggggataaacacagttcctccctgctgggattattgtaaggcttgaatgagatgataaatacaacatctgacttgcgactggacggtagcaaagggtttagttaatattataataagtagaatggaacagcattagattctcacacagggtcactatgttgttttctcccattctacccctgcatattaccctgaagcacccccaagcctctccctccccatccctcaagcccctccctccccatcccccaagctcaccaggtcctggcgcacccagatctttcactgcttttcttgcctgtgagctcttggggagtcaggaccaccttaagcaccctctgcatctttggcacctaacctggggcctggggccctgcagggccacaattagcagcatggacaacagcatggacggagagggtctcagagcctggagagctcctaggggctggagcagtcacaggaagtcaccaagtgaattgaagggtggtggctttggaggttcagtgaggcaagaagaaggctgttaggctgggaattaaggaaccttgtgttgttcgagtctcaggacaactcagatatggggtctgtattgcaaatgcccctgcgtcattttacaactgatgaaaacaatggctccacgagaccctcaagtgccagagctcatgagtgacagtggaagttgaactaaccttttaaccaccctagtccacacctgtcaggctgacgggctttcagtggtgatgtgttgggagctctgtgccgcagatctctgtgtgctcctgagactctgcccgcctgtctctaccctgctgtgcccactaggaggaggctgacctttatgttctacaccagtgggtgcccttggtctccagcttccagtgggccagtctggcgagagaccctagctggagatgaggggaggtagccttggcctctctccttgcccttcctcgctgctgctaccccaggattcttgcccatcccttactggttttccttaaccccaccctcacccttgaaaacagactctttaaaactctcctcactcaccctcattgagtgtgtcatctgctccagctaggatattggctaataccgcatgtttcagaaagaaaaattcgcagttctatttatttttttactgtggattgaagggagaggcaaccaggtatatggatgaaggagtagggcctggctgtcaccactggtgttcacaaaaggctcccgtttaagtcctcttatattccaaatgaggggttataggtcgagtcagggcgttgctctaacagaagcaaaaccaaaaatacacggccgtagatacaaccctgttctggtacttcctaattttgtgtgtacatgtgtgcacctggagcttcaagaaatgaaaatggaaatggcctgagtgtttctcagccctaggatgaggctgtttctgtgatttagggctggaggttatgaagacttggtttacaatatgcacagtacagaagcggggaagtcaaggtgtgctgggcaaggaaacatctttatgtgacccacaaagagtgaagcagagggaagaaccagaagttattctggtttgcagactgggagacaggtttaatgacacagtcatgtcagagagaggggaagaggagaatacgtagggggtctgttttgatgtgtatgtacatgtaggattttcatgtagaggagttggggaaaattttagaagttttaggtgtaaatgcagctggtaagatccttatgacttagtttcttttttttcttcttttcttttctttctttctttctttttttttttttttttttttttaagacagagtctcactctgttgcccaggctggagtgcagtggcgcgatctcagctcactgcaacctccgtctccccagttcaagcaattctcctgcctcagcctcccagagtgctgggattacaggtgcatgcaaccacacctggctaatttttgtatttttagtagagttggggtttcaccatgttggccaggctggtctggaactcctgacctcaggtgatccacctgccttggcctcacaaagtgctgggattacaagtgtgagccactgctcccggccttagtttttgagtgggaagaatctagtgttcagagtggaccactgatgtcatagctgcaggtttggctgaattgggatggtgcagaaagccgtgttaaccatttctttttctctgaggcctggaggaggatccttgtgactggaaccacagttgggactggcagtggtttttcctgctggcaaggaaaaaaaaaaagagaaaagaaagagttcgacttatcagcacaaagaaaggaggatgtgaaactagaaccatctctagggcagttctagcaatgaacaaggctggaaggctcaccggcgaggggtttcccctcaggaaaggggacagagaagcttccacctcctgggtagcattgggtgttcctgggcacatctgggtgactaacgggttttctgccacacaactggggtatatagggaagtctttggccagaactgtgggccgtactgcattcttcccgtgtctgtcactgctgagtcgtgagcttgatctcttttcttagtgtttgctccttttgtccagctatgggggccagcagaagctttgggtcatctgtaccagtgactttgctgtgaagatgtaagggagagtggttgaggtcaagatctgggttctggttcttgtgcctcctctctggctgtgtgtccttcaacaagctgcttactgtctctgggcctccgtgccctctgcaactgggttgttggtctatttaaatacttggagaaaaaagctgggcatggtggctcatgcctgtaatcccagcactttgggaagccaaggtgggaggattgcttgagcccaggagcttctgaccaatctgggcaacaaagtgagatgctgtccccatacagaaataaaaaaattagctgggcatggtggtgcatgcctgtagtcccagctacttgggaggcttaggtgagaggatcgcttgagcatgtgggatcaaggatgcagtgagctgtgattgcaccactgcactccagcctgtgacagagtgagaccttgtctcttaagaaaaaagttattcaaaaaatactttggaaaacaatgctggggagagtatgagcttcagattgcacattggtttctatcaggaggatctgagcctcggtggtgttacctgtaaaatggggataaaaatacctcacagggttgcagtgaagatgtaaggatgatgatgatgacaacagcagctcaaatagatcatttaacttaattctcgccaaagcaaggcaggtacaaagatcatcctgttggcagatacagacagggagggacagagaggttaattaagcaagctacctgcccgcagttacatggccagaagcagtggcactgaacgacttccttcaggcggtctgagtccaggtctcagctcttagccatcactccatggttctgtgctgagacaagggatgtagaaagcccagcacagtgtctgttacatagtaggtgcttagtaagttagagttcctttttatcctcagaatgcgtttgcaagtatagcctcccacagtgcttttactttaatctttccccttactgggcaaaaaaatgtttgctgccctgtgcgacttgcctagctattgacttctcttttttctgcctctctcctatgatccatcctagactgtggattgaggctcagcctagattaaagggcaggggctggaggaggaagatgagctgaaaaagggtaggcctgaggcgcgaaggagttgatggtagggtggaaggtgggaatgggaagtttgagaattggaggacctgggggcaagactttccccctctgggctcgttctttccttcctgtgccgtttattgagtgcctactgggtccaccattctaggcatggggcacagacaagatctctgttctcatggagcacacagtgtggttggaggagtcagtgatggacagagagtgaggggtgttggtttccatggctgctcggagaaggacttgctgaggaggtggcgttttgggcaggccatgaaaaggtctgggcagagtgtgtttgtgggagggaataaatatgtaaaggctctaggggagaatcagtttcgagaatgtgagggggcagtgagaccagaggggctagtgggctgtggctgagtttgaattttattctaagtgtcatggaaagtaggaggacggttttttccaccagggtcctttttgattattttattcttcgtgacgatcctacttaaaaaaaaaaatcttattcaccaaaaaggtgtgtttgtgaaacaatagagtgtacaaccttgaatcactttagatttttaaagtatagggaaacaattatggatcacaatgaatatccttgagggctgctcccctccccagctgacactgtcagctaaacctttaaggcctcttgtgtgtcaagcattaattcttcccaaagctgcttgacatgtgattaaaaatttttactgccacctactgatggaaagaagaagatgaatttttgtacaatgaaaatcccaaacacagtggatttctggtttccactgtgctgtcaggactgggaaatgggtctggggaaggggtgtgctgggcttggtatcccccccacccaaccccctttttttggccctgacaatctggtctctgcttctgtgtccttctgcttcagctcatcgcacagtgggtggagggaggtgctgacctggggagttgctccggggagagggctggaggtggggggatgtgtctggggagaaacactgggcactgggagtcagcagccgccagcccccacataacccagttaatcctttgtaattgaccccgaggttgcaatgattccctgtgtttaatgtcccaagacggcctaaccctgaccagcagacctttgcttaatgtgcttcttaccaccccacccccattattaaatcctcaactgctttatttctgatttgcattttccatggctgaatgaatctgctgacttccgttttctttttctgtttcagatcctgtgcgcaggtggcagtgagtacccttttcctctctattcttgtgttgttcgctactgccccctaatggacacacagcaacattaacagcaatgtgaaatgctaatttattaaaacctgctcggtttccaatttttctttttctttttcttttctttttttttgagttggagcctcgctctgtagcccaggctggagtgcagtggtgccatctcggctcactgcaacctccgcctcccgggttcaagtgattctcctgcctcagcctagcaagtagctgggattacaggcacgtgccaccatgtccggctaattttttgtatttttagtagagacggggcttccccatgttggtcttgaactcctgacctcaggtgatccgcccgccttggcctcccaaagcgctgggattacaggcgcgagccaccacgcccggccccaatttttctttagaagtaggagtgagggtggaaacaacaaatgaaagaaaaaattttaattaattgtgcaatcatgatgaaaatttatattttctgtaatttttttctagcctcatctgtgggcgatttaacttagttgaaattgtaatacattatttgtatattgtttatgtgctgttatcctttaagtattttcttgtgttgctacattgcccttttgttgctacattgctacatttaaagaatggggtggaagatcgtcataacctttggaaaatgagacctggactcccgcatgttttgctttcatgcacagggctgagtcccaactgctgacagtgctggttcattccctggtaataaaatgagaaaaataaggatatgactagaagttttttaaggaagcttaaatatattcagttgaaagcaccatccatccctggattatgtccttactaattttttggtcataaaacatttctataagaattgaaggccgggcctggtggctcatgcctgtaatcccagcactttgggaggctgaggcaggtggatcacctgaattcaggagttcgagaacagcttggccaacatggtgaaacaccatctgtactaaaaataccaaaaaaattagccaggtgtggtggcatgcacctgtaatcccagctacttgggaggctgaggcaggagaatcgcttgagcctgagaggtggaggctgcagtgagccgagatcactccattgcactccagcctgggcaacaagagtgaaactccatctcaaaaaaaaaaaaaaaaaaaaaaaattaaaaataatagtagttggtagttttttaaaaaatgtaccttttaggaaaaaaaaaaaaaaccatggtttttgtttctccccaaaatttgggaactttttttttcctgattggtaaaatctcagtttgtgagataaaataattagattgtactcatggaagcatatatgggcagatcttgctgaaatcttctaataaagcaaatctcaattaataatggtaattagagcctgtgcaaacaatgggaagagtactgccgttggtttttcttcctgttaattagtttaataaataaactggtgggtaccttgtacaggcttgaatcactgctgcagaagaacacttctattcaaacatctaccgtaggtagtagaattgcgggaaacagaaatcatgagctattttaactgaaaggatttaccctgggaagtgagagtttacagagtcattggaagggccgctgtattagtttgccagggctgctgtaataagatcaaggtcttgggggttaggacttcaacatatgaatttgggggtggcggagcacaagtcagctcataacagctggggaggaggctttaggcctggccctgagaaattactcccagactaaggctgcagaactgaccccctagagagtcaccaccttggtcatagacagcaagcagagagggaggaatcaggaagtccctgctgtagttgctggatccagcggtgaatgttctgagctgtgatcctgggatcaggaagctgcagccactgccacagtgttggttctagagccaggcagcatgagatccagtcatcgcatccacactacagctataagaaggaggaagggcagaaggttgtgctccaccctttaaggacacttgctagaagtcagacagaacgtctggtcacactctgtttgacagaagttagtcacatgcaacatctagctgcatgggaggctgggaaatgtggtctttgttcccaacagctatgcatatacagggccaaaaatctccaggagtatgatgaagggaaaatgggggaatggagtttgggggtcaagagtggtctctgctgcacctccctgaacagagactctaggagactagtaatgaattcaagataaagcagccagtgtggccaaggttctccttcagtgcctgagctcttggccataggagctcacgcctcctctcctttcctgtgaatgactgtgtgcagtgtaagcatggagcttctgcactctcgtggccaggtactctccatgtggccagaaatggcagtttctgaggggctcatgttgtaggtgatgatacaaagaagagaaagagagggatcagtttttccaagtgtgcatttcatttcagtgtaaatattttgtgaggtggggcatccctgtctcctggagaaatatatttttaatctaattgtttactttctttgcatagcccctagtccaattcctgacccttcagtagcaactgttgccacaggggaaaatggcataacgcagatcagcagtacagcagaatcctttcataaacagaatggaactggaacacctcaggtggaaacaaacaccagtgaggatggtgaaagctctggagccaacgatagtttaagaacacctgaacaaggatctaatgggactgatggggcatctcaaaaaactcccagtagcactggtaagcataggcttttctgccagtcatgtttcttaaaggaaatcggtagaatttataaatgtcatgttttccaaatactgttcttcttttaattacctaagaaaatctttttaaaaatttttataaagatagtaatgcatattcattatataaaacatagacaagaaaagaataacaagtaaatcattaactggagataaccattgatcacttgatatacgagttttataattttaagatatatgcatgcctgtgtgcatatgtatatacatatatatgttttattttgttttacaaatatcaaggtcatcctttacatgtagcttctcaccaatatattacaaatattcttccctgttagtatatacatttctacaggacagttttaatacctgcctggcattctattttctaaatcagggttggcagataataatggtccttgggccaaatatagatcactttctgtttttgtaagtaaagttttattgagtctgcctatggctgctttcatgctagaattgagtagtggcaatggagaatttgtggcttgtaaagcctgaaatatttattctgtggcccttacagaaaaacattgctgatacctgggttagataattgattctaaaactgtggttcagagatctctaggggtctcctagattctttcaaggtatttctgggtattgttttcataatactactaacatgttatttggcttctttactctcattttatcatgagtgtacagtggagtcttgcagattctatatgatttgggatgacactgtcactcttacagctaatggaatgtatgctttcatattgtttaaaaaactttatcttttttatttctaatacagtatggtaaatattaatcaatataacccatataaacaaaaattctccgggagccttaataatttttaagaagttaaaagggccctgagaccacagtgtttaagaattacttgtctaaaagcattgtaaattatttaactgctcccctgttgttgggaaggtagattatttatttataatttttcataaaaaacattgtgatacaatagttttgttagttctagaagtattgataaaatcacatacacagttaaaataagtcattgaattatttctagggtaatatgagaaacttttagaaattcctaaggggctgggcacagtggctcatgcctgtaatcacagcactttgggaggctaaggtgggtgatcacctgaggtcaggagttcaaggccagcctggccaacatggcaaaaccccgtctctgttaaaaatacaaaaattagccgggtgtggtcatgcatgcctgtaatcccagctactcgggaggctgaggcaggagaattgcttgaacccaggaggcagaggttgcagtgagtggagatggtgccactgcactcccgacagagtgagactctgtctcaaaaaaaaaaaaaaaaaaaaaaaaaaaaagaaaaattcctagcaagcttatgttaattattgttacaaaaatttgggcttagaggttgggaccataccagatggtcttcccagaaatcactggacaggcttactgttgaagggcatttccagaggaagccaatctacaatgattggaataagaacctacttcttcaaatatacagacatcaacacagagtcacaaggatcaagaataatcagggaaacgtgatattaccagagaaacaaaataaagtgcaagtggttgaccataaagagatgggagatgtatgaactgtctgacagagaattcaaaatacatgttttaaggaagcctagcaaactttaagaaaatacagataaagaattcaaagaaatgaggaaaacaataagtgactagattgagatatttaacagagaagcaaacagaaattctgaagctaaaaaatactttgaacaaaatgaaaaatgtaatagagagcaccaagagtagaactgatcaagtagaagaaataatccttgaacttgaagacagattatttgaaaatatacagaggaggaaaaataaaaaagtggataaaaaggaatgaagaatgcctataggatttatgcaacagcatcaaaagacgtggtatttgaattggagttcatctaggggaagagaaagataaagaggtagaaagcttatttaaagaaatagtagcagaaaactctccaaacctggagaaagatataaatatccaggtacaggaaggacaaatgactccaatcagagtcaattcaaacaagactactccagaacataatcacactgtcaaacatcacagacaatggggatttggaaagcaaaaagagaaaagaagcaaataacatgtaagggagctccacttcagctagcagcagacttctcagcagaaacttacaggccaggagagagtgggatgatatattcaccatgctgagggaaaacaacctgccaaccaagattgctatacccagcagaactggccatcaaaaatgaaggcaagataaaagactttaccagagaaacaaaagctgagggagttcatcaccactagacatgtcttataagaaatgctaaagagagtttttaagctgaaagaaaaggacactagtgattaattgaaaacatatgaaaggataagactagtaaaataaatacacagtcaaattcagaatacatgaatactgtaatggtcatacatatctttaatatgaaagttaaaagataatacttaaaaaataataactacaataacttgcaggggggatatgcaatataaaaagatgtaaatggtgacataaacaattcataatatgagtggggaatggactagaagtgtagaggtcaatttgtgtgtgtgatcaaagttgtcatcagcataaaataacctgttataactataagattctttttataagcctcatggtaaccacaaagaagaacctttagtagatacacaaaaaataaaaagcaaggaatcaaaacatactactagagaatatcacttaacctcaaaggaagatagtaagagaggacggaaggaacaaagagtctataaaacaaccaaatggcagtagtaagttcttacctatcaataataaccttgaaagtaaagggtttaaattctccaatcaaaagacatagagtgcgtgaatgggttaaaaaaaaaaaccgatctcaatagtatgctgtctacaagagactcacctcacctgcaaggacatgcctagactgaaagtgaagggatggaaaaagatactccatgctaatggaaatctaaagagtggcaggagtagctatacttatgtcagataaaatagactttaagttcaaaacttttaatggagacaacaaacatcattttataatgataaagggatcaattcatcaagaggtcttaacaattataaatatatatgcacccagcattggaatgcctaaatatataaagcaaatattaatggatctgaatggacagattgactgcaatgcattcatagtagaggacttccaccaccttacttccagcaatggacaatgatccagacaggaaatcaataaggaagcatcagacttaaactacagtttagaccaaatggatgtatcagacatatacagaacattccatccaacagctgtagaatacacacttttcaactgcacctggaacattctccaggtagatcatatgttagaccacaaaacaagtgttaacagatttaagaagtgtgaaatcatatcaagtatcttttctgatgatggcatcaaactagaaataaataacaggaggaacttaagaaaattcacagatatatggaaattaaacaacatgctcctgaataactaatgggttgatgatgaaattaaaagggaaactaaaaaatatcttgagacaaacatcacttcttaagcaattttgttaacatatttctttttcttctttaaaatggtgccataacctccttcatgaaattgctgtgagacataaattagaaaatgcttgtacagcccctggtataggatctgtccccaggtcacttacagcaggtccccagcaggggtcatgctgatcttgccatctcccacagtaactattgttaattgttttgtcacaaatgcccctgaacaatcaatgggtcagtgaagaaattaaaagggacatttaaaaatttcttgaagcaaatgaaaatggaaacacaatatactaaagcctatgggatacaccaaaagcagcccttccaagaaagttgacagcaataaactcctacatcaaaaaagaaagctccctgggcacagtggctcgtgcctgtaatcccagaactttgggaggccgagatgggcggatcacttgaggtcaggagttcgagaccagcctggccaacatggtgaaaccccgtctctactaaaaatacaaaaattagctgggtgtagtgacacacacctgtaatcccagctactaggaaggctgaggcaggagaattgcttgaacccagagggcagagattgcagtgagccgagatcgcaccactgcactccagcctgggcaacagagcaagattctgtctcaaaaaaaaaaaaaaaaaaaaaaaaaaaaaaaaaaagcaagctcatacctccagcctgggttttgagagcctgtctgaaaaaaacaaaacaaaaccctcaagtaaataacctaatgtagcacgttaaggaactagaaaaataagaacaaactaatcttcaaattagtaaaaggaacaaaataataaaggtcaaagctgaaataaatgaaataggcactagaaaaacaatagaaaagatcaataaactaagttgtttttttgaaaacaaagaacattgacaaagctttagctagactaagaaaaaagagacgctactcaaataagaaaatcagaaatgagacattataaactgataccacagaaatacaaaggaacaattatgaacaattatatgccaacaaattggataacctagaagaaatggataaattccttgccatataccatttactatgattgaattatgaagaaatagaaaatctgaataatccaataatgagttaggagattgaatcagtaatagaccatctcccatttctatttattactgttgttattctaagagacagtgactccctctgtcacccaggctggagtacagtggtgtgatcatagatcactgtaagttgaactcctgggctgaaatgatccttctgccttagcctctcaagtagctgtggctattggtgtgcaccactacatccagctaacttttaaaatttttttgtagagatggggtctcactgtgttgcccaggctgctcttgaactcccagcctcaagtgacccccaccaccttggcctcccgaagtgctgagattacaggtgtgagccacccagtcctctgccaaacctttaaagaagatctaatgacagttcttctcaattgcttccaaaaattgaggaggagagaatacttccaaactcatttaacaagagcagtattaccttgatacgaaaaccagacaaggatacaacccaaaacactataggccaagatgcaaaaatctttaaccaaatactagcaaacctaatttaacagcatattaaagagatcattcaccatgatcaactgggattcttcctagaaatacaaaaagggttcaacctgtgcaaaacaataaatgtgctacaccatattaacagaatggaggacagaaaccatacaatcatttcagtagatgcagaaaaaacatttgaccaaaaaatattgttaactgtgctttcttttctgaacttaagaacttgcttttccaaaaccttcccagaatccctgtatgaatcaacaaaatttagttcttaacacatttctccttctttaaaatggtgacattagctgggcatgatggtgtgtgcctttaatcccagctacttgggaggctgaggcaggagaatcgcctgaacccgggaggcagaggttgcagtgagccaagatcacgccactacactccagtctgggtgacgagcaagacttcgtctcaaaaaaaaaaaaaaaaaaaaaagaaataatggtgccatacctttctcatgaagttgttgtgaggcataaatgagaacatacttgtacagcatctgggacatggacggcctctcaaaaggagtgctgctgttcttgctacctgcaccactgtaactgatgttgtttcatcatcctcgtcaccatcattgttattgattgtaaatggaagcacagtggtcatcttccaaatatgccactctgactctgtgaacttgtcactttataaagaggaaattcaagcttggaggggccttctggcatgacgtttattgaattgtggggcacaagatgcttccctgcttgttccattttcctttctcttgtttattctcctgccttatttatttattttttcttttgagacagagtcttgctctgttgcccaggctggagtgcagtggtgtgatcttggttcactgcaaactctgcctcctgggttcaagtgattctcctgcctcagcttcccgagtagctgggatcacaggtggctgccaccatgcccaattaatttttgtatttttggtagagacggggtttcaccatgttggccaggctggtgtcgaactcctgacctcaagtgatctgatctgcctgcctcagcctcccaaagtgctgggattacaggcatgagccagtgtgcctggcttcctgcagtttttttattgattggatgaatgtttgtatatcccatgagccagatgaggcacactgtccatgcacatagcaagatggtaacacttacaccatctttactcttttgggattagtcccaagctccttgagaatgactgccgtatcacctgggttttactcttcggtttctggttgttactcctcagtcttcagctcaattaggatgcatccatttggtagttttacagttagtaaccctgatggcttccactggtttacgatcttgtacatctaagatgatgaaactaaggttcagagaggtgagatgactttgagtaaaattgcatggtgagcaactagcagaattggaccctgaaaccagatttctaatgtccaaatcttgtcccttgtttatcatatcatggtggttcaataataattcttcgtgtttagtgtggtgtactagagctatcaacagagaaacttgagactgagaggtttgaagggactaattctaggtcacacagctaatggatggagcaggtctttaatcccagatctgggttccaagaccagtccttttctctttacgctgctctgtccctgctatctttatgtcagaaaaccactgagcttccttctagatgtcagggtttggcaaaaaagttatcatgtgcttctgcgtcatgcagcgttttctgagaatggggagagggactcattttgcatctttgatctctcttttttattttgagatggagtctcggtcttgtcgcccaggctggagtgcagtggcgcgatcttggctcactgcaacctccacctcccgggttcaagtgattctactgcctcagcctcccgagtagctaggattacaggtgactgccaccacacccagctaatttttttttgttttttttgtttttttagtagaggtggggtttcaccatgttggccagggtggtcttgaactcctgacctcaggtgatccacccgccttgacctcctaaagtttggtctctttttgtatcagcttctatacagacttaaccccatttttaagtcacagccagcatggtcaacttctgtcagttttgcttctgttccaaaggcttctgttttactaacatacacacatacatgtatgcatatggatttaaataaattctggtgcagggaagtctaggaggcaaagagagataaaactctgtgattggaaagtcacttctggaaactagacatatagagcagacctcactcttacatttctttttgaagtgcaataattttttttttttttttaacaatatagggcccagtcctgtgtttgacattaaagctgtttccatcagtccaaccaatgtgatcttaacttggaaaagtaatgacacagctgcttctgagtacaagtatgtagtaaagcataagatggaaaatgagaagacaattactgttgtgcatcaaccatggtgtaacatcacaggcttacgtccagcgacttcatatgtattctccatcactccaggaataggcaatgagacttggggagatcccagagtcataaaagtcatcacaggtaagatgactggctcccagggatgatgacaaaccatttcttattatggtgtattctagggccttgtccgttcaagttgcctgttggaaagagaatggttttcataaactagaagaggagaaaaggtgctatgttgtttcaagcctgggatttctggtggccacatcattcagtattaaggccctatgtgttttgggaagttctaactacttctgtttggtttttaaaatcttttgttattgttggttaacacctacctttctgttaagactcaggagtagagacttccttaaaaacgcgtgtcttcatggtaattaccagccttttaagctcccaggaaattgatgctgtgtttatattcccaggagtttctgttgggcaggaaagtttggtgtattttataggggagtgtgtgtttcaaatgaaataagagtttgatgatatttaaattttaattcagatttgacagtttagattttgatttatcttagatgtcaataccgaagccatctattatagctgcaaacttagctttttttttaagctgaaaagaaccaaacattttaaaaaacaggtggagaaacttttttaaggtgaggagaaccaaaaattgaagaaagaggtcctctgttagttttctgatctagggggctggggagtgtgatctcaggggctggagtcggccatgggcgcctgagctcttggagcccacggctggaggtgaacgaggtccagcgtggagcagcaaatatgaaaccagtggcttccgacattttaagtcaggaaactatttctttaaacaaaaccttgcccaggagcccaaaaagtaaaaataaaaaactggagagaaaagagccaaagaaatgggagtcacgggcaccctgacaaaactcctggagctcctcagagcactattttaggggggaaaacctgccataaaggtttgctctgttacattgtgaaagagagggaaaggagagcacagagagatgacagaagagaagagaatgagagaaaagagcatagaacttggaaatggtcatgaggacaaggtgaccccgagggggtggctgtgggaaaggggatgcggaggtgcaggaagcaccggtagaggggctgagtgtccttatctagcttaaagccctgagcacagggctgcatgggagcaggtccatcagctgctgcgtattgagcacggcacatgtgcctctctgtccttaatgttattttgtcctcacagtaaccctgggggctgcagcagaagacactgtaatgtggagaagttaagtttcttccggtgtctcagagttactgagtatcaagtggtggggctggaacccggagtctaactctagaccactgtggtgcagtgatgttcataacagctatccacagtcaccgagctgggaatttattggttctgcattacttaataaaacaaaaagacgcatgactgacctgatttagaactctttgcatgagagacatgtgctgtgaagaatcatcttaccgtttcggagctggacggtgccttagaatcatctaggccgatgtctttaccttcaggcccctgcagccctcaggaggggttttgctctatctgcagcactacctgtgcttttctgtacatgaagctgcagccctgggttctcctgtccccactgctaccaggagtgtgtgttcttgagcaagcccccctgcctctctgggtcttcgtgttcttattggaaaagtgaggggagtgcatgtcattttgggtgaagtggtttgacttatgtcaccatcaaccaaataacgcgatgggaggaaggtccaggatatagtggagatggaacgtcttctgaaaaatccccttggtgctgggatattgaatgtgctgcttacttgaaatgtcttggtaatttaaaatgatattatttgcattatcttgaattgagacctttagattagtaaacagtcactttatttgaggctttgttcctgatatctaaaacacatacaattaaatgctaccatttaaaagggacagtttagaagagtgtccagtcactattggggttaatcttggagaacagtgtggatcctaaacaatttcagttttaaggtttttttcttctcttccgtgttattattttctcccccagccctgctgtgaaatgatggaaatgcattgggctctgatagaaaggaagtatttttagtgagtcacattgggacatcagtgacctcagtcattctttctttttttcttttaaaacccgctcccagcactgaaccccagtcattcttaatgaaggtgactgcatatatcttgttccattaatgcatgttgtatttttaaaatagagccgatcccagtttctgatctccgtgttgccctcacgggtgtgaggaaggctgctctctcctggagcaatggcaatggcactgcctcctgccgggttcttcttgaaagcattggaagccatgaggagttgactcaagactcaagacttcaggtcaatatctcgggcctgaagccaggggttcaatacaacatcaacccgtatcttctacaatcaaataagacaaagggagaccccttgggcacagaaggtggcttgggtgagttacaaagggtaccttccgtctcccttactggttcttactttcagtaactaaatgttctaaaaaataaattgctcttccatgtgtatggagatttagaatttataaagggcttttcctccacattttagtttgatcccccacctgcatgaggaaggaaggaaacgtgttctgattttacaggggaacacattggggctgagaacagcaataggaattgaaactttttagagtctggcacccaggaaagttagaggcccctttagctttctatctaacagctgtgtcaacccaagttgggccttcagaggaacttatcacgtctgctggttgatgttggcgttgtcatttgcaggtttcatagcatttgcagaggatccccaggataactccatgaggaggacaggcacttaatctgcattttatacttaagaaaacagagctacagagtgggtgtcaggatccttgcttgcgagtgacagaaaccagactttggatagctcagacagaaggaacaatttattggctcatgtggattttcctgctagcgggaggccttagagaaagagatgaggcaattctcatccctccctcttgcttctttctgttcatcagcttcattctcagagcagctccctctgcacacttaaggagcccagctgctcctgtttcacaccctgcagctgccccaccagccagctgccccaccaaccagggtctggtccagggaaacgtgtcttgagtggggtctgattagcaaagtctgcttcacagagctgtccctggaaatccatgctgggacaggagaagataacaacccaaagaagggagaatgacctgaaataagcagagtttgaaagagaagcaccagatatctgtggtgctactggaataacagtacaaatggagatggagctatcaggcctttttatggggctgcctctctctctggaggaggaagggagcagatattgatggagcaccaactgtggccactgtctgatggccatctgatggggttggggctccgaaggaaaatgggggatgtgtccctcttgtggttgatgtctttttgtctcctgtgcttgaaacagatgccagcaatacagagagaagccgggcagggagccccaccgcccctgtgcatgatgagtccctcgtgggacctgtggacccatcctccggccagcagtcccgagacacggaagtcctgcttgtcgggttagagcctggcacccgatacaatgccaccgtttattcccaagcagcgaatggcacagaaggacagccccaggccatagagttcaggacaagtaggttgaactttgtaaaatggtggcagccagagtttcctagcacaatgttctgtctcctgtgattctgattctgagtgatttcttgcataacagctagttttgatgtcagagggagcttcctggaggagattttggacagagcagatctgctcagtttcttcttaactccatgggcagtgcacatctctcattaagtgaaatcaaatacatggagcagcccctgtgtgcgggcaccaggcactgcctcacgccatctttcacagctttgcgtggtggctgatgagacaaactggcatcatactttcctcttaaaaacaaataatcattgcttgtttttcctttgctttgagttaagaaagttatgaaagtgagtttcattttttcacccgccttgtaattcataccgatctttctgttgaaatgcttgttgacatgcacattgctgcttcctcgctataatttatcagcactttcactctgtaagttcaccaatatttggaggctttggtgaaaagagcgggaggtgaacacatttgggaatacttagaggtagttactggccaggctgtgttacttgtacagggctagaagttttggcaagacattggtgagaagccattctgtaaggaatgacagtttttcctggtatccatgttgaaggagggtccatttgtgtccttccttccctttgtacttgttttgctaatgtgggagtgggtggggaggatgcggccgtaggacaggctgcctgacctcatggggcctgcagtgacctggcaggagtggcaggtgggaggctctcgggtgaggagggcttggattccagagggtgggttagttggaggaggaggaaggggctcctatgtgggtgcggttggcagtggtggggtgtcctgcacatggtaagcttgcgtgagagagtgaaaggggctgaaatctggtctgtgtgccctgcgtcaagccatgcacccagggctgggtccagccaggggaaggtccctttgactgatttgctaaaaggacttgtagatttgtgtgggcctggggtccctgctttttaaagcagtttgagcaaaagcaaagtagtagtgattacatctcaggctcttggtggtgtgaattcacacacatcctgctttgggttgaactgtcttcatgcttggtaaataatcattatagtagcctttccctctctataaggggcgagtgtgtgtgtatagataagtcttagtcagtttgggctgctgtaacaaatggccatgcactagatggcgtaaacaatgaacatttatttctcagggttctggaggctggaagtctgagactggggtgcagcatgcctgggctccgggtgaaacaccctcttcctcttccaggttgcagactccctgggtcttcacgtggttgaaggggtgagggcgtggtttctctccagcctttttgataagggcactaataccattcaggagggaggtaattcatgatctaattacctcccaaaagccccgcctcctaaaagcatcacatcaggggttacaatttcaacataggaattttatggggacagaaacattcagtctgttgcaacacacacacacacacacacacacacacacacacacacacacacagataaacacacatttccacccaccccagagcaccctgcacttttcaagtgactagttaggtggggcagggttaaggaaaccatcagaggacattgttgaggcacccaagacacgacagaaagccacctctagggctgaagggctagaggaggacagggtgtttctggagcccagtgagagctggggcagtggtggacacagctgtgtcaggacaggaggcccagagcaggaggtgatggaggaaggcactgactcctttctcctgtggcccttcaggggcctgcccattggctcatagtggaacccggtcacagcccatgtggcaagaccccccatgatgccttgcacaaggtcagcctcctgggcccagagcaggtgagggaagggcagtggatatgtcgggagggtggagtgggcaggtggtgaataactggcactcgggttatcttttcttgaggttaggattgctctccagttttataggtgaggaagctgagctcaagtggttttcctgtggcccacctgggtgtcatagcagagtgagccctggaacccaggcctgcctcgtcctgacttctgtgatctcgggcgatcacatagatcgcagtgttcgctcttgcatcatgtgtgtttgacaacttttctgggtgcccctggccctagggtaagacatgcatagagtccaagtcatcatttaggtcaaatctctaaagtcaacttacaaaaaggaacaaagaataaccctgcaggtgccattggccaggttgtttcttcaccgcccaatgatgcctgactttggctgggaccgtcatgctttcctagccacggttgatggtgcagaggaggaaggaacactcccccaggagagtttgctgggcttgacagcatgccctgatgacctctccctccctctgccttggccgttctggttattttgaactcctcttgtgttctcacagatgctattcaggtttttgacgtcaccgctgtgaacatcagtgccacaagcctgaccctgatctggaaagtcagcgataacgagtcgtcatctaactatacctacaagatacatgtggcgggggagacagattcttccaatctcaacgtcagtgagcctcgcgctgtcatccccggactccgctccagcaccttctacaacatcacagtgtgtcctgtcctaggtgacatcgagggcacgccgggcttcctccaagtgcacacccgtgagttcatgcctggctctcaccaccctttcctgctgtcctgctccgtgccaggcccagacacaggatgcatgatgtagtaatggtgactgttggctgaccacacgccaagcttcgtgtgacatgctttccttgcactggcacattgtatgctcacaacagccctgtgatgtggttggaagtagccttattttatagataggaagccaaggctgagagaggtgctagacaggtatcacagctggaaagtggcagaggtgagattaagcctctggtatttctcacctggagcctgcgcttgtaactctctttccagtgtggaggagacctagagtgaattgatacagggagacaaaaatgacctggtattcatatccccttgtgtcttgggtgctgacattataacgaatcactggcacagctgtatctcatctttgtttgtttaaatgtcccttaaaaataagattttatgcagcaaataaaaagctttaggtttcaaagaaggtccgataatgtaaaataaaacagtaatggtgcactagtagtacagtggtataatattgattatatactattaaacaatagtagtgacaccagcactgcattttgcactgtgccatgagatttatagacactgtagtggcctccgaggtaggtattggggtccccttttacagatgaggaaatgacaccctgatggctgaacagtttgcccaaagccacagagctagtgagtagcagagcaggacttgaactcaggggtgtgtggctctggacccaggcttatcccacaagaatgtccattccttcgcaggaagcacaccttagcattcttatagatgtattttggactggatctttgggaaaatgaaatatgcttgcatttctttaccttttactcttttactatttattagttaggattaggttcagccacgaataacaccaccaaaaacaacaacaacaaaacccaagtatccgtggcttaaacaagacaggggtttatttctctctcctgtaacagaagcccagtgctaggcaggatggggatgatagaggttatccaaggctcagttgtatgaaacagaaactgtgagctattttaaccaaaagggatttatcctgggaattgaggttttgcagaatcattggaagagctggtgtattagtttgctagggctaccagaacaagtaccaaaggctgtgtggcttgaacagaaatagactttctcatagttctggaggctgaaggtcaaagattaaggcaacggcaggtgtggtttcttctgaggcctccctcttggcttatagatgactgtcttctccctcacatggttgtccttagtctgcgtgtgcctatgccctcatctccctttataaggacaccagtcttgctggattagggcctaccttcatgacctcacattaacttaattacctctttgaagaccctgtctccaaagacagccacattctgaggtcttgggggttaggacataaacatacacatttgggggtgagggagcacaagtcagctcataacagttgaggagcaggctttaggcctcgccccaagaaatgactcctggactaagtctgcagaactgaccccctggagagtcaccaccttggtcacagacagcagagggaggaatcaggaagtctctgctgtagttgcgggatccaggggtctatgttctgagctgtgatcctgggatcaggaagctgcagccaccgctgaggttttggttctagagccaggcagcgtgagctccagtcattgcatccacactacaggtataagaaggaggaagggcagaaggttgtgccccacccttaaaggacacttcctagaagtcacccagtacctctgctcatgcttcgttgagcaaaacttagtcacattgcaacatctagctccatgggagctgggaaatgtggtctttgtttccaacaggtatgcacacacagggctaaaaatctgggtgggtatgatgaagggaaaatgggggaatggattttgggggtcaagactggtctctctctgctgtccctccctgaacagaggctctgggaggctagtaatgcattcgagataaagcagccagtgtggccaaggttctcctccagagcctgagcccttgaccacaggagctcacgcctcctctcatttcctgtgaatgattgtgtgcaatgtaagcacagagcttctgcactctcatgatcaagtgctctctccatggccagaaacagcagtttctgaggggctcatgttgtaggtgatgatacaaagaagacagagagagggatcaggtgtcctaagtgtacatttcatctcagtattttctgaggtggggcatccctgtctcctggagaagtatatttttaatctagttgtttactttctttgcatagcccctgttccagtttctgacttccgagtgacagtggtcagcacgacggagatcggcttagcatggagcagccatgatgcagaatcatttcagatgcatatcacacaggagggagctggcaattctcgggtagaaataaccaccaaccaaagtattatcattggtggcttgttccctggaaccaagtattgctttgaaatagttccaaaaggaccaaatgggactgaaggggcatctcggacagtttgcaatagaactggtaagcaaataggcttttctgttaaaccatcatgtttcttaaaggaaatcagtataattaataaacataatgtttccaaatattgtttttcttttaattatctaagaaaaaactttaaaaattttcataacactaatgcttatttattatatgaaatacagacaagtaagtagaaaaaacttacatggaaaccatcaagcagagataatcacttttgatgtatgacattttacaatttttaaacatatacatatagatacacaaatatatgtgtgagtatacatatatttaatacatatatatttaatatttaatacacacacacacacacacacatatatatatatatatatatttttttttttttttttttttttttttgagacagtcttaccctgtcacccaggctggagtgcagtggcatgatcttggctcactgcaacctccatctcctgggttcaagtgaagcgattcttgtgcctcagcctcctgagtaattggaattacaggtgtgcaccaccatgcctggctaatttttatagttttagtagagacagggtttcgccatattggccaggctggtcttgatctcctgatctcaaatgatctgcccacctcagcctcccaaagtgcttggattacaggtgtgcgccactgcacccagcccacaaatatatatttatttctttcacaaacattgaggccatctgtacatgtggttttgtaatctgccttttccccaacttgccaattaattatgaatattctttcctcttaataaaatatttctacaggatgatttgaacacctgcctggaattccatcatctgaaacagagttggcagataagaatggcccctatgccaaatttggctcattgtctgtttttgtaaataaagttttattggatcacagccatgttcatttgcttatgtactgtctatggctactttggtgctagaattgagtagtggcagcagagaacgtgtggcttgtgaagcctgagatatttattttctggccattacagagaatgtttgctgacctctgggctagatcagtggttttcaaattgtggtccagggctctctagggatccctaggttctttcaaggggtctccaaggtagtattatcataacaatactaaaatgttatttggctttttcattctcattctcttttggagttttccaactttgatccgatatgggatgacattgtctctcaggtctaatggaatatatgctgtggattcttacattttaaaaatttcttcattttaaatccctgatatagtaaatattaataaatataacctatgtaaatacaaattctctgagagccttaataacttttaagatggtaaagaagtcctgagagcaaaaagtttaagaacctctggtcaagatgtgttagaaattaactactgtgctgtgttgggcaggtggactgttcacagtctttcctaaacaacactgtgatgagatactttgttagttctagaaggctaattgaaattgataaaatcattttatagtcagctacggtggcctgcacccatcgtcccagctacttgagaggctgcggcaggaggattgcttggcccaacagttgcagactagcaccagcctgggagaccctgtctcaaaaaaaaatttttttttatagaaacagtttaaattattaaattatttctaggcctacaggagaaacttctgggaaatcctagagagtaatgttcattattgttgttttaaaattttgaaataattgttttttggaaaggttgaaaaacatacagtcttccttgatctaagattcaagatagttgaaatcttttatacagagggtagaataaagatatacctaatgtaaatgatgagttaatgggtgcagcacaccaacatggcacatgtatacatatgtaacaaacctgcacgttgtgcacatgtaccctagaacttaaagtataataaaaacatatatatatatataaaagaaatgggacagattccttgaaacacacatgaaatgagttacgcttttgagattctccttgaagaagcttcttcaactgtgctggttgggttaagcaccgatagtcactcagaggatctgcttctgaaataagggatctactaaaatgcatccctcagatgaaatgcagtattccctttgcaaatctgcatttcagactgttgacatgacgtcttaacgtcaacatgtttcttctgtcttttaaggatgtggataatggtaagaggatcaccactgagggagatgcatgatgttgtgctacttgctattgcccagaacttactgtaacaataatataatatgctgggggtctgcgaagtgctgagtgctctcatactgcattttacatttttaacacaacttcatggagcaggtattattatcatttctgtcttacagagtaagaaatgggggctctgcaaacttaagtaactggcccagagtgacaaggtggcaaactgacctgtgtctgctgtctaagaccaagtgcttaaccaccatgtagattgacactttgatgtggtacagcagtaaagtttagtattagtgaggagagggcatctcttttactatagtttattgtgaatattctttcctcttaatatcagtatttctacagggtaattttaacacctgcctggaattgcattgtctcaaaggacccgtttcattcaatggtcccattgaatgaaagtcaagaaggcttgctataagatctaaactcttaggggggttacctttctattatcaaataacctttattgttattggaaaaagtcagcttaacagcattaaaagcaatttcaaaaaaaggaaacgaataccatatgatccagtaattccagtcctatgtatatctccaaaagaattgaaaacaggcccctggacagttatttgtacatcagtgttcatagtagtagcattgttcacagtagccaaaggtggacccaagatcccatcaacaaatgaatggatagataaaatgtggttcatccatacaacaaaatactattcagccataagaaagaaagaaattctgatttatggtacaacatggatggatcttgaggacattatgctaagtgaagccagacacagaaggacaaatactggatgattccacttacatgagtacctagattaggcaacttaatattctacagaaattagaatagaggttaccaggggctgttcagaggagggagtgggcattattgtttaatggctacagtttatgctggggataatgacagtgttttgggtacaggtagtggtgatagttacacaacattgtgaatattgatgataccgaattgtacactgacaaatggttaagatgataaatattatggtatgtatgttttaccacaataaaaatgaaaaggaacaaatatctctatttttctaacccaactgaattccttttctctctgtgtccacagtcatacattttgcttgtatactgtaattattatacaaatacttttattttgtatttgaatttctttttactcagtctataccacaactttcccctatagttagcatggccttcatatttttagtggctaaagagtatttcatcatgcagccagatcacagtgcccacagccctccccatgttattgaatatttaggttgtttctaggtttttatgtttatagacaaaggctgcctttcatgggcttttgtctgtggaatccctttgacatcaggaatctgctggtaggaaacaaaggctcctcccagtggcttctctgtaaggagaatccacttaaaattaaaaaaaaaattaattttggagtagatagtacgtaaacatggcacaattttttttgttttttggacaaggtgtttgcagtgaaagcatttcccttttttgtcccctacctgcccatttcctctccctggaggtgacgtttgttgccaggtaaagagagacagggttgaaagccgcggtagaaaataggcccagcctccgcggttacttccgggcctctatgtaggcatccctggtgcaggtggctgagtgggcagcgggagatgatcggaggatgggctcctgtgggagattccatttctgactctgctctgaaggtgcagggtgtgcctgttttcttcccttcctcatccgtcctcaaatgctgcaacttagtaaaggtcagctctccatttcagttttcctctttggtatgtaaggctgtgtcacgggaagatgtttccttctgagtgactgatttaaaaaacacaacaaaacaaaaaaacctctttattgagatataatatacataccgaaaagggatgtatcctcagcacatagcttcatgaacttttacaaactgaacacatcttgttaccagcacccatataaaaaaactgaatgtgatttccacttcagatgaccccttgaagggctttttttttttttttttttttgagatggagtttcgctcttgttgcccaggctggagtgcgatggcgcgatcttggctcactgcaacctctgccttccgggttcaagtgattctcctgcctcagcctcccaagtagctgggactacaggcatgcaccaccacgcccggctaattttgtactttttttgatagagacggggtttctccatgctggtcaggctggtctcaaactcccgacttcaggtgatccgcctgccttggctgcccaaagtgctgggattacaggcgtgatccaccgcgcctggcctttttttttttttttttttttttgagacagagcctcattctgtcgcccaggctggagtgcagtggtgtgatatcggctcactgcaacctctgccttctgggttcaagcgactcttgtgccccagcctcccgagtagctgggattacaggcgtgtaccaccacacccaactaatttttgtatttttagtagagatgggttttcaccatgttggccaggctagtctcgaacctctgacctcaagtgatccatctcggcttcccaaaatgttgggattacaggcatgagccattgcacccagcctaagggctcatttttaagacaacaacaaaaaactggagaactggtaagataaactgggaagttcatgtgcgtcacagaagagctgaaattcttgagagcactgagtgtgtgcatttctcagctcgattttggagtgtgccttttgtgaactcattagaaagcgtaatggcaaaagagcaggtcctctcgacagcacttggagaggaagctgggcgtcatgatagtaacagttttcccttctccttcctttcttctgagcagttcccagtgcagtgtttgacatccacgtggtctacgtcaccaccacggagatgtggctggactggaagagccctgacggtgcttccgagtatgtctaccatttagtcatagagtccaagcatggctctaaccacacaagcacgtatgacaaagcgattactctccagggcctgattccgggcaccttatataacatcaccatctctccagaagtggaccacgtctggggggaccccaactccactgcacagtacacacgtaagtctcttaggatgcccttctaaggaacagcctctctaactgtctcttggaggaggcactggttaaatgatggccagtgtgcttctgggatccaggttgactctgaaactgctgaagttgaaaacattggtctcagcaatggttctgctgtcaccatggggcactgttcttcaagctatgtgaacttagaattgtcattagaaggaagaaatgattccttgggaatggtgactgaaatggttctagtcattccttgagaatacagagtagagaagggtcaccttgtcatgttggtattggaagatactgcccagatgaggagcttcgcctgcaacagttagggaggtgttttgcgaatatttgaattaaatacatggtaaagatgttagtttgtaatatgtttttagtatatttttctccatctattagatttaaaaaacagattagaaattaaatgttaaaaatatatttgaaataaacttgaagtattaaaagaagcctaaattaaacttcttttgagacttaatctgtataattattttcttgatgtgtttttgggaagttttccatcttttgagccagcaaatactagttttattcattctttctaaaacgagccaggctatttttggatatagtaaatagtcctggaattctacttaatctgtgcttttacatgaattgccttttttttaaaatcaagggcccagcaatgtgtccaacattgatgtaagtaccaacaccacagcagcaactttaagttggcagaactttgatgacgcctctcccacgtactcctactgccttcttattgagaaggctggaaattccagcaacgcaacacaagtagtcacggacattggaattactgacgctacagtcactgaattaatacctggctcatcatacacagtggagatctttgcacaagtaggggatgggatcaagtcactggaacctggccggaagtcattctgtacaggtgagtgtagccccaactgcctcttggactcctccctgagtggtgctgaccttgcaggtcagtcctcccaagtctgtagtttgtctggttttgtgtgatgtgcagtgatggacattgagctttccgaggcatcctgttagcttatcggtgctgtctcgatgccctcatcatttctgcattcaataaatatttattgagcatataccatatgccagtcaagtccttgccttcttggaacttttcgaaggaggaagtgggatgtttacctagagtgctcaggaaaggcctcaatgacaaggtgacttttgagcaaagatctgaatgaagggaaggagccagccatgtggatatcagggcatgagaacattacaggcagaggcctgtgcagaggggcctgtgcagcatcaccactgtatctggaggctggaggaagagcaggaggcaagggtgggaggagtggacccgcaggaacaggaggatataggtgggaggtgaggcctgagtggggctgagccaggatgtggatgatatctggcattggtttgtcttttgtgctggagaagatgaaaagtttattgaaatgatgcccagcctttgcatccttcttgatcctcacctatctcacaactgaaaatgtgtgataaagagaagagccctctgtgtaattgaggatgctttcagggcagcccaggaaaggctttgcagacagtggtgggcacttctgctcacagtgctgactgtggcacctttatcactcagcacccgtgcactactcattttctgcccttctcgctcctacctcttccctttttagcccaggccattcagatatgttcaggctgatttggaagtgatggtctcatgggatcagcctccctggtagtataggagctccagccttgatggcctctggcttttcagtggtgagtggggtggccacagaaatccctgcagctttgggtcacttctgctccatcccacctggtctagacacccatctttgatatttgggtgcctttcattgctgatatttatcttagctatagttatttgtagcctatagcaagagaaaaactgtatctgagcatttatgactgggtgtgggtggaacaggagctgtaaaagtgggtgcagtgttcaggttacctttccaggccctgggtggcaaatgtgggtgttgcactaggtgccttggtagagcttctcctgctctaaaattctgtgacattcaattaatgataatactgtcctccagttgtaatatggagttttctatttacatcagtttgatgttagtcctcagtaaaaatctaatggccctcagatagagacaaataacactctattttgaagatgaggaaactgatgcatcatcaatggatgatgcagtatgttatgtgagtagagagtgtcttgaacttagacttagaaaacctgggatctagttttggcttcaccacctgccatgtcatcatcagccaattacttaacctctctgagcctctgtggatttatctgcagatgggacagtataggcctcacctgtctcagaagtatcatcaagagggccttggctgggctggtggctcacacctataatcccagcactttgggaggccaaggtgggtggatcaggaggtcaaaagatcgagaccatcctggctaacatggtgaaaccccatgtctactaaaaatacaaaaatcaactgggtatggtggtgcatgcctgtagtcccagcgacttgggaggctgacacaggagaattgtttgaacccgggaggtggacgttgcggtgagctgagattgcgccattgcactccagcctggtcgacagagcgagactccgtctcaaaaaaaaaagggggtcctcatgatgagatggtgcaagtgaggaggttgctacttctcacaggatgatacagctgactctcatggagccctggtctcttccaggcgtctttcttggtgcctgacatcattgttcaatttactcttcaaagagtcctgcagctgaggctcagagcagttgggtgactgacccaagctcacacagtttggtgttgcccaatttagggtcagcccctgcctcttccaccacatcacccacccaccttctcatccccaggattctgctactccctatttccatgtttgcaaaggcaaaagtcccggaatctcatgctgtgctgtacttgctttgcagatcctgcgtccatggcctccttcgactgcgaagtggtccccaaagagccagccctggttctcaaatggacctgccctcctggcgccaatgcaggctttgagctggaggtcagcagtggagcctggaacaatgcgacccacctggagagctgctcctctgagaatggcactgagtatagaacggaagtcacgtatttgaatttttctacctcgtacaacatcagcatcaccactgtgtcctgtggaaagatggcagcccccacccggaacacctgcactactggcatcacaggtgggctacaaggcaggggctggtcagttggcactgtgatcactcctggagcggctgacccacagtgggtctgcacgtgtggactagaaatctgtttttgtttttttatttcccctaaaatatttgcttttactgacatagactggtttctcattctatagaaatcaatctaaaaaagcagagtaagaggggctcattttttacattctaaaagattccttttctttacagcataactcattgcctcattgccatgttttcttttatatttttttgagatggagtcttgctcttgtcacccaggctggaatgcagtgacgcaatctcagctcactgcaacctctgcttcctgggttcaagtgattttggtgcctcagcctcctgagtagctgggactacagacacatgtcaccacgcctggctaatttttgtatttagagatggggtttcaccatgttggccaggctggtcttgaactcctgacctcaagtgatccacccgccttggcctcctaaagtgttgggattacccacgtgagccactgcgcctggtcgtcttttagcccacatctgttggtggcttactgtgtgctatggtgagggatactatggtgagtaggggcgacagggcccctggagcataggactgagaagagcattgagagggagaggatttccaggtctggtggtgggtgagctagcatgctgctgccaattttgcagcaaggacctggggatggaccttctctggccagctacagggtatagagctggtgggaaatgcaggagcctgtgctagcagttgaccattaacatgggaacgccacctcccagcgggcactgctgccgcatacttgcgaggttgctgaagcttgtagtttagagcaggaccatcccactagatgtgcaatgtgagcctcaggtataatttaaagttttctagaagccacactgaaaaaaaagtgaaaaggaatagccgaaattggtattaatagcattttacttaacttagtatattaaaagtattatttcaacatgtaatttctgtgaagtattaatgagttattttatgtcttcttttgtactaagtctttgatatctagtctgtattgtgtgcttgtagcacatctgaatgcaaactggtcacctctcaggggcttggcagccgcatgtggctagagggctgctgtatcagcacaggtttagacaattatgttgtggttgttttggagttcagatttctgtctccttgaatcttgaatatatataataatgagaacaggctgggcgtggtggcttatgcctgtaatcccagcactttgggaggctgaggtgggaggattgcttgagccaggagtttgaaaccagcctgggcaacatagcgagatcccatctcatttattttttaaaaatatataaaaaaaatgggaataacccaaactgtatgtgtgagatgaatttaggtagagagagagagtgtgtggagtggatcatctttaattcagtgtgttctttcttttgtgttagttcagagagtggctccataccctggcttggaaagggggggtgtgcacaatcatggaggccatccatggagggtcctgtgggggcttttctggtttctgggaagaggatctgttgggtttctctaggtggtatttgagaccaactctgggaaaaatgtggggactgtttatgaagaacacagagaagtgctgtgcccaggtctcagcagaaagtgtgttctctcccacctcatctgtgattcttctccttggacatttgctccgtctttgctctcagctgaccagctgatcctggggccaagccaagtccatgtggtgtcattgtgcagctcccaaggccacaccttagagttccaccacagtctctttctcactctccttcttccaccccagatctcaggataatgaacccggctcatcttgagtcatatgggactgggggagaggacaagggcaggttagcttcctcatgcaaggatactagcttcttactctaatgatggtttcttttactgtgcaaaaccttttcagtttgatttaatcttgcttgtcaatttttgcttttgttgctgtgctttttgtgtggtatccaagcaaccattgtaaatactatgtcaagaagctcttccccaatgtgtttttttttttttttaaacaaattttacagtgtacagctttaggtctaatgtttaaggcttgaatctattcagagtttatttttgtgtctggtgtaagatagaggtccagttttattatgctcacggatacacagttttcccagcaccatttgttgaagaggctgtcttttccccattgtgtcttcttgacatccttgttgaagataagttgactgtatatgtgagagtttaattctgggctcagtattctgttctatgggttgatgtctgtctttatgcctttaatatactgttttaattactgtagctttgaataaatatatcttgaaatcaggaagtgtgaggcctccagctttattctttctcaacgctactttggctattcctggtctttgattgttccatgtgaactttaggattttttttttatattctgtaaaaattgccattgggattttgatggagcattgaatttatagatcgctttgagtagtgtcaagtcttccaacaatgtgaagtcttccaatccatgagcatgggatgtctttgcatgtatttgtgtatttgtatcttctttattttatcgatgttttgtggttttcactctacaagtctttcatctccttgattgtattctaattatatttcaatcaatctgttaaaaaataaaataaaagcatgtactgttcaaaacaacaatagcaaaaccaaacaaggctgctgggtgcctgccctggggatttggctggatgccctgaaggggtcattgtgagctaggtgggtttcccaggatctgctgtctctgctcctcaccagtttccttccctgccttttgcttctggatttgctgttttgcacgagcccagcatgtagcttccagagtaagatcttgaggaggttgctgaagcatgttctctacctaatgtgttgctttggttttcaatattgggtgatcatgttttgttttgttttgttttagatccccctcctccagatggatcccctaatattacatctgtcagtcacaattcagtaaaggtcaagttcagtggatttgaagccagccacggacccatcaaagcctatgctgtcattctcaccaccggggaaggtaaggagaggcctccgtgggttaaacagcccatgagtgatgcagtgaccagagctttctctgtgcccactgaggcatgtgagtaatgcagacacacgcctgtcttctcactgcagcctatgctgtgtactcagacagagaaggagggtgaggtatttgcctgatggttgacaaactttctggaaagggccagattgccaatattttaagctttgcaggtggtatagagtctgttgcaagcattcgactctgccattgtagtgtgcaagcagtcacagaagatacagaaggaatgagtgggaccattcccactagatgttatttaccatggcaggtggatttggtttgtggcccataacttgctgatctgtgatctaggtttttcttctcttttacctcactgggccttttaggtggtagaatattagttttaaccaactctgtctctctctctcactctacacacgtacacacatgccatcctcagaggatgactttcctttgaaagaaaatagaaaaagatttgcatttgctagtgggaatttgcagagtatctccttagctgagagaagaggtggattaaaagctgcttttccttaaagggctctgttacattcttttgtggtaggaaaggaatcattcgagagtctcttcggtagctgtgtttgagtgcttgcataaggcctagatttaaaagcccaagttttgttgtgggggttccctcctccccctcccctcctccccctcccctctcctcctcctccccttctcctccccctcccctctcctcctcctccccttctccccttctccccttctccttcccttccccttccctctttctttcttttagagacaagatctcaccatgttgcccaggctggtcttgaactcctggactcaagtaatcctcccaccttggccttccaaagtgctgggactagactacaggcatgagcctctgtgcctggtctgggagattctttatgcatgaataatgcagtgtttcctctgcccactctctcctactgtggtgctgtcctcatgtccttgaggaggatagagaccaaacacactgtcggggttagggatctgggaggatagaaatttgctggtgccataacctgtggcaaaatttcaaaaagtgaggttgaaatctctatcttttaattttgggtctgtttccagctcttagtcattttgctgtgatgcttgtcagcaagtcccattgaggaaggccatgttgcatagcagccagactgaccagtgctggcctgtgattagatgaaaccttgggctctgagcccgatgccctggattgggaacccaactctacctcataggcagtgtgaccttgtgcctggtcctgttagccttttgtaccttcgttttcttgtctgtaaaatggagacaataagcttatgtgatgggattcatggggatgaagtgagttactgtaggtgaaacccttagaattcaatgtaagtcaaacctggcacagagagatacttgagagatggttgctgatcactatcacccaacatcaccaccatgtagatatgcaggagaagaaatctctctgccatcactttcttatgattctccttctgtgtacctttcttagctggtcacccttctgcagatgtcctgaaatacacgtatgaggatttcaaaaagggagcctcagatacttatgtgacatacctcataagaacagaagaaaagggacgttctcagagcttgtctgaagttttgaaatatgaaattgacgttgggaatgagtcaaccacacttggttattacaatgggaagctggaacctctgggctcctaccggtaatgtcttctggttcttactctttgggggctgagcctcatgagcataaagctctacatgcctgcggtcagacacgtctcagggacctctttttgctctttgttatcccacagggcttgtgtggctggcttcaccaacattaccttccaccctcaaaacaaggggctcattgatggggctgagagctatgtgtccttcagtcgctactcagatgctgtttccttgccccaggatccaggtagggagaagacaacagtcctggcactggttcagtggcattttgctccacgtgtccatagaaggccagctgtgtacatgcctccctcagaccttcaggagggttggtgtgcccagctctcccctcccagaggttgagatgtcactgggtcaccgggcttactgggcttcctcctccgaggtcccacagcctggaccccacactctcccttctctaagtgccagttgttcttccaatctgcaaagattattgactccccttatctatgtgtggtcacttgtgggcccatatgccaggtgcacagtttgacacattgcattgaatccttaaatagtagaatcagaggaagccacataaattgtcttgttcaatcctctgtttatttttcttcataattttaattatgtttattgatttgtttattttattttatgttttttttttttttttttcagacagagtcttgctctgtcacccaggctggagtgcagtggcacgatatctgctcactgcaacctctgccttctgggttcaagcaattcttctgcctcagcctcctgagtagctgggattacaggtgcctgctaccatgcccagctaatttttgtatttttagtggcgacggggttttgctctgttggccaggctggtctcgaactcctgacctcaggtgatctgcccacctcggcttcccaaagtgctgggattataggcgtgagccaccatgtccagcctatttattttatttttgagacggagtgttgctctgttgcccaggagtacagtggcatgatcatagctcactgtaactttgaattcctgggctcaagggatcctcctgcctcagcctcccaggtgggaccacagttgcttaccaccatgcctggctaattttttgtagagatggggtcttgctatgttgcccaggctggtcctgaactcctggcctcaagcctccttccaccttcttccaaagctctggggttacaggtgtgagccactgtgctctgcctgctttttggaagtgagacttttaaggcctagagaggggaagtaacttgcccagggttacacgatggctttagaggcaggcctgaaattctggtcttggacccttgttaagtgcttctaccctttatcacatagacctaggtgatacaggagcttcagggatccaagaggggtgcatcccctaccttcaagccagaggctaatggactggctggtttgttagtttgtctgcttttctttcctagttggtggttgttgggcgcaggaaagaatgcctgccccagaagcaaagtttagggagtccccacatccttccccggtaaacaaatgggtttcctgtcacctgagcatggatgctgctgtaggtacctctgctcatatgtgggtgctagtctcaaaatgtcagaggtggcaggaaaaatatctgaaaatccagcccagttccctaaatttgcagttgaggagacagacctggagaggaacagtaactttctcaagaccatccaggtagtagtggattgggaacaggaacctggcttctgcatgcatagactagttttaggtccaaagctatttaactcccttgtgtgtgtgtgcgcctgtgtgtgtgtgtgcatgcatgtgtgtgtatggtatacacactttaactctctggtgttagggtcccaggccagtttttagcacattgtgtggtctgcatgaacacctcttgaagtgtctcccatttggacttttctcaggtgtcatctgtggagcggtttttggctgtatctttggtgccctggttattgtgactgtgggaggcttcatcttctggagaaagaagaggtgatattgcttatgctaataataatactctggtatttaaggaagctttctattaaggaacatttcaaactttgacagattcagaaggaatgatatgatgagcgccatgttcccttcacccatagtgttctgcatttggccagtcctatttcctctgcgcccccagctgggcgatgttaatgtgctcccagctgtcacatcaggccactgatagacgccacagtgtgggatgctactttcaaatgatatgttcttgtttacaagtcagtttcatagtattatgatgttaagagatttcatttcagaggtagctaagtttgaacaccagctctgtctttgaccagctgtttaggaagcttagccttaatgtcctcatctatgataggaggataatcattgtgcctaacttgtgaagctgaggaggattgaataaataaggcacttctcagtgtcttgtgccttgtatgctattactattattttatctgtacaactaccctgtgaggtcattaaatggtaaaagtagcagccctgttttgagtgctcaccgtgtgcctgcatctgtgctttctgtgaattatcgcatgcatgaggctctgcgaggcaggtccagtaagtcccttccaaggatgcagaagctgagtcaggaagtgtggaaatagaacttgaacctggtccttgcacttcatggcacgccctcttgtctgtgtagtgtgtgaagcctgtgtgtgttagttgggatttctttgctgtaaggtgctgccaaccagggaatctccatcctgccttaggggtcctcatgcggcccaggccggttccttgtgctgccaccctgccctgttggagtgacaggcagagctcatgctccagcttttaggttaggttctgtttttttttttttgagatggagtctggctctgtcccccaggctggagtacagtggcatgatctcagctcactgcaacctctgcctcctggttcaagtgattctgctgcctcagcctcttgagtagctgggattacaggcaccgccaccacacccagctaatttttgtatttttagtagagacggagtttcaccatgttggccaggctggtctcgaactcctgacctcaagggatctgcccgcctcagcctcctgaagtgttgggatcacaggcgtgagcccctgtgcctggccagattaggttctgattttggggggggaaatggatcagtcagtggctggataaaacagttttattgtttcttgttaaaaataagagtaatacatgcttatggcaaaaaatatagaaaagaagagcaaaaataaataggaaatctgcaatcgcagaacccacacaaaactactcttaacattttgatgtgaccaaactcacacacaaatgtgtgcacacacatggaatcatgttacatgttagaatcaagcctgctttattcagcttagacattgttggcagcttcatttcatcacaattttttttttttttgagacagagtttcgttcttgttgtccaggctggagtgcaatggcgtggtcttggctcactgcaacctctgcctcctgggttcaagcgattctcctgtctcagcctcccaagtagctgggattacaggtgcccgccaccatgcctggctattttttttgtatttttagtagagatggagttttgccatgttggctggtcttaaactcctgacctcaggtgatccacccgcctcggcctcttaaagtgctgggattacaggcatcagccaccgtgcctggctcatttcatcatcattttaagtggctacagagtattcaactgtatgacagtaccatgatctagttaaccaatttcctaggtgtttccaagttttttttcttggccacagttacttatccttgtgcctaaatctttgggcacattcacgattatttccttaggctaaattccaagctaggcaagtgctgggtcagtgggtatgcgtgctttcagttttgatacatactgccaaattaccttccagaaagtttttcttaaataccaatgcagagttgagtcaacagtgcaggagtgtgcagatgcctcaccaacttgccagttccggatctgatatgttttttggtttattgcattcatttatcagaaaagctttctcaaaaacaaagtatgaaataacaagtcttgctttacattaaagtaatgccactgctatatatttgcaaggaagttcttaaaagtgacttggatatgatttttttcattcttttagatagtacaaaagaaaataacttcacaaatttgtaattagcatttgcagcttgggtcattaagtttagtattagggggcaggatttggtgtcagctgtgaactaatgcctgaggaaaaggtgtaacacctttatttcatagatgacatcaactccagatacacaagggaaaagcacaggaaggaatccttttttgtctaatgggtctcttttctcttaaaacaggaaagatgcaaagaataatgaagtgtccttttctcaaattaagtaagtctctcaaattatgagctttattttaaatcctccaatctgttcggtgactatctataaataatttttgatggaacttgctgtcatttttcctgattggcacattttgaccatgaccatctggaagtttttgctagctctgttttctgcaaggaatctatgttttattagtctcctgaagctggcttccttgtcatgttctactcttctaccaataaatacggatttcttgattaaaaaaacgtcaaataggttatcaagatccaggggagagaagaacttacttaaagtcacaaaaccaattagttacaaagtagggtctagaaatcagatttcctgaatcatattttagtgttttgtgaataatagtactctgaccccctcttgccaaattataccctgggttttgttgttttgggaagattgtttactgtcatttctagagtatgaatgagtctttctaattgcatattttttctttccctttctatcatgaagacctaaaaagtgagtaatctctttattttttttaataacttgtacttttctattgaatatggacttcactgaatgtaaaaaatcctgataagttttgttttcttagatctaagttaatcagagtggagaattttgaggcctacttcaagaagcagcaagctgactccaactgtgggttcgcagaggaatacgaagtatgttgctgtaaatactgtttttaattgtgtcaggttccaacccaagctgggatctgaggggagttggtggatgggtggcaggtagctgaaagaacactcgagggactgtaggcagttgggacatggctttattctctctcctacagagtcagcagtgcagttatattactcacagacaatagtggctcaaagccaggtatgaactcacacaaacaggttacattaaatggctatataacgcaaggggttgttgcgctccaaaccctttgcgtcatactgtcctggatgtctaccttggactactcctgactgaagcacagccactttccttagaaattggcttgtttttcctgaaagttagaaaactgttaacagaaactaggaattcaagtcagggaactgttagccacaatacttaggaagctatatgagctggaaagaaaccaaatgggcatgtagaggtctggggcttgatggcagtgtggcctaggatggcttgtgaggctcacttctgaagccctgcacaaggaatttcttggccagtgtctgcctttcagttccccatgctgtgctccaaccagcccaggaaccagccctgctcagagtgaccatgcacactcgtcctcctgtgctgccctgtccagcatctctgcctttgctctcttgaaatcctgctcagcactcagcacagtgcacatgctgcttcctccatgggcattctgggatcccattaggaggacttgagttctgtgtgctcagactgccttgtttcccctgttgcttgttaccaatattcagcatttctttaattctgcctttttgtaatgttagttttttctgtgtacagtacacctctcctccaggttgcaactgcttgaaggcaagggttatcctttttcctatattctaacctttgtattagttctctaggctgccataaaaaagcaccacaaactgggaggctgaaaacaacagaaatttactgtctagaggccacaagtcccaaattaaggtgtgggcagggtcacactcccttctaaacctctgggcagcgcccttccttgcctccgcagcttctgggagccccaggcgtcccttggttttgtggcagcaacactctgatgtctgcctctgtgttcacatggccatctcccctcatgtgtctatgtctctttgtctcttttcctcctataaggacactagtcatatgggattcagggcccactctaatctagtatgatctcattttaatttgtttacatttgtaaagagccttttttttttatactttaagttctaggatacatgagcacaacatgcaggtttgttacatatgtgtacatgtgccatgttggtgtgctgcacccattaactcatcatttacattaggtatatctcctaatgctatccctccccccaccccatgacaggccccggtgtgtgatgttcccctccctgtgtccaagtgttctcattgttcaattcccacctatgagtaagaacatgcggtgtttggttttctgtccttgcgatcgtttgctgagaatgatggtttccagcttcatccatgtccctacaaaggacctgaactcatccttttatggctgcatagtattccatggtgaatgtgtgccacatttttcttagtccagtctatcattgatgggcatttcggttggttccaagtctttgctattgtgaatagtgctgcaataaacatacatgtgcatgtgtctttatagcagcatgatttataatcctttgggtatatacccagtaatgggatggctgggtcaaatggtatttctagtttcatatccttgaggaatcaccacattgtcttccacaatggttgaactagtttacagtcccaacaacagtgtaaaagtgttgctatttctccacatcctctccagcacctgttgtttcctgactttttaatgattgccattctaactggtgtgagatgctatctcattgtggttttgatttgcatttctctgatggccagcgatgatgagcattttttcatgtgtcttttggctgcataaatgtcttcttttgagaagtgtctgttcatatccttcgcccactttttgatggggttgtttgattttttcttgtaaatttgtttaagttctttgtagtttctggatattagccctttgtcagatgggtagattgcaaaaattttctcccattctgtaggttgcctgttcactctgatggtagtttcttttgctgtgcagaagctctttagtttaattagatccaatttgtcaattttgtcttttgttgccattgcttttggtgttttagacgtaaagtccttgcccatgcctatgtcctgaatagtattgcctaggttttcttctagggtttttatggttttaggtctgacatttaagtctttaatccatcttgaattaatttttgtcagtttcagctttctacatatggctagccagttttcccagcaccatttattaaattgggaatcctttccccattgcttgtttttgtcaggtttgtcaaagatcagatggttgtagatgtgtggtattatttctgagggctctgttctgttccattggtctatatctctgttttggtaccagtgccatgctcttttggttactgtagccttgtagtatagtttgacgtcagctagcatgatgcttccagctttgttcttttggcttaggattgtcttggcagtgcaggcttgtaaagagcctatttctaaataagatcccactcataggtattgggggcgagaaatccaacatatctttttggggcacagtttaacccatatcacctctacatttccactttgttcttttgctaccaaaacaccacgggtttggtctaggtcctgctcctcacctttacagaaagccaatcactgagatgacaaatattgccggggaagaaagctttaatcgggtgctgcagccaaggagatgggagctgaatctcaaatccatctcgctgactgactaaaaccaggggtttatacagcaggaaagaaatgtaacaatgtgtaagaaaacaggaactaggggctgggcatggtggctcacgcctgtaatcccagcactttgggaggccaaggtgggtggatcacgaggtcaggagatcgagaccatcctggctaacatggtgaaaccccgtctctactaaaaatacaaaaaattagccaggcgtggtggtgggcgtctgtagtcccagctactcgggaggctgaggcaggagaccgcgccactgcactccagcctgggcgacagagcgagactctgtctcaaaaaaaaaaaaaaaaaaaaaaaaaagaaaacaggaagtagggaggggcaaggaggcatctggtgcagtgatctgactagtttcagttctttgttactccctgaaggtcctttcctgagaaaggaactcagataaaacaaatacaagtttcaggctttaatagcagaagggtaaatttctatgtttattcaaaaacaacttgtctatgggactgttgggctggtttcactgtcatatgctatgctaaatatgaataatatttgaagactaaataaatgaacacctcatttgttttgttttcaggatctgaagcttgttggaattagtcaacctaaatatgcagcagaactggctgagaatagaggaaagaatcgctataataatgttctgccctgtaagttattttatctacagcatcttctctgtgttccatcagtggccatcacatctctaagtgtagaggggagggaatcagtgatcctaagtaaccacttccacaaccattcattagtcacctacttccacaaccatccattattcacctactatgtgctaagcactatatttaggtgcattctcttaaatcctcacaacagccttatgaagtaggtagtagaatatttgttttgcagatgaggaaaatgcacagagtggttaggtgatctttccaaggttacacaggtagtgacgggaaaactcggctttgtactaggtctgtctgtctcagtaagggaaaaggccagagtctgtgttcttaacccctctgtctcacaactatttatttcagttctataattctggaatgaaagtgagcagagggagacggggagtcacactctctgtgtccagacacatgggctgagtgaattccacagctaagtatgacttatatttagctcatttcctgtttttgagaattaacaatgtctgcatcttagtcaacaggattacagcaaattgagtttaaaataagaattatttattacatcaaaccattagatgaaatgtaaataattctccattgaaagttccttgtaatctctcttttgggtggggattagggcacagagaggagcataagcagattgtagccatgttctgatggagctgaaattgatagactttgcagataatttttacatcaggacgtcatcatctttattcgaagccgtgtttttcattcctggactaaaacattaagttctttttaaattcagcattttctagttcttgggttctttctctccatttatttccttgtacttgacaaggagtattggcccatgttctgagggaaatgcttttaaaactaggctgggggtattgcccttgtaagggtaatttgggattattggcccctttttgtgaatgtctgtggagattctcagatctggagtgggagctgggaagtgggtgtttgggtattgttcttattgggaagcctttaggctgagactcaggtcagtactagacttagcattgttatgttattttgtccagaggagggtgaggtagtacaatcagagacggggaaactgaggtggtgctgcttctggctcagcctgacacttgcagttctaaggttattatttcatctcttaagttgggcaagtttgtgtgtatgcttttgagatgacaataatatttataaaacataattctgtgttttagaccctcctactcatagtagtcttatacattcaatttatacttgaacttggtactctgtttttataacaacttgtttatatgagaatagaggcagagtagaatggttaacctagggacctaccccgtcctagtggaaggggcactagatttgaattttgactgcccctcaccagatatatgaacttggagaagtcacttaatctctgtaaccctcagtttcctcatctgtgaaacagggcagtggcttgtagggtggttttgaggagtaaataaaattgtttagcatattccctcatggtagacacctgaggatgctaatagtaacaggttcattttatgtgagaaggcatctggtgtggttaagatcttgggtcctggtgtcaggctgcaggttcaaatcctggccctgccactcattagctctgctctggtgatcatgtgacttctctgtgccacggtcatatagagtgaccatgaggattaaatgaggtggtctatatgaaatgccacactgtgcatcttcaaagacacaagtcccagttttgccattttgaatttcatttttttttctgttttgtgtccaactttactaaaacatttgcttataatggggaccttttttcttttaatgtcacagatgatatttcccgtgtcaaactttcggtccagacccattcaacggatgactacatcaatgccaactacatgcctgtaagttgggggacggtctcacagcactggactgtttcgatgaaatcttcagtgtgctttgcttctttctgtttctttgaggttgactatgtgctgtttcccatttttagggctaccactccaagaaagattttattgccacacaaggacctttaccgaacactttgaaagatttttggcgtatggtttgggagaaaaatgtatatgccatcattatgttgactaaatgtgttgaacagggaagagtaagtatcttttttagtttttaaaatttaaaattacattaattgctttttattgtggcagaagggtatcttaaaaaccatttgtttctttaaaaaaactcaaacattagcactttattcttataaacttgttttctgtctttttttccccataagagaaatgtttaaaaacattctttaaacaattctattttgtcattatcttttttttggacaaatatcagtgtcttctgtttattacgttgctgctggagttagtaaatagcaaaatctcccaggcctagtgcaagatgctgttcacggtgtggctctgttcttcattggccccatgaacacggacaagcccatcatgtctctaagcaaccggtgtcttcatctgtgagatgagggttttcatcagctccatgattttcaaatttaggttgagcactgaacccctcctgcctccaccccagggttttttttttttttttttttttttttttttttttttgagacagggtctcctctgtcagccagcctggagtgcagtggtgcgatcatggctcactacagctttgaattcctgggctccctcccacttcagcctcctgtgtagctgggactacaggcgtgcaccacatgcctggataattttttttatttttagtggaggcaaggtctcactgtgttgcccaggctggtgtcaaactcctgacctcaagtgatcctgcttccttggcctcccaaagtgttgggatttcaggcgtgagccatcacacctggcctggaaccatttctttaagcaaaatctcagacttatccctggataagcctcagcagcctcctctctcctgcaacgtcctgaaatccctcttctgcttccatcaaagataagattttttttttttagatggagtctcactctgtcgccaggctggagtgccgtggtgtgatcttggcttttgcaacctccgactccctggttcaagcgattctcctgcctcagcctcccaagtagctgggattacaggcaggcgccaccatgcccagctactttttgtatttttagtagagacagggtttcactatgttggccaggatggtctcaatctcctgaccttgtggtccacctgccttggcctcccaaagtgctggattgcagatgtgagccaccgcccctggccaatattttttatagtaataaaattctgcatttccatgaattgatgtgaagagaactgaaaaacacatgctaatctaaaaaaatgctgtgccttaggaatgggacttaatgttgctttatgagttgtttttaagtgtaggttcattgcttgaggaataggattcgattccttaagccagtggatctcaaactttagcatccatcagcatcaccaggagggtggttctaccctcagagtttctaattcggaattgcgtttctgccagtttctgggtgattctactgctgtggcaccagggtgcacacttggagtggtactgtccccaggatagtgggagcccttcaggcatcatttcttttattgttctttaattcatggtaagctagcagatgtttatccagcccctggtatatgtaagatcctgtgctaggggctgaggatggaggagggaaagataacagagcagtaagagatgacgcccatcctcatgttgcttgtgatagagggtgggctccttaccctcttgttgaatcaggagaataggctgtaatagaaataaaagcgtttttaaaatgaatgctgataggctgggtgcagtggcttacagctgtaatcccagcactttggaaggccatggtgggcagaccacctgaggtcaggagtttgagaccagcctggccaacatggcgaaacccatctctactaaaaacacaaaaattagccaggcgtggtggtgcatgcctgtaatcccagctacttgggaggctgaggcaggagaatggcctgaacccaggaggcggaggttgcagtgagccaagattgcaccactgcactccagcctaggcaacagagcaagactctgtctcaaaacaaaacaaaacaaaaaaagaagaatgcaaataagctttttaatactgttgagcccagggccttatacatgaaacattcttataaatctatctgttagacaaacaaaaatgacataattacattaatggagaacatgaagatgaatttaaatggtcttttgttcatctaaaatcaagattgaagttagtcttagtgaccctgggtgaatggggaagggagtgtattttctgcactagattctccatatatgttattttttttctgtaacaaccctgtgaggtattatgatttcatagatgaggtaactgaggcttggggagtttaagaacttgcccacaaggtaggaacaaaaatatacctggtaagaggctgagctgggaatcaactccatgtcagtgtgtatccagatcctgggttgtttctttggaacctgggtctttaaagaaatacagatcccgcagccagagtcagaatctctggaggtagaacccaggcatctctttttaaacaaaacaaggccaggcacagaggctcaggcatgtaatctcagcactttgggaggccaaggtgagaggatcacttgaggccaggagttcaagaacagcctgggcaacatagtgagacccccatctctacaaaaatacaaaatagctgggtgtggtggcacgtctctgtagtccaaactcctctggaagctgaggtgggaggatcacttgagcctgagaggttgaggctgcagtgagccgtgatcgtgccattgtaccccagcttgtatgacagagtgagactgtctcaaacaaacacacaaacaaaaaacagaaaacaaaacccaaaacaactcaaacttctcaggtgagtcagataatcaattagctttgaaaactaccagcagtagagcacaccttagaatactgagtgtgtgtgcgtgtgtgtgtatgtggggtgtgtgtgtgtgtgtgtatgtggggtgtgtgtgtgtgtgtgtgtgtgtgtgtgtgtgtgtgtggtcatttgccaaatgggtattcagatattcttggagagcaggtgtttcctggttatttctgttcacatctgcccaccaactttatagaaatcaaagaccccagaatgatttaatttgattttctttattggtgtgtgtatttgtattgcaaccgatgtatatctgaaagccttgggaaaaagtcctcatttcttccagctgtctggggttatgggagaagatgaggtcagtgaacagttgtggtggctactctaggggcaaagggagctggatggggactgtgtcctaggtcaagggacagctgctgctctgctctaaatcaattttcatgctgaaagcagggcctgttgtaggcagatctgatttttaaagagaaaataagtctggatttttatgagaaattttaagagttggcaagaattgtaaattaaaaaaagaaaaaacaattccaacaggtgctgtggtgtgcccatagacccagctacttgggaggctgaggcatgaggattgcttgagtgcaggaattggaggtggtagtgtgctatgatctcatttgtgaatagccaccacactccagcctgggcagcatagtgagaccctgtctctataaaataaaataaaaaaattcgaagggtcaaacaaaacccaactagaaggtctgattccatctctgatgccagttttcaatagccagtctcccttgtgaggttttagtgatggcagatggcatgatctgagtcttcttataaaaatgcaattttgttctagaccaaatgtgaggagtattggccctccaagcaggctcaggactatggagacataactgtggcaatgacatcagaaattgttcttccggaatggaccatcagagatttcacagtgaaaaatgtaagtaagaagtcaggatcagttgagctcatgtaattaccatatgttaatttgggggtgatatgttttaggttgatattaactaatatgttttcctatgcagtgagaaatgttttgctgctttcctttcagaacagaacaatccatatgcatgtatactccaaggcaaccccttgacttttctgggaaatttactttcttgggaataacctaagttatttctgaataaaatgaatcttaagagcatggctctacatcaggaactctttcctttctttccacttccaggtgacttgctcatagattttacagaacaaactgtagccttttggattatttggttagaaatatggcatcaggagcggccacttgctgttaggagtaattgataacagttacattaataggattccagggcatatgcacatggccttccttcccctcaaaatttacaaaagcaaatccaattaaattgtgcaggcattctaggaagtcaagtttatgtgctttttttctttttcaaggatgctttgaaaatagaggcagtgccatgaagcagcattggtatctgttgatgggtgtgtgcattggcataactctctgctgtttatatcacaggcctaaacattaggcatgtgctggcttgaagtctgagactatcctaaggaaataatctgaaatgcaaccaaaggcttattcagaaagacgagtctcagcattatttataatagaggaaaactttggaaaccatgcagacatggttttgtagcttttgtagcttttgcagaatggataacttaactatgactcgtctgcttataatatcattattcagctattagaaatgatggcccaggtgcggtgattctaacctgtgaggctaaggtgggaggatcgcttgagctcaggtttgagaccagcttgggcaacatgctgaaactccacctctacaaaaacaaaaccaaaccaaacccaaaaattagccaggcatgctggtatacacctgtagtcccagctacttggaaggctgaggtaggaggatggcttgagcccaggaggtcgaggctgcagtgaaccgagattgtgccactgctgcactctagcctgggtgacaaagcaagacccggtctcaaaaaaaaaaaaaaaaaagataaataagggatgggtagactatataattaccatggggacatggtaggatgtaatgtaagagaaacattctaggagatgaaaatgtatgcatattatgaatagtgcataaaaggaaagccgggaagtatagattcactggagttgaatcttgaatcttttgggtgggttttgggggttgatgggttagggtctagtttatgagattatccttgaagattccacaagtcatggataaagtatagtatattaagtagtaattctttactaattgctgtgtctcaaagggtctggcctcaatatttcagttcctcctctggagatgccatcaaagctgttaccatgatctggccacctaaataatgcagctcacagtagtagaaaaatgtcatgcttatttcttttcttttcttttcttttttttctttttttgagatggagtctctctctgtcatccaggctggagtgcagtagcacaatctcagctcactgcaacctctgcctctcgggtccaagtgattctcctgcctcagcctcctgagtagctgggactacaggcacctgccaccatgcccagctaattttttttgtatttttaatagagatggggtgtcaccatattggccaggctggtcttgaacacctgaccttgtgatccacctgctcggcctccaaaagtgttaggattacaggtgggagtcactgtgcccggcctgtcatgcttatttctatagattttgctcatttgaactgactggcttctccttggttgcctccactgcttggggcttaccttgtggaggggaatttaggatggagttgtccacatcatttttaaaaattgctgttactatgattattattttttattaactaaactccagactttattcagatttcatgtttttccactaaagccttgttttgttcctggctctgatccaggacaccacatggcatttagtaccatgttattttttaattatacaaaatgcctgaatacattttcctttagaaaatcgagaaattacaaacagagctaaagatttcctttgactaccacccctaacctgagcccctttgcccctccacgaagataatactaagtataaccctcctcacttctccctcttcctctccccctccttctccccttgcccgctcccactccctttcctctccctcctccctctccctcctccctctccctccctttttcttcctcttcccccacctccatctctcacagctggtttctgtctttggatcagtacttctggttaaatgtgtgaatgttaactttatctgtgatgaggtcttctagcacctctcccttcactctgtctgtttttcctgttttccaaattttgaatactgcacattcttatcatgaatatacatttcaaaaaatgagtgtcaaagggcagctgtcataatggagatggaaatgcctgcagtgcagatgtaggtcacatgggtacggatgtaggtcacatgggtatggtcattccctggtatgggcataacgagtacagctgagtcagggacaggactcgccccagctggggtgggcttctggtgcttcaaggtatatgctttggtatgaggtagggaaccagtctgtgtaataatgagctctattgtctttcagatgttgaaatggatggttttttgggggagtcctttctcagctctctccaattctaaatatttgcatggtgcttgctagtggcctgtcactttattcacttctctaggggacatagtgaattatgaggccattcttgcctagaaggcactgattatcatggtgtatttgagtaaattatttttggttttattgtcagtgacattcccaggggggctcggggatggggctcatgcagctctaaggaggtgcaggtgtaagaatgtgagttcattattgataggcagctgtggcaggaagggaaggatctgaatgcagaattggaggatgagggacttctgttgcatctgaaatcagtgttggggaaatgacttcacttctgtgaatctctgctgcctcatctttaaagggggataataaactctccttcttgagcatattgtgagggtttgatgagcaagcactttatcagctgctgtgcaaatgtaaagtttaatttttagtcattacaactcctggttagtactcaggctctgcttgatttcccctgcctttttgatgttgttaggcagcctttctgtctggatctaaatcattttctgggcttttagatccagacaagtgagagtcaccctctgagacagttccatttcacctcctggccagaccacggtgttcccgacaccactgacctgctcatcaacttccggtacctcgttcgtgactacatgaagcagagtcctcccgaatcgccgattctggtgcattgcaggtacgcagatggcacgtcacgtgtgacagatttcaaatgtcattatatatttatgagcactttacaaaagcaaagcctaagagggaatgtaataggcatttatgaattcaggaaaggtttggataaggaaccatggacttactccctaagccctgagcttccaaaacaggggttggcaaactgtaacccatggatcaaatctggtcagctgctgtttttgtaaataacattttctaggaacacagcatgcccatttatttatatattgtttatggttgcttttctgctacagtgacagaaagagaccatatggtttgcaaagcttaagatgttaactatctggccctttactgaaaaagtttgccaacccctaacaataagaagttagctttgaagctaaaggaattaatttaggacagaagacaggaggggctctgttgcccagtggggaaaaaatggctaaaatgtgccgccatcctgggttatgggcaacttgaatggaactgagattgaagaagcttgagcaaagggttatatgtgtggcatctgactcaaatgtgagtttgggacttaggccccagtcccaagctagtgctgtctgacttgctgaggcttcaactgagcaaatgtgtactgatcctgtgcattgccctcaaagtgtgacagtgaaggaaagcaagatatatgtacaaatgaggaactctaagagggttgcagtcgagggaacccactgtaataggcttatttctcttttctctcagtgctggggtcggaaggacgggcactttcattgccattgatcgtctcatctaccagatagagaatgagaacaccgtggatgtgtatgggattgtgtatgaccttcgaatgcataggcctttaatggtgcagacagaggtgaggccaagatctgtatttgacattccacccttcccctccattttttttttttttttttttttttttgagacggagtcttgctctgtcgcccaggctggagtgcagtggcatgatcttggctcactgcaacctctgcctcctgggttcaagtgattctcctgcctctgcctcccaagtagctgggattacaggcacgcacaccatgcccagctaatttttgtaattttagtagagacggtgtttctccatgttggccaggctggtctcgaactcctgacctcaagtgatctgcctgcctcagtgtcccgaagtgctgggattacaggcatgagccactttgcctggcccttcccctccatttttaaaaggttgcattgtgtcatgcacttgtgttaaaatatgtcacccttccagatctttccagctcttggctgtgaactaacactggatttctttgcagactttaagctgacttggaattaaattacccaatacaagtgacatagtagtactgatgtcagtaatggaactactactgagatagtgtcaggattctttaccttgctgcctctgactcattaaataatcttaggacatctttgaactttggcttccaggttttaaactcataaaactggtattttccagtctttgtttctaagaaggtctgaccatctttaaaataagctaatgaaacaaactcatcaaacattaatgatgtgacatatcataatgctgcttaaatgttaatacagcaatttatcctcacccagacttgtacattttaaagactatcaattatcatagctacagaagggtggctgaccagcggagaaaaggaacacttaatatctatggtatagtttctgtactactgctggatttggttttacccaaactgttactgagaagtgtttttgaggcatgttttcaacagaacatattgcaaagttgctttcctcaaaggggtgaatgttccttgaccaggatgagagcagaatattaattttgtatcaggctatcgtcctgtaccgatttagaactctatgaatatgtgctgtgtttttgagtctagcagggaatgttctagatgcctgggtacattgcgtgctctggggtgagcttggtggttgttgtggaaagagtgaaattcaactcctgtgttggtcaaaagagagattttcttttttctgctataattatataaagtagtatttctcaatcttttatccttttttgagaaacatagaactcttatccctgctactagagtctaatctcttttttatattttgaaaacaatacttattcatatgaaagcatttgacaatatatttttctctcctcttttttttttttttgagacggagacttgctctgtcaccgggctggattgcagtggtgcgatctcggctcactgcaacctctgcctcctgggttcaagcgattcccctgcctcagcctcccaagtagctgggactacaggcgtgtgccaccatgcccagctaattttttttttgtattttagtagagatggggtttcaccatgttggccaggatggtctcgatctcctgacctcatgatccgcccgcctcggcctcccaaattgctgggattacaggtgtgagccaccgtgcctggcctcaatatatttttctcttactcttccttccccaatcctgcttcctggaggtagccaatgtttatagtttggtgtacatctttataagactctttatgtacatctgtaaacacacacacacacacacgcacacacagtactttgaaaaaattggatgctgttttttttttgagatggagtcttgctctgttgcccaggctggagtgcagtggtgccatctcagctcactgaaacctcaacctcctgggttccagcgattctcctgcctcagcctcctgagtagctgggattacaggtgtgtgccaccacgcccagcaaatttttgtatttttagtagagacggggtttcaccatgttggccaggctgatctcgcactcctaacctgagccgatctacctgtcttggcctccccaaagtgctgggattacagacaggagccaccgcgcctggccagatcctgttttatgtatgttgcttctctgtgattttttttctcctcttataatatcatggatatttttctgtgtcagcttatacccttgtttcctcttttcttcatcactatccacagattctgatatacctacctgaaggatagtcctcatccagctccacctgatcatctccttttaacctcgctcctcggttgagcattacagttgattcttactctgtacagtctcactagccaaggcaatcttgttggacatttgattgttcgaatgtgtgtgtgcattttttcctctacatttcctccttcctttgcccttccctgagactgtggcatttttccttggggaggggaggtgtggagtgtgctcttctggttgagaatcattgaggaaggacatcttgcttctgtgatttcagatttcactgcaatgttgttacctcttgaaacatgttcgcttgaaccgtttgctgttgggtggatggggtttgggagttgggcgggggaatgacctgtttgaaaataattttgggtgctaatttctgggacccatgttcattttctgtctctctctttcgtttttctatcaggaccagtatgttttcctcaatcagtgtgttttggatattgtcagatcccagaaagactcaaaagtagatcttatctaccagaacacaactgcaatgacaatctatgaaaaccttgcgcccgtgaccacatttggaaagaccaatggttacatcgcctaattccaaaggaataacctttctggagtgaaccagaccgtcgcacccacagcgaaggcacatgccccgatgtcgacatgtttttatatgtctaatatcttaattctttgttctgttttgtgagaactaattttgagggcatgaagctgcatatgatagatgacaaattggggctgtcgggggctgtggatgggtggggagcaaatcatctgcattcctgatgaccaatgggatgaggtcactttttttttttttcccccttgaggattgtggaaaaccaggaaaagggagctatgatttttttttccaaaacaatttcttttttaaaaaagactattttatatgattcacatgctaaagccaggattgtgttgggttgaatatattttaagtatcagaggtctatttttacctactgtgtcttggaatctagccgatggaaaatacctaattgtggatgatgattgcgcagggaggggtacgtggcacctcttccgaatgggttttctatttgaacatgtgccttttctgaattatgcttccacaggcaaaactcagtagagatctatatttttgtactgaatctcataattggaatatacggaatatttaaacagtagcttagcatcagaggtttgcttcctcagtaacatttctgttctcatttgatcaggggaggcctctttgccccgactccgcttcccctgccccctgtacatttgtgctccattttttcttcccttttccctcccagttttctccaaagactcttctgttggcaacattttcaacccattggttgggtgagaatggcgactcaaatatcaccttgagaatttctgtgggtgggaatgggagaagcagaggaatcctacagtggcagaaatccttttcttgtccctgtattatcctttttctcatgtctgtatttggtatgaaggattatttaaaggtgcaatatgtgaattagtgattcatgatgttctaggtttttagtaacgttttactcaggttggcattttatgtgtctgtgtctgtatgtgtgtgtgtatgttcagaagcgtggcaatctgtgaacacttcagcgtgaattcagtgtcagattaatccctccttccccaaagtccactggctttcgtctctctctgccgtgacacatatcggaatctactgtgtatatatatatatatatatatatatatatatatatatatatatatatacactaagctctcaaaaacagtcattcctatgaattgaggtgtacaaagtttgaatttgtatcaaagatgtaattattatttttaaaaccttttcactatactgctgctgtaattactttgatttttaaaatgtagattaatttttttttttttgcttcaggtgtgtatccaccaagaatttcaaatttatgtggatttattttattggtacataatctgtaaacttcttaaggcattaacatgaaaagattttttctttttattttatattgtggctcaggttatattttgaagatgttttgagtttatcctccaataggcaatgaagttgacaaggttttatgaaggaataaccaagtccctggagtcctgtggctgttgccacagtaatgtgtcctgctgtaaacaggacaggtgtgtcctgttgagaatgtgagcgggctcttccagcctcctggtccctcctgactctgccacgcccctcacctcactggcacttcgataactgactggacgtgttaatgggtcttttagggttctaaagggtgaaccacacttttaaagccccggctgtggttcggagggttagtgctgtatgccttttatttccctttccctttgaggtactgaaaggatgaaaaggtggtgtcatgttttggggagaatcttacttctcaaatggaaattgcactttttgctgaatcctttgcatttttttggtagtaagcagttcattgagtatcaggtcctcaaaggaatgagttggcccggctagggtgggccctcttgacctaacttcagagggggccttggctcagtaggtgtgaatcagggaagccacattgtcctcagggtgctgtatgaagctgggtgtgggcggattcctcccacaccttcacactggcctgcctccaactcatacagatctcggagcggtcggtacttcattcataggtccctgttcaggcagcagttctgtgggctgtggccctctcccctccaatatgtccgaaaccattgtgatgggtggcaaatcccagggagctcctaagccctgctctgcccacatcactgccacagagaagtcagaggaagggacttgttgctaaaaaatcctttaaaaggttaaatactttaaaagattaaagcaacataactgtaaacatattgtataaaaatgaaaaacacaggaaccctcttcccttccgcctggtgtgggcttgggaaatgggcaagcggccccagcaatcatgggaggaactcttgcgggggagcggtctgggattccaaatgggcaggtcacacgaaggtcacgatgcttctctgcatcctgaaaagggctggggacagggccagtgggggtggtaagggtatttatagcacagtgcttgaaaagggaagattaatgtgtaaatataaaggacacacaggctgggggttggtcagaggcaagaggagggtgcctctgagcttcaacccctcccaggaacaatgagctcaaattggaagagtccagtggaatcggggggatggtgtgagcacccctgttcagtctttgacaattgcatacagaaaagcagctggtatgggtttgggtgtcaatgaaagggccaaagactggtggccagctggtttgggggatttgggccattgatagcatctcccaggaacaacgactttttgcctccaaagttggatctagtgatgatcagcaccagcaggaaatgacatttggtgtctgcccactgcagccatactgtgacctccagccagacttccgcctaattgactccactggatttgtgctctgttgagtcagaggctcccgggggttggggatcgaggggcgggggtcagctatgcagcccatcacgtgtgtttttcatctgggatgaaaaagcctggttctcttttgaaatgcttgattgtacttattgagctaaacaagtcttggtgactgttgttgatttgcctcaaaagttttaagtcctgggttttcagactactgtgtagcagctgtgtgtttaacatactgtagctttttctcccttgggggcacatacaaataggatgtgttgatgtggactctaaactgtaattttcctgtaactattttggaatgatgcatatttctaatgtttgttatacttgtacagagtattgctgttggttgctttttttttttttaaggaaaaaatggcctgaaaacatttttttaaagacttacaaataccaaatataaaaaaatgtcaatgcattatgcctttgcttctttctttcttcttttttccttcttacaatgtgccaagcagtttactggcctgcattttacttgggcatccttaacaaaaacacatttctctttgggatttccggattgttttagttttctagggctgttgtaacaagtaccaccaactggtggtttaaacagcagagatttacttcctacaattttggtggctgaaatccagatgtgggcagggttggtttcctgtgaggccttttttttttttctttttttgagacagagtctcactctgttgctcagagtggagtgcagaggcgtgatctcagctcactgcaacctctgcctcctgggttcaagcagttctcctgccccagccttcaggcgcctctcttcgtagcttgcagatggctgtcttctccccatgcctccacatggtcttccctctgcttgtctgtgtcctaatctccttcttttttttttttttttgagatggagccttgttctgtcgcccaggctggagtgcagtggcatgatcttggctcactgcaacctctgcttctcgggctcaagcgattctcctgcctcaacctcccgagtagttgggactacaggtgcctgccaccacacccagctaatttttttgtatttttaatagagacagggtttcaccatgttggtcaggctggtgtcgaactcctgacctcgtgatccacccgccttgtcctcccaaagtgctgggattacaggcgtgagccaccgctcccggctaatcttataaggacacgagtcatactggatcagggcccaccctattgacctaattttaccttaattacctcttcaaagacactccaaatgtagtcaaattctgttttagtgggggttaggacttgaccatatgagttttggaagggacccagttcagcctgtaacacatattcagggcaatttagtgaagaggaggcttggaggaagtggctgtgtgtcttaagattgtgtgtgttcccagaaggttggaggtatgagcctgcaggtggatggatacccagttggttgggggtgtgttatgatatagttagctctcctgggctttctgcttagggacagcgcttgggctgcggataaagtatccatcatcttcctgttttgattcaggccaaagttgtcccagaacttttctgcccacagtgttggtttagaggaggcagggagacactgtattgctgacctgttatctgcatacttaaaaaaaaaacaaaccaaactaggctaccctgcaaaatagcacagcattctctgctcctagcacttagtttgataaaaactaccttacccaggtatagcctaggaattgagatattgtgggaaagaaaaaccgaatgatcacctgtggttttataaaatgtaaagcttaagtgagaaaacaaattcatagaactataaacagagaacaatcccaataagaattaaataagtgcatagaagaaaagaaacacaactctagaataatataatagtgggattaggagtggattttatttttatattcacctgtttatagtttctaacttctcccaatgaatatggagtacttaagagtaactagtttaaaacttagcacttttccctccttgcctcaaaaaagtgaagctacagtatagttttaaatttactagtcaagttacaaaattctttttttttttttttttttttttttggagacagagtctcgctctgtcacccaggctggagtgcagtggcacgatcttggctcactgcaagctccgcctcccaggttcacgccattctcctgcctcagcctccctagtagctgggattacaggcgcccgccaccatgcccggctaatttttttgtatttttagtagagatggggtttcaccgtgttagccaggatggtctccatctcctgaccttgtgatccgcccgcctcggcctcccaaagtgctgggattacaggcgtgagccacgacgcccggccaagcttccaagttctgatagccatcccatcccttctggggtttcacagctctatttggggctgaacgtggcagatctctggggcctccaacatgagagcctgggctttacattcctgcaggcaggtgaagcctcctgacccaaaaggtgagtagtgggcccctgttggggccagcagttttggatgatgccactagatggcggcagagaactgggctgtggaagcaatccttggctaggctgtggcagggcagtggagcacataggattggaaaagaaaccaggaggtccgtaaggcaaggctaaaaaccagcaacagggcgaaggaagcgcccttgccagcagctggcagctttccgtataatttgttagataatatgttcatggtaaaaaaatttaggaaaagaaggaaaataaaaaaatcctatgttgtcaccattcaacaagatgtcccccaataatcctcccgcctggtattcacatttttgtgtagcccctcctccactgtagcagggttggtctgtgtgactggtagattgcagagaggtgatggcatcccacttctgagataaaactgtgcagtttctctctcgctgtctctctccctccagcccccctcccacggcactctctccaaaaccagctggcatgttctgagcagccttgagagaggcccacgtggtgggcttcttctgaacctcctgccaacagctacatgagtgggcctggaagcagattctcaggtcagcctttggatgacagtagccctggccgacagcttgactgcagcctcctgggagaccccaagccagaacctacccagactccctgacttgcagaaagcatctgagatgataaatgtttactgtttcaaactgctctgttttgggataatttgttacacagcaagagataactaatatgggctaatatatcccaccacataggaaataccactgttaacattttactgtaaataattctgtaacctttagaattctcacaaacaccacacacacacaccccccatatgtgcacacatgcatacatcttcatcttcatgtatttgctttcatctttttgcaaaactggaatcaaacatgttcatatttctttttaagattaacatatttctttgagtaatatttctactgaagcgtaatacagacagaaaaatgcactaatcataggttggctgtttgaataattgtccaaaaatgaacacacccatataaccagcacccaaattaaaaagtatatacgaccagcatgccataagccaccttggtgccccctttcagccacaccctggcaaagctaaccactatcctggctgctaaccttttaagttggttctgtgctcaattttttgaaacttgcttcttttttaaaattaaaaatttttatttttagagacgaggtctcactctgtcatgcaggctgcagtgcagtggcactgtaatggctcaccgtagcctcagactcctggactcaagtgatcctctcacctcagcctcctgagtagctgggactacaggtgcgtgccaccacacctggctaatgaaacttgctttttttttttttgagacagagtttcgctcttgtcacccaggctggagtgcgatggtatgatcttggctcactgcaacctctgccttccgggttcaagcaattcttctgtctcagcctcccaagtacctgggactataggcatgtgccaccatgcctggctaatttttttgtatttttagcaaagacagcgtttcactgtgttggccatgctggtcttgaactcttgacctcaggtgatccgcccacctcagcctcccaaagtgttgggattacaggcctgagccaccgtgcctggctgaaacttgctttttatacttgacatattgtgaactctttctgtgttattaggtattcatcctgttcaccattttaagagctgcataatactccatagtatggacacataccactctcgagttaactactcttttattgattgccattagattatttctgattttactctcctgtgaataaggatgtggcatctatcacagtagccagatctttgcagacatcacaattaatttcttagtaaacttttctataaaattaatgaatcgaaatatataaaaaggtagggctttaggctggtcgtggtggctgatgcctgtaattccagcactttgggaggccaaggcaggtggattgcctgagctcaggagtttgagaccagcctgggcaacaaggcaaaacgtcatctctaccaaaaaatacaaaaaattagccgagtgtggtggcacatgcatgttgtcccagttgcttgggaggctgaagtgggggggatcacttgagcctgggaggcaggttgtgccaagattgtgtcactgcactctaacttgggtgacagagtgagatcctatctcaaaaaagaaaaaaaggtaacgcttagatgaaattctgctaaatttttctctagatagcaatttacactctcattatagtgtgtgagaatgcctgtttctttacagcttcatccacaatgaacattataataatgaacaccccgcccccctccttttgtaacttgaataggcaaatgaaaaagaagcaaactgtgctaggcctttcttggattgctgtaaagaaacaccacctgagactgtttaattgataaagaaaagaggttttagtttggctcatggctctgcaggctatacaggaagtgtggtgctggcatctgcttctagtgagggcctcaggaagctacaatcacggaggagggtgaccgggagccagcatgtcacatggcaagggcaggagcaagaaagagagggtgacagatggggggacgtgtcacatgctattaaacaaccagatcttgcgtgaactcggagggaaaactcgcacttcaccaaggggatggctgtgagccattcacaagggattcgtccctatgattggagcacttcccaccaggccccatctccaacactgggaattatatttcttcctttttttttttctttgaggcggagtctccctcttttgcccagcctggagtgctgtggcgcgatctcggctcatcacaacctccgcctcctgggttcaagtgattctcttgcctcagcctcctgagtagctgggattacaggctcccactaccatgcccagctaatttttgtatttttagtagagatggggtttcaccgtgttggccaggctggcctcaaactcccgacctcaagtcatctgcccatcttggcctctcaaagtttgtgattacaggtgtgagccaccatgcccaggaggaattacatttcaacgtgaggtttggaggggacaaacatccaaacaatatcacaaactcaaaacttctgggagcctttatatggagttgggagcaccggttcgagtctcccacttagtgagggccacacatccaggatctaaggaattctgtcctgtgtttccacagctgcagtcttgggtgtgagaccaggtgtcatatcaggagaccaattttgttatgtcaaaattgcatgctcaggggtcatggttgtgtcttggacaacctgatccagactcataggccctgatgctgcagccttggcagtgtgagggtccttctgaggcatttcatgttccctgacatgggccatagactccctagatgggaagaatccgtgaaggccctttcaacaaatccactggtcctatccactccacctagcctggaggcttaattacttccagaacctttagagggagggagatggcatggctctttcttggaaagtctggaaggacaccatgggctagaggggacagacacatgcctcatgtggcctcacaggtcagcctaggacctgtgacagtgacagggagacaggtttggcttaacacaaggaagggccttttgaggagcaaactcccctgaggggtcagccctctcatgggagcagctcaggggagaaggctcagccttggctgctgggaaggcctctttcctggagcgtgactgatgactttgtgcctccctctgctctacctcctggtgtaatgttgttggtcctgggggcagtgagatggaaagaaggcatcagggaacaagatggatctgccctttgcatttgcttctgatggggagggggtcatctcagtcacttcatggtaaccagctgaagcaggagggtatctggggttgtggatgggacatggctgtgtcccaaccaccagcctgcctccactacattctgctcagaatccaccctccagccataataaaccacttacacatgatttctacacatgagattgttggatataaaatgctccaggaataaatgctcggtgcagcgaagtaaaaccagcactcaggcaaaagtttaattctctcagcaaggcaatttacttctgtagaagggtgtcacttgcatcagtaaaaatcacaagagcacagagaacaaaggagaccagggagtttttatccttaatgcagtccctatctctgtgtcactcccccatgggctggggtcagactgcaaaatctgagctgacccagttggctacttgtacatattttcctaaatatagaaggggagggggacgtgaggtacagaggtggaacgtgtgagatgtgcagtttcgggggaacaatgggtagaggtcaccaagggaacagatttattgattagagctaacggacatggggtaggctgtttatgctaactaggggcaaggaagaacaagaaagttgagtttgcgaacgagggataaggaagttaacaggctaaatcctttgaagagaaactcagaaagatttattgtatcttacaaggtatcttctttttgctcaaattcttgtatgcttccccctttccttggccaaactcagctttagtcattcctcactctagaaagccttctcttactcctttctatttagactgtgctaccatagaatctcacacatgaccttggggcccagctggctctcccgcatagagctgttgtcaacgttaagcgaaaagatagtgcctggaacatagtaagtaataagtaaatgtctgctactatttttatcatagcatttggaacacaggattgtaattgtggcttcacaattctgtggggcaggagctatttctcatttatccctggatacccggaggccagcacatggcctggcatctggatacacagtgtgtttgctgaatgcatgcacgcctgagtacatgactgcatggatggagcaggccttctccaccatag

SEQ ID NO: 1312 - DNA, 859038 bp, Homo sapiens
ggttgagaagaaaccaactatgcaaaagtattgttcctaggcagaaagaatgaaaaattagtgccaaagaaatggctaggtaatgttgataattgggaaagacaagtaggtggggtttgagctgggcctgctgggcggtactgaaggtcagttcactcaacccccattcccagtcccattctcccctgccttcctccactggagaggaaaatgaaggactaaacttcccccctccactgaagcaagcatgaccataggacatcattgtggctaatgagctgtaggaaaaaccctttgggaggccttcccttctggaataaaagccaaaggccactggaataagtcatttttgttccttgcctttcctctttcttctgtctggaatgccgaaggaggtacttacattttacatcccagagaatgaaactgacatgcaggaaatgtccaagcagggagacagaaggagcctagttccttcctggctttgtgatgtggctgcaccacctggactgcctacctctgattttttttttaatgtgagaaactaaatccgtttattggtttaaataatgacaacagcaaatgtttctagcactttctaggtagtttacatgaattcatatttaatcctcatatgaaccttaaacagtgactaccattgttatcccaatccttagataaggaagctgaggcatggaaaggttgaataatttacccaagtaactcagcaagtcgaaaggctggactttgagaacaggcagtgtgcccttaaccaatgttctaccccagtgttggccgggttttctgttatgcacagattatcagtcctaacttatacatctttgatggatgaatacaatttagttgggagcttttagatcattatctaactagatcagtgtagcatgtggtcagtggatggcaagttagacaacaatttgatggtgagtttatagtaggaaaagtgacaaagatggagatggaaaatagagcagaatgggtaagaaagggagctctggaaattagaatatttgcctacaaatcacagctctaccagttactactagctcagtgaccgtggcctaattatgctgccttatctttataacatttaagtctctagctttaagcctcagtctcctcatctctaaaatgggcatcaaaactgtacatgactttcagaggtttaatgccctagcaaaatgcttcgttcacagtaagagctcagtaaatgttaccttaaaaaacatactaagtttgaatgttttcctctacagcttgtctcatcttgacagtaatgactgtctagaaattgtcaattccaaccacaacatttggaaactttaaaatatcaaagatgaagagagactaaagatgatcttttctttgatgttagtattgaaatgtttttatttttttcatattctgttggaaacccagccttattacagatcacaggacctaggacaccattgttgcaataatttaatctgaggtaagaaagacattgttagcataacgtttcttaatagtattagtcaagctgagttttaagaaacatacctatcaacttcaaaggatttgttttaaagaaagtaaaataaaaaggaactacaaatccatgggaacatgataaagtactataatttccaccctgagttttggaaaatctgacgaacctccaaaatgtgttctgaggaaaacagttgtctcaaaggcacaagaactaatatgaaatgttagttcaaaggctctgggcaaaaagagggacacacagacagacgctctctcctttaatgaaccctcatgtggaaagtagctgctacttggtgagctgccgcctgtgcctttgaacatactatgattcaaacagtgaagtgttatttcacactctctgagttagccagcagatctctaaaacttcccagctcaaaaaagtttgcagaaaccattttcttctagtacttcttggagacttaaacaaaagtagagagactgtacagtgacctccagagggctctgataaaatcttcataaattggctttttgctttttctatagatgattaaccagcctgaaaaccattgccaatatgtgtgtgggcaagtggttactatgtctatacagtggctgcagccgctggtcttgtagatggaaccctgcttccagacaggaaaaagcctgatccgggctctcctgtccccaggggacagggcagttggactattctggtcagaagactgcttttgtgtagggagttgtttcccctagttcaggatgcaggagtgcaaggagagggtacagcgtgacctgttgccccaggtggcctcagtgtcaggcagccctggtgttctgcccgcacttggatcaaggaagtcaccaggagacctgggctgtccccagcagagtatacaaagcaactctcagaggggatctgactggtgccagggaccttccagcaggtcatttcctgggtctcctggttcctaggaacacaggctcagacatggctgtaatactcatattttctggtaccgtatattgagattgccttgtaagatctgccctgctactgatcccgtgactaaaaggagaatttttagagattatcaacctacctagtcattttacctaaaatagcgaataggtaaaagttccaatcagaaaaagatttttataaaaatatgacctatgtgtaaattgtgaactttaagtcctatttgataaaattaattaaaagagcttcatgagaaactctgttatagatcttagatcatccttattcatcaatcaaagtctagtaattgagggcccagtatactaccttccatgtgcataggctttccctgtttctaaagaactttcatgcacactgtcattggctcttctacaacacagtgaaggtagacagcacaggagttattcccattttgtagatggagaaatactaagggcctgtcatgataaaccaggcagttttactggtctggtgctgagtctggcagctgatattaactcattatgcccagaaagaagagtgtgatgagaaaggacaggaacatctattggaaagtcttcccatctaaatggtaactgggcccagttagatatttccaacccatctgcacacatatagaaccccagcatggagtttgtgcatggtcggttctctctagtatttaatttaaaaatcaatggttaacatcatcaacaacaacaacttttacatcactaatgatgtgccaggaactgatgtttttttttgagacaaggtattgctctgtcgcccaggctgaagtgcagtggtgcaatcatggctcactgtagctgtgactccagggctcaagtgatccttccacctcagccttcaaagtagctggaaccacaggtgtgtgccaccatgccccgctaattatttatttattttgtatagagacagggtctcactatgttgcccaggctggtcacaaactcctgggctcaagtgaccctcttgccttggcctctgaaagtgctgcaattatagacatgagccactgcacccagccaggaactactgttttattacaatacttatcacattattatttaatcctcacaacaactttgtgaagtgtggacaatgattatctttgttttacagataaggaaactgaaacacagagaggttaagtgaatttcccagtatcacacagtgtgagaggctgataacatcttcataacataaaaaagaatatgcaatacactgcctcagtaccaacaatgcagagattaatttatattctgagggtaatgtgagcaaagcaaagaactaaaacctattacctctctgcttttaatcaggccacgagaaggaattcctggggcatctaaaaaattcatcctagtagtttaagcctttatacaaaagtggctttgaactatgcttggatgagctttgccttttgtcagtgacaggttctgaccttaggtaggatacgaacagccacaaaaaagggcacctgctccctttttgtcatttgttcaggtgaaacagggcttcgctggtgacagttgaaatgacctggtttcttctgacccctgtgaaaaactaatgatgtgtttttcattttcattccattttccctggtttcatgtatacacattcaaaaggtgagggaagctgtgaagtgaagtcagtcctgggtgaaaagttctatttgctcctctcatgcctgaagctaagtaaagtcgacacaaatcgtgcgtgtgcacaaggacagggatctgcatatcacgtggccgaggccccactgctgtgcatgcctgcactgtcctctgagggaaagaataatgggggcgagatgggtggggagtgggatgaggcactactcactcccagctttgcttagagatcaacataataaataatcaagtttgctcagcgcctcagagtttacacagagctttcacatgtaattccatttctacaagtcaggaagtggaaatgaactcatttaactcacacagttggaattcaaatgaagttggactctagatagtgctagctctctcctttatcccttccttccttcttcccttcctttcatcctcctaccttctcttcctacaacttgccatccttgaatatgtcattttggaaatctatacaagaatgcttatttacatttcccatttctctcaaaccacactttcataatcccaacatgcatctaaaagtgggaagtaatcatttcagcaaggcctagataagaaaacatgagcaatggaaacaatgacaatcttttcttttccttttccatcggttacaattgagtgaccttgggaggtatccaaatgatcattttgtccatgcttcttggcaaatacttcagctagcttaggaacttgccgcacggggttaacctcctaattcgacataacgttttggataggtagggatgggttatggtcagatcagttttcattgttatatttacattttgactttaatggggtttggacaaatctcaagagcagagttgctattgccaggccccagcactgcacaagtacagccagcaattcggcccaccgactggcaggatgggctcctgccctgggcatcacacacctataaaaataaatttgttaaggaacatacagccacttctgtcagtagaggtctggtgctcagtgttaaagactgcataaaactttaccctaaacttttgctttcaaaaccaacaccgttcgggccccagagaaacacttctcccctatagtcccttgtccttgaaacaaaggtgagtgcatcccacaacctgaagatttgcagggtgtgctgctgctgacatggaagatggacactcctaaacgtgtggatgatgtatagtggaggcgcttgattcaaagaaaagtcaaatgaattaaactgtcaaaaccttccttttagatagcaagcatatcatacagtcttaaataatgagggtttcctagcaatgccaaacattcattttcttgcttctctttttgttacaattcatggttctggcagaagtcatacagcagtatagcatttgcatgcggttgaacgtggtgattggccaatattttgaaaaattaactaattaatgttactgttaaaatggtagatatgaagttataacacatgaaacataatactgattatttatgttagcaaccaggtggacaatgaatgctagaattgctaagtttatgttttatttacacattaataaggtgtaattaaatttccaaatattaaataaaatgtttatgctttaaaaaaataacttttcagtgtttatattcattgtcataatttgtattttgcattttaattctaatagataactttaaatcatttgaaagaaaacttttaacaactatagaaaaataattctaattttctgaaataaaaaaaggaatttacatttgtggtgtaagtacaaacattttgtatgatttgactacattaatcctttatttatttattttttagaattgggatttcattctttacccagacggagtgtagagtgcacagctcattgcaacctcaaactcctaggctcaaatgatcctccagcctcagcctcctgagtaggtgggactacagggataaaccaccatgtttgactatttaaaaaactgttttgtagtgacaggatcttgccatgttgtccaagctggtctagaaatcctggcctcaagtgatcctctggcctctgcctcttgagtcgctgggattacaggtgtgagccaccacatggggcctgaatagatgaatcttttagatcaatgttgttcaatagtgctttctatgatgatggacttgttttctctccatgttgtacaatacattagctctagccacatgaagctactgagcatttgaaatgtagctagtgtcactgaggaacagaacacctgaaatgctgttaggtgctaccatacagaacagcaaagctttcaatcaccgctgtcaatggaacacaaattaagtgaaaatctcaattataacaacacagtgattttactaaagagaaatatcaattttatagaataaatatatatgaatcatgtatattacttatccatatagcctatcaaagaaaatctagatatgtataatgtctagcagatatgcataattcagttgctgatattttgctttttgtcatataaaatctgtaggttttatatttcaattttattgttatatgtgtcaaggtaggaatatacatagtagtttgctagcttaattaataactttgaaatattaggcatatggtaagtggctatgcatttgtactcttgcccaagcctaccaatgtcaggggctggcctgacagcacccctaactctgagcagccattctgcaaatgtcactattgtcctcagtgagtcaggagtgaaatgtggttaaaactaaatctctactgctgaaaaaacaagtcaaagcaaatgtcccactgggaggattcctacagcatcccttccttagaggaagtccaatccattcatttcagcagaggacttccatttaggctcaaaggctgctctgaccagttacctgtaagagggagtaaactaacagtagttgtcatgaattgagagggcagaagctgctggcaaaaatcccaccaccctttgaaatgtggatggaaggctgcaaagggtagagtcaacttaacagtgtaaagatagagaacaggggtaatagaaatttacagaccctcccactaagctttaagtaacaggcagaagggacagggtttgtagaggttaccaagaggagtcctgtggcagcagcagttggagtactggcagggatttctgtctaatgcctcagtggcaggtccgtagagtggccctttcctcttccatccagctcctcatcgtccccccgcagggggattgagtttcccttgcccatagtggtaacctgcttattgacacatctcatatcgatgtctgcttttttttttcttctctgtcttgctgtctcaccttccttatagtgctttctgggatcacttccccaattcaaaaccacttatagttaaatcctaacctccaggtctgtttctgagggagcccagcctaagacaacctccagtacttagcacagtgcctgacatatggtattgactcagtagatatttgctgaaagaataaaatactttgcaaatgaaatcctaccctaatattaacttcacctaatttaaagaagttactctgaagcaaagtgattagatcaacttttgtctccctagcttccacctctgtcctcccactagcagaaaaactccattggaaagcctattactaattttttttaaagcaaatttgaactgcagtatagaacacaagtacatcaaaatggaaagcccaggttgcagatttgaccatcctcacttgctgatcttgaagacattgcttcctttctgagatttcaatgttcatttcacaattaaagataaggttccataagcacatagttgggagaagtggcaggacaatgtaagctcatattaacaagcaaatgattaatatagagacttctaaagagcaggtctggtaagtatctagtaagtggacttcctgaagtaagaggagtgttggttgccacactaaaggcaagtcttctagtccccaaatttgccttgggaggatgacagctgtatctttcttggttctggtgtacagtggagaacagggtcaagatgagtgtggaatccatttatttttttacgtgtttataagcactagaaagcagtgagcactaagcagaggacccctcttgcggaaaaagtgcaggagagctcctgggtgcctctgtatcaccggtttgccttctagccagaatcattgctagaaccctgtcactcagttactttggttcctaatttaacctcttcccaagccttctattgcgttcagttagctaggccaggagcttacagctgtctggttggtgctggctcaatgtgcttattccctggaagatagaaggatcacttacaaaaaaatttacaattaaaataaaaaaattattttttgctgaagcattgtaaggtttttttaattcactcagacccaaaatcgtaaaactaaaatatttcaagacattacttgattcaccccccacttctctttctcccctgtttctcagcactttgcaccagatacagaaaccacgggttatgtccaaaccctggttttggtgtgaccaccgccttccgtgtactgcctgcggctcgcttcgggcccacacgggacaccgaggcatgatgaggacgcagaacagcagaagcgcgccctgcttcccgggcgccagtgctcggggccagcggcgtgtacccggcgggcccggccgggagcgggctggcgatcgcggggctcggcgctcccggctcccgcgccatctcccggcgcccgccaacttcgctccgcccgcggcgtagagaagctcgcagccctccggagcctcagcgatctcctggctcgcttttcccgcagccgccgagcagcgcaggcccggcgactccgggtgcagctggccctgtgcggtgacatcgccgtccggcgccaggctcgaagccgcctggccgcgcccgcggggtcgcaggccgctggtcccgcccggccgcgctcacaaactactcgcggctcgtgacccgggacaaacttctggcggcggcgcagcctcttccacagtcaccctccccagagccagctaccaaaatagaagacgcggccggggcgaggaggtgggcggggggagcccggtggccgctcctccccgcgcggctgacgcccgcttcggcggcggtagtggctgtggccgcggggccgcccccagccgagctcccggaggcgctcgggcgcgggccggcggggcacgggcgctcacgccctctagcgggccgcggcggcgccgggcggccgtgacgtgagcgctcccttcagccggcctgcggggcaccgccagtcagtcggggagcaagagccccgcgcgcagccggcgcgggctcggtcatcggcgcgccgccgcccggggctgggcttggggctgcctgtggagaggcggcgggcggaacgcgcgcggccacggccacggccaccgccacggccacggccggcagctcgggtcccgggtcccgggcaggggaaggggagaggcggcgagctcagcaaccggaaccgagggaagattttggctccgcgggctcgccctccgctccctctgccagcggcgccagacgccgagtggggccagggacaggggaggaggacccaggaccctgtgcccgcgcccctggagccgctggagttcggacttctgcaactgttggcactttgggggcttggcttagcgctctgctgtttacccgtctctcctcgctgcctcggaaccaaagctcccggccccctccgccctcgcgcgcccacccaccgccgccggggagcggcccggcccgcactcagcaccatgaggggacttgggacttgcctggcgactttggccggacttttgctaactgcggcgggcgagacgttctcaggtaagcgggaccgcctctgccgcccccgaggcgcgcgggccggcgcgggacgcccgggacgccgacagctccctggtggtagagccctaaggctggcgtcggggccgggcggggggcgcggcgggccggacaccgcttctgcctgtgagccgggcgctgggcgaggggccgtggggctggcaggcacccagtcctcgggcgggcggagcggacggaccccgagggcgagctccccagccgggactgccagctcggccgccgtccttccgcggcctgggctagtgctcaaggttgggcggcttgcactcttgagtccctggccggctgcaaaaggaacagcagaaaactttgcttgaagttcccagttgcagccgccgggccgcctggcgtaggcgctgcgcggtccccgccgaccccgagcagcggccgggcccaggccgctggtgttcggctgcgcccgcagcgatcgccgggaactggcggccgctccggcggcggcgatctcccggtgccctgccctccctgtcgccccctgcccggcgcggctggcgaccccgggaggtccccgcggtcgtgcagcgtctgcggagaggctggggggagttcctcgccggtcccagcggtagggcttggcggccgcggagggaagcgggcaggtccccaggccctggccacggccctgcgccccgctgggctccccctccccaccctcgtccccctagcggagcgccgcggccagctgcaacttgttcatccagcccggctgcccgggggtcccaggtgggaaggagaggcactggcggtgtgcgagcaagcgtgtgagtgtgtgcgcgtgtgtgcctgcacgcgcgcgcgggggcgttctaagcccagaggaacccctcacggagaggatctgtggatcggagtcgggggtccggcgtgggggcgaacccggcacgctgtcacaggggtttacaaccaggatgacctttattacctgggtgacacaggtggatagacggcaaatgctggcccatttgcacaccttctttctagtgtttattagattagtttcattaaggtccacatgcagtgggggcggtgggctttctttttctttaataaaaaagcctgctctttggtcttaaacttggtttttgcaaaataggtctctgcgtttgggaacaagtgagttgaatgagtaagttgggctttttaagaatttaatgaagaggactttcataaacagtaaagagcatattttaagcagtaaaaacctttggtcctccggtgcgtggaaacctttttattttcttggggtccaggaccattggctgctggagctctggactcacaggcacattagttgtgtcttgtgtgttgctgatctgcaggacccttgatcacagttggcctcagagaaggagtggaacgtgtaggttttgaaacccaaagcatcaacttcaatacagaaatatcctttctccaagttttgtgtttccctaactgcctggtaattgcacgtgctccagaggatttaacacaatgatgcactgtcgtctgattataaaactgatgcagaatttggtctgtgttcttattagtgaataatagagtagaatttgagagccttgtaactcattagtattagaagccaagtatgagagccctagtgatggttttctctttattaacatccatgactcccttcttgggatttgtttaaagttaagctgtgtcaaatatcatttggatggatttttaaattgtgtgcaagggagtggaaacaaatatttatattgcttatttaaaccatgggttcctcatcaccaaaaaggatttcagcctcagttgtactgacccatgtccttgttaaggctgatgtaaatgatcagtcaagccaaaatagacttctactaaaatttagcctgatttttcatttggaagaaatatatctatttgtttgagttaatcataccattaagtgaaatgtgttttcttttctatctagaaagccagagttatcctggcatgctagtgggtaaagggcagcatccaagccatgcctcagaaacgttgaactttaaaaaatgtaaaattggattagctgggtgtggtggcgtgtgactgtagtcccagctgctctagaggcagaggcaggaggatagcttgagcccaggagtttgaggttgcagtgagctatgattgcaccactgcaccccagcctgggtgacagagtgagaatccgtctcaaaaaaaaagtgaaaagtgaagatggcaaatttcatatgtgcaaggatcagatatgtttcacttcattatttatttttctctccatattgcgtttaggtagtacaggtgtgaatcagggttttgttttttgtttttgtatgttgaggaagttaattctgaatgctaggagtggcattgacacatttcttttttatgtttcttccagaaattgtagtaattggctgcttttcacttgacatgggaataaattttagagccagaagagctagattgtaagctccctgagggcaaagccaattttcgttttcttctgactttctcacaaaacatttctcatagatccttagatgtcacaggcattattactatttgttgaataaatcactaatgagaatcttgatcatttgcacatattcaaattgtgtgtgaatggaccaatatataataaaatggagggagagaagtgattgttaaaagttagacttggcttgccttttccacactgggttctctttaggccaatggactaatcatgagggtttataaatataatcagtcaagggtttttgtataactcagacattatctacacaaggcactctgccctttgctttctgcagtgctctcctgtcctcttttggaatgggtttggaattgttaagattgttaattaaccatttctggaggtggactacatgtgatttggataccagacatcagaaatagaatgctaaacttactggaaaagtattaggatttgggcctgtgatgacattgcttacttataatgatggatttcattacaaaattgtgggtttttttttttttttggagatagagtcttgctctgtcgccaggctggagtacagtggcacgatcttggctcactgcaacctccacctcccgggttcgagcgattctcctgcctcagcctcccgagtagctggaactacaggtgtgcaccaccaccaccgccagctaatttttgtatttttagtagagacgggttttcaccatgttggccaggatggtctcaatctcttgaccttgtgatctgcctgccttggcctcccaaagtgctgggattacagacatgagccaccgtgcccaggctgaaaaattgttttttatcattaccgtttctaatttgttaggcaaaataatggaggttcactttatatcttctaggtctttagtgttcactaaaaataactggtaagatggtatataagtaagacatgagaaagaaagttaaattattttacctttgttggaaattcccttttgcatggtgagaaaccaacgagttggcaagttgttcctctttgacccaatttcttaaaagccaagttgcaacatatattatataatacaatgaagtgtttagttctaccttataatggttttgatgtgttaagttctgctaagcaagctttggtttgcagaaatagaaatatagacttagctctttgtttcagctacagtggtatttgaaatatattaaatgttaacataaccttgtgaatttgggactcgtggagaaattaattttttaaaatattttaaggatgtttgtgggaaaacagctgaaatctgaataaagcctgtaatttagttagtagtgtggtaccaatgttaatttcttagctttggtaattctgctctgtgaatgtaagatgttaacattagggggaagctgggtgaagggtgtacttgcacagtttgtattgtttttgcaagtcttctataaatctgaaattttttcaaaatacagaattttaaagcaccctttgcaaagagtggtaatatgtttgtttagcagttaagtttattttttctttttcagataactatagtcatagcattttacattttcaaggtgctttcgctagattgaaaattgataatgaagaaaatacttcaaatttaaatcagtgagcatgaaagaaatatgctaagaaattactataacattcttagtgttctgtatatgtaaagaagaattgcttgagcataataaattgttccgatctagaaaattataggttttagtctctcatgttttcaaagggttatttttacagattttaagaaaagaatctattgacatgtagtgatatatggataagtgtgtatataattttggtaattcaaaatgaattttctttaatgaacaagtaatttgaattatgtcttcagattatataaattctttataaatgaagcatagcctagcctttagatttggtaaaagttggtttcagaatttaagcaattctgtgacaattctagaaaagtcaatacctttatttaaatttttcataattctctaaggattgtaatatattctaggaattgtgaggctgtatacagtagaggaactatgtattagattaaatattgttttctttcaatttttgttttagatttcattaagtttctagaatgagcatgtattatctaaatatcccaaggcttagttttcatttagggaatcaggcattttaatgagttttatgcttttcaacagtgaaacatttttcttaggggttatgtccaccatgcattttactttagttctgagattcttctctttgaaaaccaactttcctatagtttcactttttagtgtgcttactatctttatgaatataacatgcatgttaataggcttattttataagcgagggaaggtttaattattaatgtctttccaactcacaaacattctaaaaaggtacaaaataatgtaaatcttgcattataagaggatgttgcttttttgcttcctaaaataccgcggtggttttcagtttagtcatcagaaagcctgagttgacactgtagctctgaaaaacccagcagagaaaaataagttgggctgccttgggtggagaggaggaaagatttagtcaccaagcttcctagtctgtagtgcccccatcattggtgaggaggctggcaaggccagggcataattaagggtctgggagtatgtgagagaaaaagacaaaaacaggatgagaagagaagtgttgtgtactcaggtgtgggatgtgacaagctctagagatcttagcaagggagggtcactccccttgtgccctcttagctatgaaggagaaacacatggaaagttgaaggagggccatgaagagtggcagttgtgcaggtagatcacagtgacatcctgcctcagtgacgttaggtggctctggggagggcctgggaaactgcaccagtgttgatggtgagctaggttttaatctgtgcttctcaaaacctgctgtccacggggagcatctggaggcctcctttcaaaggctgcttcctggggcccagctgtggtgattctgatgtccacgacagaggtcccccagcatccctgggtggtcagggtttgtagccacagttgaagaaacgttgtcctgaaagaggaggtttttgttttgttttgttttgttttgttttgttttttttgagacaaagtctcgctcttgtcccccaggctagagtgcaactgagtgatattggctcactacaacctctgcctcccgggttcaagcgattctcctgcctcagcctcccgagtggctggaattacaggtgcctgccaccacgcctggctaatttttgtatttttagtagagacggggtttcaccatgttggccatggctggtcttgaactcctgacctcaggtgatcctcctgcttccacctcccaaagtgctgggattacaggcatgagccaccacgcctggccctgaaagaggagtttttaaagtgttgtccttgagccagcagcatcagcattacattgaaagttgttagacttgcaaccctctgaccctgaatccgcaaccctggggatgaggcccggcaatctgtgttagaacaagccccccatgggattctgatgtgacctgagattggagaacccttgttctaaaagaactgagatcttctgcctgccctatcagcctcccttgacaagagctgaaagagaactgggggtaaaaatatcacatccattcattcactgcttagcctcttgattaatacggccggtattaccaacatggtgatgtgatcgtgttgtctctggccagacactggggaagagactaaatccagccagttgtaaaactcaaatgaataaaaaagtttcctatgtttttacttaccacgatgtaacaattaaattttgttgtaatggttagccattggaaatttccctgggttgatattttgtataggagatatttgttggcttgttataataagcatgcagcccagtgtgcttattagaatatttaatagtgcttattaataattcttattgaaatatttaattcaaataaatatttattgagcacttacatttgtacggcccctttgtggatggtaatgggcaaggataaagcaggtatagttaccacactttgagaagttattcatttattaaaatttcaaaatctactaaaatggaaagaaacagggactttctcaggagagaactggaagttagtagatgtaagatttggaattgtaatgtggaattgtgaaactttgcctttggcaataaactcaaattccaaatagaaagaaaataaaggtttttcggccaggcgcggtggctcacgcctgtaatcccaatactttgggaggccgaggcaggtggatcacgaggtcaggagacggagaccatcctggctaacgtggtgaaaccccgtttctactaaaaatacaaaaaaattagccgggcgtgttggtgggcgcctgtagtcccagctactccggaagctgaggcaggagaatggcgtgaacccgggaggcggagcttgcagtgagccgagatcgcgccactgcactccagtctgggcgacagagcgagactccgtctcaaaaaacagaaaaaaataatgaagatttttcttggacatttatttaaagtactgacaatgtgtatcctaaaattgagcctaatttttctctgaaccctcaaagacaaccattgcatctctgtcatttaacactccaggtaaataaaaataatcatgatgtcttttaacagattgatcctgagcgctttgtagccggcctttctgagaaacagctgaagagtgcttccctgctgccggttgctcctgctgccatccgcagctgatcactaggtgtagctgcgtcccttaacccccctgcctgagccaagcaaggtccagccccatccatagatggcttcctggacagctaaagaaaggcacgagagcggactttcatccgcttacgtgtgcatctctaagtctttattgtaaaattgagttctttagtgggagttgtagttccactgctacttgtagtgtagtttgttgaaattcagcactgatccagagacaactttagattcacctgctacagtcttactcaattttttcttttttctgctgtgtcatatgttgctgctaatctacatgtagtggtaaaactggaagaagtagtatatatttgccaactaagtaaagggttcatgttaacctttggggccttcttgtagtagaccagaaaaagcagtggtgtggatggctctgtgtaggtgtgtaacatctttaggacatggcttgtctgtacttttcttacgtctgcaaggagtgacttctacagcactgagggtttaggtatgtaattcaagaagtcatgaaaatctgcctggaaatctgattcagccatttttcctgcttaaaactcagaagactaatgagtcatcaaaaactttatatgaaatgcaagtgttgggctttgggttagaagtcagggcagggtggagaatctgattgaagatggctgtgtggcttcctttcgaaactggggctagcaggggttggaaatgaccttgcaagctaaaagagcaaggattgcaggacatacaggagagatgaatgagaggagaggagtcagagacttgtcaaaactgataaggttttagcatctccctctgaagaaaaggccactgtttaacagaatgatttatttcaacatgcaccagccaaagcagaagcaaagcatttactttttatgggctgcaaagcataaaagcttatagagcatcagtttttcagatgggtgaatattcattttaatctctctttctattcaatatgcagaaagcagatttattgcatacaatgagaagagtgcatattagtgtgggttactctgggagtctgaggccccattacttttccctggcttctagctatggaatcaaaatgggctcacaggtaacaggtaggctttgacagagggtgagaaggaattggaccacaccctttgtatagtctgtgtttttttgatttttttttctcaaggcgtcttgctctgtcatccaggctggagtgcagtggcaggatcactgatcatggctcaatgtagcttcgacttcctgggctcaagcagtcctcccacctcagcctcctgagcagctgggtccataggcacaagccaccatgcacggctaattaaagaaaaaaattgatagagatggggttttggtacattgcccaggctagtcttaaacttctgggctcaagtagtcttcagcctcccaaagtgctgggtttacagatgtcagccactctgcctggcccagcctgtttttgatggatactatttgttctctcttctctgtttgagtagcttgaggtactttacatcatgtaataagcacatgcttaaaatgaacttaaaatggactcagtgtgatgttccatctagatatacaattataaggtggtttaaagcattccttttaacatactcataatgtgtaaaaccagattacttaacaattttagcatgtagtagtcactcaataaatatttgttgaatgaatgaagaaacaatttaaagaagctcccttggagaagaaaaaaatcaaataacttatgcttaaggctgttttttttttcctacttcctatcaagtttgacttaggtatctccaataaccttaacaatagaaccaggctgtgtgtttagtgcctggtgccattagcaatttataggtgtatagagacacagttgctaaatttaaaggaaaaagtattaccttttgttaattaaatatataaaagtaagactgtagttttattgtgtataataaaaatgtataaatcagttattgctataaagtagcattttgatataatactgatcactaaaaaatgaaatttactatgcagtagatttatcatgactgtactctagggggatttgatttagtcactggtatattaaaggaaccatggtatcaccagaaagaagattccatgacagggaataatatatattatctctgctgccttttatttctgatatagaatgaaatgaattatacctacacagagctcagacagcatcatgataacatcaggctcatcttcattacagcaggcatgttctcgttcctttttcattcagtgtatcatactctcaagtgataaaacttaataaaaagaggctactttgacaacaacctcataaactgtgttttctacttcctcaacttctgaagtcttgaacaccaaatgtggtgtaaaatttccaccatgagttcaggtcattggctctcattggcattgtgttctgtgtgtgtgtgtgtgagggaggttctccctcgtctctctgtctgtcatcattttcatcccaaatgtgtgactttttaaagagcctctgcttttctttctaatcttgctcagtaggcaggggcccctgtgagacagctggttgagaatgcttggtatgtttggagtgcagcatgctttgtcagagagggacaggacacagtgggggtctgaggctgtgacatcagccatggggatccctgagctgttgaaagaagggcagtagtagcctctggttggatcaggtcttcctggcattgagttctccttctacctctaagtagccatgagaccttgggtgtgttatttcattttaaaataccctgcaggatgatgatgatgattatgatgatgatgatgataatgatgatttttagacagggtctcactcttgtcacccaggctgtagtgcaagtggcatgatcatagctcactgcagccttgaactcctgggctcgagcgatcctcccacctcagcctcctgagtagttgggagcataggtgcatcaccatgcctggctaattaatttttttttttttttttttttgagacggagtcttgctctgtcgcccaggctggagtacaatggcgtgatcttggctcactgcaagctccacctcccaggttcatgccattctcctgcctcagcctcccgagtagctggggctataggcgcccgccaccatgcccggctaattttttgtatttttagtagagatggggtttcactgtgttagccaggatggtctcgatctcctgacctcgtgatccgcccaccttggcctcccaaagtgctgggattacaggcgtgagccacagcgcctggccaattttttttttttttttaagagacagaggtcttgctttgttgccttggctggtctcaaaacacctgggttcaagtgatcctcccacctcagcctcccaaagtgctgggattacaggcgtgagctgctaatgcccagcctccttgcagagttattgcaaagactaaatcagagaaccaatgctgtgatgtcaggggcccctggggtgatagggcttcatgtgtaattagtggtcagaataagacgggtccatcagtctgttcccccatcctcatgcagattacagatttaagcataggaaccctgtgctttcataagtgaaaaagtgttgaatattggcaatttcacatgattcagactaacacatcccctttctgggtccaaggctttgatagttgtggtgctgggaggttgtataagtgacatagaagtatgtgtatgtggttatgtatgtctagattttataaacagggccaacattatgtttgaaaagaaaaaagccccctgaaattagcaaaataatcatgttaaaattggcatcatgaaaagccagcactgctcggtgccatggaaggccctgcatcctggatacctgcattacagtcacctgaagcacttgttaaaaatgcagattcctggccccaccagacctacagagtcagaaactggaaagaaatacctcatatgattttgatcttctttaaagttgaagagctactggaaggaaagtaacagtgactcagagaccctgcctttgtattgaatttatcacatctactatgaggagtgttaagaaagcatctgaggattactattaatacatgaatttttacatagcaaactataattggccagagagcatttcttttataaagcagaggcttttcagcattagaagagaaaatgagttatgaaacaattacattatagaaacttatctgcttcgtatatatcttgcaacttggtgacctctagtaaatgtggcatcactctggaatgtttagaatatagtgaaagaataaagacattttggagtaatcagaacacagatgattttagatctctaaatttgccaatttgagctgcattttgagatgactcattcagggaagatcatgagacaagatgatctgcaaagtattttgggaagattattttccagcacttagtcctttacttcatgttcattgaaacatgtgaacgttgtggaatgatttgtcttaggtgccccataaggatggaccaaaagcttggtgctttgattgcagtagttttaaaaagtctcacaaacctcaaaatgggcatattggtctgttaaagcacttgaaatttccactagctcatcattttggccaaggaagaaaggtctttgtcaaaatgtcgtctctaggagaggtggctcattaagttatcttaaatatgacatctctaactagctgtcacctcgataagttgacatctttagattctcccttgtaaaatgacatttgattcaaggatctctccaatatcttaaagagtatgaggattgtcatcagcttatgtcttagttcagattagtttgtcagatggcacagcaaaagagaatgagacttggatcattgggtcatttttgataggtgagcatgggagacatgtctagagcactgggtcccatctgagagagtgcctgatacagcatgaggttgcttgctaacaagaagtgggtgttgaagggctgtctgcaagattttagatgctttgaacatttgccataggcttcatctgctaagctatgcacttagcataagcgaagttcactctttctctctgtacttgagaatgtagctaccattcacaggtgacgccaaaggctcttcagcaactagactgttaaggcctgtggctttcttcttaaatattgataatatacgtaagccttatttcaggggcttagcattgatagtcataagtgataaccatatattgagcactaagtatgtgctaaatagtgtgctgagagggtatgatattctcaaacttattgccccccatttacaaataaaagcttggctgagagaatcaacggagactttgggaggtaaagtcgtctccactcccaacccaaccatgtcatccgaacgtggggtacatgtaccatattatgtctccctccccatacatacacagagtagtgttttcctgatttatgctttactttgatgccatcctcctgtattgaagtgtgctctaagaaaaagcatttcaaatgtagtgttgtggctgctaggaagatattaagtgatgttgtattatgtcatataaaatccgtatgatgaccttctggagagatttctttccggttcagggaaaggtgtgattctcctgtgcagtcagattcttctcgtggacacagtgagcaatataacccatcaactttcttttttctgtcggctgttagaaagccagattcaaatgcatgttttgtagtagctggaacttttatattgaactgaaaacctcagtcaaagctggcctgcatcaaacagggaattttttggctcttgtaacaggtaacagagaaggccaaaggtgggcacgggattccaagtcttccttgctaagcatcttttctctctatgtgatgtttctaaggagttacaggctaaatccctctggctccaagcctagtggaaagagaaattctcttccctcatggtacaactcactcctgtgattgggctccaagaaaaaaataaaaataaataggttctgttaccagttgaagagtagatagtacctggacgaaaagcagcaaactgccagagcattcatctatgcagtcgatgcttgtttctgggtctttttgctggcctgattcttagtcacttctcacatcattttaatttattttgctgtattttatgtatcattataaatgcattaaacctttttgggtggtggcagaaagtaaattagtttcaaatctcatcatttgcatcagtgctccaaatgtaccttttgtgtgtgcatgtttcatttactttttttttttttttttgagacaaggtcttgctctgtcaccccagctggagtgcagtggtacgattatagttcattgcagccttgacatctcaggctcaagtgatccacctcagcctccagagtagctgggactcccaagcagcatgcggcactattcctggctacttcacaaaaattttttttgaagagatgacttctcgttatgttgcccagactagtctcaagctcctcgcctcaagccatcctcctgcctcagcctcccaaagtgttggggttacaggcatgggacaccccacctggcataaaatttatttttttaaagcatcaaaatcttttggctaagcaaattttacataggtagaaatgtgtacaaatcttttggttaaataaagttttatgtgaacatatttttaaaaaggctatccaaattggcaaacaaggtatattggttagctattgctgtgtaacaaagcacctcaaaacttagtgacctaaaacaaccaccatttactaaaacttagtgacctaaaacaaccaccatttactattcttcatgttctatgggtgcctctgctgacctaagttgggctcggtatactttgtgtatatgtgtctctcctcggtgatcttggctgagctttcttgaaattttgctgctgtccttctgtaggctggtctaggatgtcctcagctgggacagttggactctcgtacatgtgatctctcattccaaagagagagcagaagtgaaccaagacttctgggctaatgcttgggaagagtacgttgtcacttccacctcttctcctggccaaagccagttacaaggccagcctagaatcaagggtggggaaatagtcctcactccttggtatgtgaggctgcagggtcacatggtaaagagtacggatacaaaaagaggtgggaaattgggacttacagaggggtctgctaggaccagcacatatgacctaaatgcctcagcttctcagaacagttgggaaatcatgggcagcatgggaaaaagaaaagtttagggttggaagaactgcgttcaagggccagcactgctgcttactgtcatctgaagggtgaagttgttaacttcggtgaactcacttccttatctgcaaatagggtcaatcggtggcattctcattcatgggtttacttcagagatcaaataatatgaatttttttcaatccctgtgtccctgggtgagttctgaaggttataatagcctcattaaacttgagttctcaaggtggctgtgctatttcctcactgtgagaatcacatagcttctctagtccttcatctgtgaaaagggtatgaattctacttccttggtcatcctgtgtaaaacacagtgcccagtccagaatagctgctgttattgttggagccctatgactacagaatagccttgagcaataaccttgccttgtatttttcctttatgtctacaaaccccaaagggtatggttttcctcagccccagtttttcttccatttgtgatcttgattcataaatttgctaccatttctcctggtttcctagaaataaggaaaaaggaaatgtgacaattgcatgccacctaggtgctaggtcctttacatatcatttatatacttctccaatgtgatcctattaggtgaagatgacagcactggtattttagggtttatggaactgaggcctcaacacatttcaggatgtcccatggacagtggctacagctgattttagatccaaaagtgctcatttccctgggcccaaagcctgttttcttgtccctgtctgttgggtccaaagcgcatgttataattttcaagtatggcttaagaatttggtacagtttctcattttgatgttaaaacaattgtaagattggcacagcccagaagtgcagtgtacttactgctattttacagccctctgaaatagtaaattaaaaggaaaaatacttagcttcttagtgacttgactgaaattaattggttagagaattacttatatttttcatgagcagaggagggcagaatgttgtcttttctctggttacaaatcccgtagatagaactgtgtttttgtaatttcttgtgttttccatccgaatatctgtttaacgtgaaaggtgcaaaatcctttgtaaatctctagtctgtatgcctgagtggtcttagggagaaaatgccagtaaggtaagcaataatttaagacctttgacttcaagtggaggtgggaggccctaggagactgatgttaatcaccttctttagaacaaatttcattgccttttgaggcttgacaaagtaaagaaaacatgtagatctgtatttgaaggatttaaaataatctagtgagtaaattcttactttatccgcaatgggaaagaactgtttggtatatagtactctacagtggttatgtactttgcttatttaaataacattcttgcagtgtcattagggagaattacatcaaaataaactgcattaacaaaagtagaataagtgagtatcgagaatattagcatttttcagagtgactttaaaaaattatgcaattatgaattcagacattttatcaaaattatttatgaagtaatggtcattgtcaacagatgcaagtttgtaagtaagtactgattttggaaagattcctgggcagatagagataaaatgaggtgtttgtcgtcgattgttagggatgagaaagacctcaggactgggctttaggagatctgagctctgatgtctggttctgctgccatgtagcatgtgatttgggtcaaatctcttcatggtaactcaaggcccagaaaagtaaaattgatactctaataatactttttggctacctaaaataaagacgaagatcagtgagaaattgtgattgtgttggcatttttttttttctcttgggatgctttctgaatacatattgtttattagattctgggtacccccaccccaagattattctctcatgcctcagttctataaacggaaactaaacacagtggtgagaagtcctccatggctggaagaatattcaagagttgtttgcaaggcatattcttttccaaatacaatgcttacctagcactgagagtgaaatgaggtagaataatatccccctgctggacgaggtatctgtgccttctgtgggtgagtacccatttataagtcctgtgctgaggccctgggagccaggcctgtgctgagcattgaagatataaaggtttccaagatgagggtttgtcgttaaggagctcacaggaaaactgaagggatatccaagcaagtcgagccctctatttctcaactgacatagacagcgtggaaattagggagggagagaggaggttgctccttccccaggctggccttggcaagggagcttgaggccaagtgtgcaggaggaaagatccgtgggaaaactgcagggaaagctctcctgtggtcacctaggtaactaggaggtttgcagttagacaatagacacgggagctgcccatgaggcctttaggcactattcaggttgatgcagagggaagggagagaataaacttttacatagtcttttgaaatggtttttaatttttttttctcttaaaacgggatgtcttctaagcaagtgagttttcgaaggctgtggttatcttagagtagatgcagaaaggagaacatctgggaaattgcagagaggattggaaattgcagagaggaacgaagtttgaatagtttttgtttttgaacttggtggcttggcagtcttcccttctgtcccatgcagatcatatttggtgctgtatttaagggatggatttgtgcgggattggaatttggccagaggttggaaaagtgttgagtattggggaagattcatgactcaaaatattggctactgttctattcccatgcctgatatcaaggtccaaggctttctctctttttttttcctcttcttcttttccctcatctatctccctctcatgtgatagatgggttttgaaaggaagtggtaaaccaaacaggtatctgtatcccacttaaccatggccactcctcttgtagtggcattgtcagtggccaggccgcttgtcatcgtatttctcctctgcagatgtggacaggacagagtgttcattcacatagagtgaattggtaagtgaaagcataaccagtaccatgcctggtgaggcactgggtggtgccttatctactttatatctaatcagcactgaagttcttgtgtgtaaatgtgtaataacaccacaaaagaacagctgatactcatagaatacttaaaatttctaggcattgtcttaagcgctttttaattatgtattatctgatttaatactcataacaacctaaattaccctcagtttacaggcctggaaatcaactgaagcaaagtggccaagatcaggcaaattgtaagggtagagctgagatttgaacattatcagcttgatcctttcagccactaacctacagtttgtagttctttgtctacatcagacaggcttacaatcacgctgcatacatcgtgggcttaacctgcttctgtttcaatatccgggatctttttgtatgcttctctgttggttggttagtcaggagtccactacgggtggatgaatggttcaggtattgtaagtgcactggcaatgaggtggcaggactaaggacctgggggaaagaacatcagtccttaggcacttaatcaggttgatatctttagtttggggggtgacttttagaacaaagtcaacagataggtttgcttattttggagattatattataatataaaccagccaaactgttagggttgggagcaaaaccagggctagatactgcgtgatgaaaccttgccagtgaaatggctttctgagcagggagctgatactgctcagttccaaggtctgtggggcattggcatctgacttaaaagcctgtatattcaataaaagaatgtttaataaaacagcaactcaaagcactataaacatttaaaaacagaatttttaaatactaggcattccttgcacattgataagttcacatctgaaatttgcatgacataaacatacagttgagaaggagagaacgtatgccctatggtaaatattgacattttaaaatacaacttgtacaaacatcttttaaaggtatccattgtaaagacccaagtaccaaagggattcgataccctccattgtccatttaaaaatatatgaacaaacttttatttaattgagagaaactttacctctttaatttttctccttaaactggtactcccattttctttccctatagaatcatatcctattataacacatttgtgcttgaaagtctgtgattacttatcaggcttctctgtaacaaaaatatgtaaaaagttgaaattttaattctatatttaattttataggagtataaacctttaagtgttagatttttatgtagttgaattatcactagtatgtaatcgaatcattgttaaaatttattggaagaattgtttcagaaatcaactgggctttcgatgaaatagttcatttatctgtgggtagatattacttactggttgagttaaactgggttaaacatcaattctatttccatttttcatttttataaataggtactgagaatctttgttcatataaatagatggataggattagccacttctttgaatttctttttcaagtttcatgccaagattcacatcattatctagtatcagtaattatttttaatgacctgttagctgacagtttgattaagctcattctcaaaattgttgaaagcaaaaattgggaaaccaagtagtctcaaaaggatttgttgcccagttatgcaccctctcatttgctgggaagtagaccaagaggctttgcaaagatttcctcaatgactgttaatttcacctgttgttttttaacttaaaagcatcttgtttaacccagaaatatgaagaagtcattgggaaaacaaaaataatattagtttcaatatactttagccaatacatgttttaaatatatttatataaataaatacacacccaaacccacatatgtatagttaaaccttagaggtgaagatttaggctaatcaataagtgaacaatatatgattccatcgcaaagcagttctcatcaagctgtcggtaaaatcagacgtgctttctatcagataaagtctaacatagtttttaatttcaagtaagttttaatttgcattttgaggaaaaaatttttaaatggtaaaaagaaatgatatgacagattactaaaagcagtttagtcaattttgaagcactgtagatttaatagaattaatcatattttgtaataagttataaaaccataatgaatctactttgtttcttattagtctataggaatgccatataatggacacctaaaattatgagctattataaagtgaggattctgattaaaaacatgctatttttctggtaaatgtgtatgactgtttatactgaactccggcatttgacttctgagaataattaaacagtaattatatatatactttcagaaataactacattaatttccaaagacttcagggtccaactttgtatttaattcttacatatttaatcaaatggaggtatgtgctactaaaaataaattgttatagcagctagcatatttttgttaagaggtagaaaatactaacttatgaggattgactatcattggaaaaatcactacataaatatttgataaaatagattttaatgatcttactttataatgcacaccgaatctaactaaatctcatttttgtgagtttttattgtataattagaaaaatttggaaagcattgcaattatacttaaaagaatcagtgtcaggaatcttcacacttttggttgtttgaagattcttttcttgacagctaatgtgatgtttgagtgtgatcataaatgctcacaaaaacaaattgttaatgattatatttggaaacaccagaagtaattttttgtgtttaatatttaccagtgtcatctttgccttaatgtcaccagttcttctgctctgaaatgtatcctttaaccgtggtcacttgaaggaagatgtgtggttgttaaattgtatatctaattttataacacctcacagggaggaaaaccctcaatctctagtacattgctttacttttgctctgttgcctaggctggagtgcaatggtgggatcaggactcactgcaacctcaacctactgggctccagtgatcctcctgcctcagcctcttgagtaggtgggaccacaggtgcataccaccatgcttggctgatttttaaattttggagagatggtatttcactgtgttctccaggctggtcttgagctcctggactccagtgatcttccagactcagcctcccaaagtatggggattacaggtgtgagctgctccatccatcccattgttttactcttaaatgaaatatggatttgacagtgaaagacaagaagccctccagcgaatgtctgttgtttgaaagcttccttgaaagcagcaggtcatgtggttcctttggtggctgcatgggagtgtttacaggtgaggggtatggctttcttttggcagctatgaggtctgttgagaaacagcaaatgggaaaggagaatctacctgatcctagcacagaaacgggtgccctttggcctgtcggtgttctgtacccctgagtttccatagccacggagtgtggctctgctgggactctcatactcatggtaggaatgctggagctgggccctatggcccaactttaatctttctagatagagacctgaacacttgaaagtgtgacatcctcccctgcaactcccccccaccaccctggccaagaggcagaaatcaagctggtgaattctggtttacaatatagtaactcaattctggtcttagtctgtgactttggcaaatactgtatgtctctctgctcctgaaatcaaaacaagtaattctgacataatataatgtagatattaagactttattagtcattaataattaaatgaacactaaacaaaggcatatactcctcatttaacctgaaagaatcttgcaaaaccattagtttcccatgctgtaagtaaatgttttggacagtgggtagtttccagctgaattcgcaccttattccaggaagcagaactttgagagaacaagaagcagatagagctgtagagatgcttaacacgtgctgcatgtcatcaagccacttattatgtgacattcacctttacacttgggtggtctttccaacttgtctctaatgggaagcaggtgggtgttgttatcttattacatggatctggaaacaatggttaaattgttggttcaggccctagcagaagcgagagcatgggtttcccctgagtgagttctacagagtggtggcaaagcttttgtaacgcactaccgaagaaaatgacgaagcacagggaatggatgcttatcccttttgctaatattaagtcaagtttctccttaatttttcttcaggaaatataacactggcatcttaatctttgtatataaggatatttataataagctttgaacgggactgaagaagatagtaaggtgtgggggattatctgaggtcaattcattgatcagtggctgttcccagggtgatgggtcatccaaaacagaggtctccagagtgtgcacacctggagggtggaaagatggtcacttggatacctaaagaaaatagtggaactttttccaaatatgataaatgtctcctgaggaaataagagtggatatatacaaagaatccctgaaggcgtattcattaaggcattatttggagaagtaaaaaaattgggaacaacctaaatatccgacaatagagagtggattaaatcctggtatattcatgtaatagaatgccatatagccactaagaatgatgacaagaatatttaagggtgtgagataatcacaagatagtgatgtgggacaaaaactagtgacaaaatcatttgtgtaggattatgctggtactacttaattatttaacatgtttattgaaaaatctttggaaatgtatggaatacaagctaaaatattaaccacagttaattatagatagtggatttattggtattttactttcagtttttctggatctaccaggctttcttgaacatgtttatgtatccatcttatgatgagagaaagttacttaaaatagctattatgtgaattttgaatccatgagtgtttaactcagtaaagaaggaactgtgatgattttgtgagtatgtatgaactggctggcaaagagtgactctcatttcctgcttctagaaaccaaaaagtgaaagaggaagatttccagatgacaaaacttatctccatttttctttgctttctatgtgtaaaacacaaaacatacaaaatgtaggtgtgaaaatgcatccccgtgtgttttttaaaacagattgtatccttagctagttgtcttctaatcctcatttggctgtcttttcctctggaattgtttctttgctgaagtgttaatggattggttaatttgtgagcaacactcctaattgtattaaatctctacaaccttattaagcatttgtgcaggattagatcagagagcttggagaagcagcttgccagtggtcagagggagggagtggggagagccaggctaacaagtgagtctgggccactaattgatatccctaagtcccctactccccaaaataaaacaacagactggaaaccccaccactacaagttcagaagtattctaaagcacatacaacagcttctgtgctgtatgtttaaatgccattaaagagagagaatatgcaagccaacttattctttttacttttatttgagggaaaataaatgataattaacataaagaattaacgaaaatctccagagtgctaggtttttaattctagttgcttgtgtttatatttagacaccaggctacaggtattctgtgcttaaagagagggaaacaatttcaggaaatataattgaaccgtgtttattttgaaaacgaaagataataaatagtctgaaatatactgacttttatgaaccgtgattgacagctgccttctgcatgtaagggaggtgaattcagcacctgaagatgctggctgtgcaattgagaagtggggaaggggagaatgcatgatgagagattaataccaacctcagggggctctccctatgtgtcccgttgcttattcctgcctgctgataattctgttcccagaaaactttgaagtttatttcccagcattatcacaacagtaatggaactcccagtaaaaattttagtgacccgttgtttgatttaaattatttattgcattacatattttagcatttttgaagtaagagatactgtagttctgttaaggatgaaaaccaagtcaaacccataagcagtcagacttgttttaaattggatggtaccagaggtttttaagagccacctgaaaaaatagaaaaataaagacacgaaatggtttttgaggttttacataatccatgtttctacaggcgacatgggagctaggagagtaaaaatagggcaaatagaacaaaatgtaaagagaagagtaggcaattttgccttttcagtgctttgggagctgtaactcatcatatattccactcaacaggtcaggagagccatggggatgccccaagggtgtcatcaaatgctttcttgccctctgccactctctcaggacttgcctggtcctaagcagagctgtcaggcctctgcccacctgcagggggaaaatcactcctgtctcctgacgctacccccagttatgtggtacagagctgcctggtgctatctcagaaacataagaggaagaggctcctcagttaactcttcccttgcccaggggctattatgaggtccatgtaatctttatagtcagcagggtcctagaattgggagggtaaaaattggagtgtgtgctataaaaaaggggtgatgttgatagagaaagttgtcaagaaagagcaacattcccagggtttgattgataaatacaaaggcaggtgtgtgtgtgcacattcaagtgtgtgagctggggaagtgttgctgaaccgagacagaacatagccctttgccttggaggccttccacagcgggctgaagggagactcggaggttctgtccatatctgtgagaggtgaaaaggaaaatggcttctattacaacctggattagaaaaattcctagacatggtggcaggtttcttctgttcctttcagattttctgagtccttgtaacaattgaaacacatttcagtcagttaaatatataggatattttctacaataaaatcagtggcaaggaaagtgtgcaaactgcttagttaataattgctggtgtggagcatctcttactttgctttttcccccttaattggttgagtattaataaactcatggtttgtttcaagggcacagctagtttttaatggtcttaccgaaatttcaggaagaaagctaaagaattaacataataaataattattgcttccagggttttttgtcgttaagataataaaatgttaaaaagcaagccacttgagcggaaagtaattgccctgataagcaccacacaggcagcattcacaataaagcagcccttccctcaatgtcagccagatttgcatcccacataaatgcttcctcacattatggaaatgtactttttctatcaacagagtagaatgaaactccaggcttctaattaatcttggctgacatttgatttcatacccaagttaaaggcaagaagcggtggagcttcccccatgtacatgaccacaggcaaatctctccattaatgtcaaattgcatctgtgcatcttattgtcactgccacatgtcagtcattaatgcattagcaatcacttacgtccactttctacctgctggttccctgcttgaggaaatgggcattgcaggaattttactttgcaagcctttaaccttgaacctctggattaatgacataaagagcttactcagatataatgctttacagatttcagcttgcctttgcctaccctgcacattgtaaatctcaacagcttggtgaagaagaccagacacccacagtttacaaatgtggagaccaagacttagaaaacctacatggcttatctgaggtttcatggaaggtaaatggtagagctgggatttgaacccagaacttcttaggtccgatgtaatattattttctctaaatggattagagagctccttgaggggtagaattaagtagctttgtcactctatacgaccctctccgttctttcccagtcaagtttctgttgatgttaaggaagcagtacacattttttattggaaaaagtaacaaattcaaatttatagacaaaatagtaaagtcagttccatttaaattatttgaagtgggtcataaaaagaaaagaaaattgtccaggcgtggtggctcatgcctgtactcctagcactttgggtggatcacctgaagtcaggagttcaagaccagcctggccaacatggtgaaaccctgtctctacaaaaatataaaaattagctgggcatgatggcaggtgcctgtaatcctagctactggggaggctgaggtgggagaatcgcttgagccctggaggcagaggttgcattgagccgagattgtgccattgcactctagcccaggcgacagaacgagactctgtctcaaaaacgaaaaaaaaaaccaaacaaacaaaaaaaagaaggataagaaaattactcacatcagggtgaaaaagtaaggtgtgtatatcgctcattagatgttggttttaagctcgcctgctgtcctgcagaaggaaatgcagaaagcctttgtctcagagagaaaccattttccttgttgctactctgaggtttccacccagggttttatgtcagaaagttggacaacagaatgggtgatgctcttctcattaacaattttcttgtcaatatggcagaataatgtgtgctttttaaaaatctggtctccaaattaaaggaataacttgaaaacaattgagtgaaggtagttctatgggaggcaaagatgatgtataactgatttgatttagaaacaaatcagcctacctcacaaggtaaaaaatagcttcttttaaatgatcatcctcaaagcccacttctcgggactgagttttgacagtggggacaacagtagtactcttgaagtgtcttggagttctggggtctttctggctaagggtgttgtagaatcaccttggcagccaatgtgccactcgttgaatagctccttcagtgacttgctaggcctgatgttgacagaagacaagccattctcttaaggcccagaaaggtcttggttgtgatcctagagctgctgctgttgatgaaggcagggatggcttttgctggactattttaatttccatttaccttgaagccagcatgagaagcatgcctggagtattttggaacaggtattgtgtggggagccattatgactataggagaactttaggaaggtgcccatgaagtatcagaatctaagcaacattgatgctttcctgatgtgcctctgaggaggaattggctgcaaaatgcgcctctaggtaatgaggcagattgacctgaggatggaatggcttttttattagctatgtaagtgttggggaatgtctgtcaaacagtgattttgttctggcatagttaatgttgagccttttagggggacaataatgagatgaaggttgtttggtaacattgctctatgataatgtcatcctaggagacttagcattgtaagggaggcccagcatgtcaaatgcattttagtctacagtgaagtctcaggtggctacattaaaagcagaaagtcgtggcacagacttcaatagtaatgttactctatctgcattttaacatgtttactatcagcaatagatgatgatcttcatagtgatattattaagactatttcttgtgtaatttttgcatctttgctgttcatctgagaatatttgaatttgtgcacagctgaagccatttgaggcttgcctgtctgattatttacgtagaacaaatcaccctagatatattagtggatctctgccaaactgccttccagaaacattgtacccatttatatccacacctctgaaagatgcacctgaatcatttgaatcttttcccacttgtttgacaaaagatggttttcttggaaaaagatcgaaaaagtattggtaaggtgttttaggcatttgtgtatggtagtacccccttatctgcagttgtgctttctgaggtttcagttacccacaatcaaccccagtctgaagctactacatctccacccttgtgctttggggcccttatgaagtgaaatatgtgagtgacttgagcacaggcactgtcatacggtgacagttgaccagagaacggagtcagctactaagtgaccactgggcagggagtgtagacagtgtggatcctctggacatagggaggagtcatgtcctgggtgggactgagtgagatttcatcacgctactcagaacagtgagcactttacaacttatgaatcgtttacttctggaattttccatttatgtcacaatgccttgtctttcacctgacttcatcttatcccatgggcatttcatcatctcacatcatcacaagatgcagggtgagtacagtacagtaaggtatttggagagagaccacatccacatacttttattacagtatattgttgtaattgttccattttattattagttgttaatcttttactgcgcctaatttataaacttcatcataggtatgtgcatataggaaaaaacatggtatatatagggtttggtactgtctgcagtgtcagggatccaccaaataggtcttggaacctatttttggggtacaaggggggactgctgtatgtttattgccttttcctttgcttttttcctactggagtcattatctgatttgtttgttaaaactctttgtagaaatgccactcactcctttccttctcttcaaagtattttcccttactttcttcatttatcttttttttttcctttattttcttttttttcagacagtttctctgtcacccaggctggagtgcattggcacaatttcggctcactgcaacctccgcctcccaggctcaagcgattctcgtgcttcagcctccccggtagctagaattacaggcacatgctaccatacccggaaaatgtttgtattttttagtagagactaggttttgccacgttggctaggctggaattgaactcctgacctcaagtgatccaccctccttgtccttctaaagtgctgggattgttgagccactgtgccagccttcgtttatcttttaattcatagcgtttttgtaccatagagaaacttaactgtgtgcacatgtgtggtaaagggggaatgattgactacttttatgagcagcagtagaagccttggttcatggaagacctccagaggccttgaggtgtgaagtggggctggtgagagaatgctgttctctctgtgttctcttctggtccctttgctgggtctcagacttggatgctaatcgtttctttacctttcggatcaatattgtcatgggaggtaattttcccccaagtggacagattcttgacttactagagtcagttttgttactctctttggcatgggaatttaattatgtattttagtgggaaggtgtgagcaggatgaaattagacacagataggtagtcactgccacaacctgaggtcagctgcagttttcttaaaaagtcactttttgctaataaagtttccgtccctgcttctccattcatgtattgcactcatctacactaagctgggtaggcaggaatcatgaagtggattatggaatgtccagtgggtctggatacatagctcgcatatccattaatagcctgcattacagattttatgtaaagtgttagttttaattacgtaagcattagatttcctgtaaagatttcagaaaccacactatttgaaagagagtacaaatttgcaaagagaatacacatgtagtggataggtgaaaagcttactccctaaaactatccagatatggacaattcagggtcatctgtcaggccatttataaataactcatattagcattaatcaatagtgcagcgttccaggcctgaaacaatgcatttaaaaaatgggatattttgcctttaaaaaaaattgttaatatagacagtcctcttgaaattagtggggtttaggtataaatttagatcatatttgtgaatgaaaccaaggccaatttaaaaagctatgtatttaaaactacaacaaagtaaaattctttttatcttaatccaaatatatattggtcagtatttcttattccagagctcagaattacccaggaaatctttggtttcctaaaactcaaaatgtttattgccaatagctaagtaatatcttctcgtaaacagtgtggctcaaaattatgatcctatgtttatgaaactgaaatctgacttaagtgcttgtgattgtgtttctagttatacaaactttcataggaatgaaagcaaagcataattctgaggttaagacaaacatgtttggtattcattaaactctactgagcacgtctacgtgtgtttattgatcatctactgcaggcttagttctatgctcagttctttgggatgcagggacagaaattaggtactcagaaatttctagaaccaagtaacattatttttaaaatagtgcaagtctgggtatccttttataacagggtttctaaccatagttcagctttgctgtattaatagtattgttgatgtcagcactttcttggaagacatgttttttgcttattcaacttttgcctcatgttagatttttttttctgctaaacattgctgttatcttagtgtttgttttttgttgactggctgtttggcctgagaatttagttctgaattccttttttttttttttttttaaggcaacagaataaacaagcaactgtgtgtcccttggcgcggtagccaatttaaggtgattcatacccagttacttaatagtaaagtctcattcctaaaggatataaactctatttcttgcaaggatgcttaaagagctgagcaaatcttaaagcattattatcacattttagactaaataaagatattttcgttcattctaattttcgtcattcccaaacacactgtggccttctgtggcatgagtagtttaatcaagtgtttagaatttcttggcctcaaccagattagaggaatttaactcagctgttgttgagaagaagtaattcttcagtcactactgaggttttgtaagtgttattgttaaaaaaaagaaaaggaactttgaagtctttattagaaaataaggtgaactcattgtgttttatgtatgttctgagatagagttaaaatatttcaaaattactacggggcaattttcaagcttaaaataaaaaatggctcactacccctggacaggttgaatttgtaattcatagctgaaccgctaaagttagcatgcagattacactatgagagttcatgcaggtctaaatagtctcaaataattctttaatttgtctctacaagtgtaagtttactaaaagtactatatggaaattccactatcccagcttttgctgggtcccttgctataacccctgactcagttccttgctttcagtgagagctcccaacagctctcatcatttctttctgtggcttaagtctgtgcatgctcccagttgccacagcagagtttctgcaacctggggttcacaggatcatctgggggtgcttattcaaatgtagcaccctgctacatttttcattccagaggctaacacagggcccaggagaatctgccatttaaaaaagccacccatgtgatagaaagccctcttgagggaaagcaaaggcctgtttgtgatgagagctgttcttggcctcccttcttgtggcaccctcccgagctggggactgtgcactgtgcatttgctactcttgaagcacacttgaccttcacctttcaccctagttcttttgcttaggtgctgggtgggatccatccaccttgctcctgggatcttctacatgccttttaccgtctatctgcatgtcactgccattgcacccttctcctgtaatgcaccctgctttggtgtaaagtcagttgctctcttagctgttctcataatgcttgaccctgctttcttttcacacttactgcagaggttaggagcaggactctggggcccaccaatctggatttgaaacctagctcctcctggtctagctgtttgctgaagggtaagttattttatctttctgagcctgagatgcctcatgtgtagagcggggagaatagtgactacctcacagtctgttgcgaggaccaaatgaggtaataaacatccggggctgagaacagtgactgtcaagtagttagcatgcctcgaaggccagccattgccatcattgtgatttctaacatcggctttttcatgatcatcctacagagctctgcgcagccagaaatctggaggcagcaatcttgtctcccctttcaaatccagcacataacacaccacttgctccccacaccaacccacaagtgttgactgaattgcactgactttacttgcaaatgcatttcctgacttcagtgtcaccagacctcatcagtctgtggctatcaaatacattctgttgacttcagtaactcaaaagtccatgtccttgtgatcaccaccttgtgcgttgtctctacccgctcccctccctgaaggacttggttcccttgctcattcagcagtctctccactccaggccctgcccttcccctgcttcctcactagctgcaggagggagtaacctgctggtgctggctgtgccattgtgtgctcttgctgcctgcaccggtaagcttgcttgatgcacaccaggctgtggcccaagaggtgcctagaggaagacgctgcgcccctcagttcccctctgctgcacttgtgtctacctgggcctctaggtgctgtcagggtttcagaggaaactgctcctgcatctgcagggagctctgctggactgagaacaggctcacctcctgagaaacacagaacctgaattcatgcttggagaagacaacaattctccaaaggctgacctcccctgtgtgaccgagccccggagcccctctgttggttcaagatcctgcattggggctgcagaagcggctggcccagtggcgtggctttcctaggacagaaggattgctccaccctacaggggaacaaatgtccaccttttaggagacagaaaactggctgttgtatccaaattaccgtttttctagcccgcggtttctgaacagtttcgtggatcttaagtctgagtttcagttaggctttcctccccactggcatatctgcaggaaggacagtcctagctctggatatttctctgcccccttttatttcttgctgtatgagtcactactctcccccggtgcattagtttcctggggctgctgtaacaaatgaccacaaacttgccagcttacaaccacagaaatttcttctctcacagttctggaggccaggtctggagtcaaggtgtgagcagctacgctccttcctaaggctctggagacaccccgttccgggcctctctcctggctcctggtggctgttgcgagccttggctcatagctgcatcactccaatctctgcctccgtcttcacatcaccttctcctctgggtttattctcttctgtgtgtctcttttaaggatctttgtcattggatttggggtctacctgaataatccaggattatctccacattgtaggatcattgatcatattttaaaagaccgctttatcaagtaaggtagcattttacaagtttcaggagttaagacttgatgacttggggtgttcattattcaacctgctacacccgggtaacagtaatctacattctcatacatcagttgcattgtacccatttcataaattaatcttgtgccatttaatttggtaatctggttagtgctaggaatttttcatatttaggggagagagaataataataactacagaaacagtatatagttccttgagcccctaggcatgctaggcactgtcacacacaaatgcttacactggcctgggagaaaggtgccaccattatttgcattttactgatgaggggacttaaacctggagcacttaagtaacttgctacggtctgcttagcaagtcggtgacagaatcagcaatgaattggccgtctccttcaaagtctgtgctctttaaagtggtcaggactgcaggaggtgacctcaagtcagagctgggtggggaccttggtgtagttgtttctaccactaagttggtggtaagatcttgggcaagttatccacttctatgaacttgactccatctagcacagtaaaaggactgtgaaggaggaattaatagggaggcacaaattaaaagaagaccagtgagaagctttgggtttggttggattcagttgaatttaacattagatatttgggttatctgggaagtttgattgtggcaatttttttttttttttttgagacagggtcttgctctgtagcccatgctggagtgcagtggtgtcttcatagctcactgtaactttgaactcctgggctaaagggatcctcccacctcagcctccctagttgctgcaactataggcacatgccatcttgcctggctaatattttattttttgtaggcttggggtcttcccatgttttcaagactgtggcaatgcttttttttttaaagcatattatttactatagagctttatagaaatgttaaataggactattgtttagttagtcccatttctccttgcactgtgaacgtggaaccttaaaaataaaagtgttggcatttaaaaaaagcttgacaatgcttcagtgaatttaaatatatataatatatatatttcaatacttgacactaaaaatattaagagaaaatatgagttattatgaaaatatctaagaacgatgtatttggaattattattattattattattattattattattattatttgaggcggagtctcactctctcgcccaggctggagtgcagtgttgtgatctcggctcgctacaagctccacctcctgggttcacgccattctcctgcctcagtctcctgagtagctgggactacaggtgcccgccaccacgcctggctaatttttttgtatttttagtagagatggggtttcaccatgttagctgggatggtctcgatctcctggcctcgtgatctgcctgccttggcctcccaaagtgctgggattacaggtgtgagccaccgtgcccggcctggaattattttaataatctttggtcatgctgtcagttaactttatggtaaataagtaattggagttttaactgtagaatttgttttgttgagattcattgcaaaactgtgagactactttgcaactccgtcttgggagattggtgttgaatctttctggtaaatgtttgatttggatgttaagctaacgtttgcagggcccctgcctgttaacagctacctgggctttgcctgtttggccttgactcttcttcctaacctggggtgaggtctgcaggatccatgtgaggccagatgtgctccatggggagagtctggtgggcagatcctgagtgatggacttcccatttctctctccttctctgctttgctgtcaggagtatctgtttgtctgaagcctgctgattctttctgttcctccaacttcctttctgtaatgccagttggtagctttggctttaaaatgggcaaacctcctgctctcctggttcagaattagtgatttttatcctttcagggatcatgctgtggaacacacagcagcctgtggagtctgctaagcccgattcacaatggagcattgatccctgctgctgtgtggcaccctggcctctgcagcatacacatgcttgggccaggatcaattttcagtgggttttaggtctgacacactggctttagtttatagtaacatcgggggcttgtgtctgcctaaccccatcctttataaagtggggatcagtgccttacagattttgatgccaacataattatttataaaatcatcacattacataagatgtgctgtttttcttttttcacacaagaaatgattttcatttgatgtattgatcagtgtagttactgggaattgagcccaatacatttattcttttatttgagatctgctaaaattgtctcttccttcggaagactgaaaaatgatccaggttgtgaatgagttgttccaattcttttcatgccgagcagggctttacactaaatttgggacctgaggggccagatttaggatctggagggttaagagtgagacacagcggctgcctggccacatgccagatgcaggaggtaaggctggaggttcgtgaccagtttggacatagctgctgctctggtaaaacacaaacatcaacaacgaaaacttgattcctgtggaatatgtgctataatctaggaaacagagattctctggtatgggaaatccttgaagtcttggcattagtgacagcacctggaaatactcattccaattcaaatgagtctgaagtgggccctggaggggctgcatggggaaatttgcaagtggtgtctgtgccgggaatgttaagtattgatggtgatgctgaatttatgaatatggaaagaatgcgtgtactcagaaggaggatgcaaacagattttaaattttattttgacattaccttccagtgcagtgcatggttagcagtaactgtatacagaaagggccacagaggctttggtttctgaaagatgtctgggagctgccctgttcacctggtgccatacttcctcagaaatacagaaagagcacgcagcagccagcaaaggtgtacttcagctggtgtccctatttcttctaatttagtgttggatggaatgataaaatagttctaatatgctcatatttgtctgtggtagtacacagtaattttcagtttatttgatatagctgctataggtcctcaaaatagagttttgaattttctttcttggtgctgacaaattgataccatttggaatacagagaaaaagtttcagtgcaacacaggtgaattttttaataggatatactaagtaagtttaatctctggcagggatgtctgatcttttggcttccctgggccgtgttggaagaagagctgtcttgggccacacagaaaatacactaacactaatgataactgatgagcttaaaaaaatcaccaaaaaaacccatgttttaagaaagttaacaaatttgttttgggccacattcaaagccttcctgggctgcatgtgtcctgtgggccatgggttggacaagcttgctggagtattaataaatattgtgaagcagaaaggctgtgcttatataaaattttgatgataaattcttagaaattagctgtatttatcacactcattttcttttaagaaatcagcaaaaatgtcccccccccacttccgttctagtaccatactttgtagcaaagagtttttggaaagaaaagagattcttgttcatagcacatcatcattcttttctcctatagatgtataagggaggcaaggtgaaaatgagctcgtctttttaagctcttgtcgtgaatcgaaccaaatctctttggttattttaaggattatttccttggttattttgcagagttccagttgtgtgggatgagttaatgttaaccatacactacttatttgcaatgttacctgttgtggacagctctggttttgcttaagcgtgtgaggttcaggccctcattctgcagtctgaggctgtggtagtgatttgggagaggtctgccgtgttgtcagcccagccctcccagtccagctctaccaggcaagtcctcctctcctacttaagcacagaccaagagctgacatgggattaggtgatatgtggggcctggttcctgccattgcagagcatgacagacagggagagggtgtggcttgaaacctgggaaccttgtttctggggatgagcaggatgtaggaagtcaggaaggcagggagcttttctggagtccctctcaaagcagccactccctttactggtctgcaggaccaggcagagtgggaagtgggaggtggctgctcagcactttgctacctgttgtctttctgaactgaagactcagaccatctttgaaagtcctgcggatctagtggcctgcactgggtgtttggaggaagactcctctcgtgaatagtttaaagctagagaagcaagtggttgccattccttgttccctgggactggtaatttaggggacccttaggatctgcacaggtccagaaagaagaggcatcttactgtggttgcttctgtggaagaagaggcatcttaccgtagtggcttccatggctgtgatcttggatgggcggggccagatggggaggagacagcagggatttggcttctttttctccccttcccagacctgtgcggttggagagcttcttatcccagttagcagagaaggtaaaatctgaagttagcagagaaggtagaaatcatttttgatttttttttcatgtctgactttgaattgttgaattcatccaagggtaaatattcctctgtataccacactagccataagcacacagtcacatatactgcacattagatagagcgtgatggtgacttacaggtcctgcttaatggaggtgagcgaggtggttttatgttatttggctaatttgtatttgtttaaaggataactaggctgtttcccttgcccttcattatctttctagttcataacctttttctccaggcacagaccttggctttggttgagtggggagggaggatgtcttgttttctttagtctgccttacagatgctggaggaagctccgttgttactttcaggtccctgaattccccaaaaagcagattttaaaaatcttggccatggattttctaccttgttttggtggaaactgctctattggaagttgcctgactccacccagctcatctgggggctcccagaattttacttgtaacccatcagatttgctcttctcctgcttgtagacactcaggtgcctaacctgggaggttttcatgggaacttcacaaaagacttcagaaaggtggagaaggaattgccgtttatttagtactcagtgtatgccaggccctgggtgcaaagttgccagtgttactgcatcaaacattctcaccagctccttaagggagcttaaattaacacaattttaatgatgcagaaactgagatctggagctgcgaggaatagagatagcttaagcatgtttattacagaaattctcactgcaaccagttgctggttcttttcttcactcactggcatgtggaaaaagcctgttgataaattgtgataagaacgactgatgtgctggggtgtgccgagttgtctcttctgcacatctctcctctcctacttaaggagaggaggcagctagcctagcctagcctaggattaggctggagcttgcactcgggagccgtatttctgggttcagatcttgacaccacaggccttcttgtgtgacctcagataaattacttaacctctttgtgcttcacaattagtgatgtttgttaaataaattaagcagttgagtacagttctagtgatctcttaccactgaaggggcaaagatttctcctgcatgtgccagcttgatctggcagaggacagggttgtgaggccctctctgtgatacgtgctaggctgctgagtgctaagatgtcactttcctaaaataagtgtcctggatgccgtaggcaagccactcattcctcgctctgccttcctcggagcactgctcatcctctcttcgtatatcaaagcccccacactgaacacgatttccttttgccccgctgtctgatatttaatcccgaatggtgtagggggtgaagagagtggagtgaggcagtagccagcttattacagctccagccttaccagctgcctgtgtggtggccttttagggccattgggccctcctgctctacaggatctctctcccacctgttgcagtaatgagtgaaaccctaaagcctttcactccccggtcagacaagatgctgggaaggcagcgttcctgggagaggcatcaggctgactgatattcacatcaaaggaacgaacaactcctttctttctgagtaggctgttttagagacgacaggatagacataccttgagagtattgagatgacttgggaaaaagaggcatggatagtctggagatacaaagaatacttttttctgattcaggttttatttggggccagcatgcttctgcacactcctgacttcacacagattcaaatacagcttgtccagaacaaagacggtttctactaattttttacattccatttttatgaaacattctcagagttccaaggaaaagagaatcctgttgttctgtgagattacattaagaaccactatattggttatctgattttctttttctttcctttgaagctctacattgatctctggaattaatgtcagtgagcttttgaggtctctaaaatgagaatgggaggcacctggctccttttcaaccccgagaagttgaatgaaattggtgtggggatatctgtggagtcagatttcctttggatttttcatttaaccccttgagccttgagctaaaggcactgattttgttcatgaagggcctgctcccattcttgcgtcccattcttgagccatgctgactggagatgaccggtgacaaccacatccaactgcccacagctgtcttcgggaagctggagaattagaatagtattgtctgctctgaaacagcctggagaattttagagctctctgggagcagggtggggtatgggataagggaagatgtgatgaaagagcagcctttcccagttagaacagatgtaggaagcaagcaaccccagaaacatctggaaaactcttaaagtgcaggctagtccctgtgcaccccataaggtcgactgattagaggcagtggaggcagatgtcagggtcagctctctaggatgcccttcataattcctgttttcttccccagggtatgtttgtgctattattaaatgattacacatgcttgttcattccttcctagtgtatactttctagctaatgtcatttcaagctaaaaataagtctggtccttagttagagttcctgagatttttctgcccagccgtctgtctttctcctgagatttgggtcttctcacatcatagtgaagtttatcctcctggtctgtctttgcatagctgtaaatgatgggagattctggatgatgagacaaagttcccagctcactacccagctatgacctgcatagggggacagcagcataggtagtcctgtggcgaagcgttggcctggaggacaggcctaggtgctcactaggtgctcactgcctggtgctttggggcgccatttcccctttcggagaaccagagtcctcttgcatagaatgagatcatggaatagcagtgcattctagaaactgcctgtctccttttttttttttttttttaaaggcaagccctgtcttcaaacaattttgtatggaatctcagtttaagaagatatttactgtccgtggaactgacaaccattgcaccccctcttctcttcatttgctggtgtggttcccaggcatgcctgcagttgagggcaagacagtttctgatctactgccattggaggatctcccaaaccctgtgagctcttgagtgtctgattactgcccagggatgaccattagccttgagttagggagagtatttccacagaggtgagaaggtagttcccatggattcctaaaggtttaggaggaactggcctcaccagatggtgagaattttgctaatgatggctgctaatgagggacacttcccatgttcctggtaataagagttgtggcaattttgtttccttgggaacgtcctaaacaaatgacttacactattctgttagtagtgggaattggaaggcattttcatgacagtgataattatattacaaacatcaacagggagacccatcagataaagtgggataggaaagaacaagacaacacctattgggcattttgaaaagctgataaggtaaatggtcattttaagaaaggtctcaaagactccttcaactagaaaacttcttatgctgaccttgaaattagggcaaactgacaagaacaacttatttgataggaattgctgggttttgcacagtggttctaagtgaggttctcagacttgggttcctgtgattattctcagccaacatgaatttcacgtaatttttaaactttaaaatctgggtgtcttaaagtgttttctatcatttatgaaagtccgttttagaatttttttttttctagtattaagtcagtgtttctccaaccagtgtcctccagaaccctttaagaagacattgtttgggtccttgaaaattatttttcttcaaaaattttctgaactttattcaagtttgagaaatacagactaggagacaggctggggtataatcatgtgtcacatagcattgttttggtcaacagtggaccacatgtatgaggacacatataatcccatacaattataatggagctgaaaacttcctattgcccaatgacatcatagtcttcagaagattgtagcacaacgcattatttgtgtttgtggtgatgctggtgtaaacaaacctactgtgttgtcagtcatataaaagtattacacaattctgttcagcacatgattcttgataataaatgactatgttatagggttatgtatacttttagattgttattttagagtgtactgcttcttctaattaaataaaaagtaacctgtaaaagcagcctcaggcaggtccttcaggaggtatctagaagaaggcgttgttattctgggagatgacagctccatgtgtgttattatggcccctgaagaccttccagtgggacaggatgtagatgtggaagacagtgatgtggatggtcctgaccctgtgtaggcctaggctaatgtatgtgcctgtgtattagtttttaacaaacaaaaaaagaaaaacatatataaaagagcttagaaaataaggatataaagaaagaaaatatttttgtaagctgtacaatgtgtttgtattttaagctaagtattattacaaaagtcaaaaagttaaaaaaaattaaaagtttataaagcaaaaatgccacagtaagctaaggttaacttattaaagaaataaaaatatgcttaaaaaagtaaatttagtgtagcctaagtgcacagtgtttataaagtctatagcagtgtgcagtaatgtcctaggccttcccattcactcaccactcactgacccatccagagcaacttgcagtcctgcgagctccattcatggtaactgccctatacaggtgtacaatttttatcttctgtaccatatttttctatgtttagatagacaaatatttgccattgtcttacagttacctacagtattcagtgtagtcacatgctgtacaggtgtatagtctaggagcaataggccataccagcctaggggtatagtaggcttgatatggttaggctgtgtccccacccaaatctcatcttgaattcccacatgttgtgggaggaacctggtgggaggtaattgaatcatgggggcgggtctttcccatgctgttctcatgatagtgaataagtctcatgagacctaatggtcttatgagggagagtttccttgcacaagctctctttgcctgctgccatccacgtaagatgagacttgctcctccttgccttctgccatgattgtgagacttccccaactgtgtggaactataagtccattaaaccctctttcttttgtaaattgcccagtcttgggtatgtctttatcagcagcatgaaagcagactgatacaaggctctaccatctaggtttgtgtaagtgtactttgtgatgttcacacaatgacaaaattgtctaactatacgtttctcagaacgtgtccctgtcattgacacatgactgtaactaagaccacaggttacatgaattcctttcatatgtgtttggaataacatgtttttttgctttgtctcatttttcagaagggagagaaagtaaagtgaactaatttgcattgtgtatgtgctctgtgtgtgtgtgtgtgtgtggtgtgtgcatgtatgacaggcaatctactgttatgctacagtttacttttgctctcttttctgaataaatgtgcaaaatgtgtatggaacctgttgtgaaggtgctggccacattttctgatgctttaaggacaagtgatccttattctgcttgagaaatcttcacggcctcatttttcactgcatcagataatttaagtctacgttctgggcattcctcatgccgatttcttcttacagatttatcgcactttctatgattcccaacatctcttgaccaggctggtcagacctgtctctcaattgttccacgattcactttgattttatcagccttggacccttgcttcatattagacctcttatttaaaatgtcttaccttccatttatctaaatcccaacttaatgtttggactaagtcatagctcttcagtgaatgggagtgaagctgtacgaaatcattgcattctagccaggtcctccaaaattggatatgtgagaaagagaagctgaaatgcccttctctgtaaggttctcactcatttctgttgtttctttcattttggcttcagggaaggtgtaatttcttttagcattgtgtaggtgaggccagtcactgcaagaaggctttgtaaaataacatgtaactaattgggcttacaaagtggaatgtacctagctcccatcgagtagaagggagggttcccttcatgtgtttctgccactcatgctcccagctcctattctgcttccatctctctccatgaacagtttataggcaggagggcaggacctggagggtaacagaaatcgccctcttacctggctcaggaaaccagcgtcccatctgtgattcagttgccactgtagtgtttatccacttgagggcagatatcaccccatgtgcctgggaagataggtttgcttatgacctcaaaggacaattggagggctctcaaacttgggtacctatggtaattcagatacaacaccaagcatccaacaatcctgtaaggatgttgcatggagattttgaagactgttcatttaaaaactcccccagtcattctcttctctcagctactccatacaatttaatccttaattatattttgtcatgttcccctttttcatacagtagatgctcaataatgatttcagtcatattgtttcttgaaataaattgaaaataccggccaggcgcggtggctcacgcctgtaatcccagcagtttgggaggcctaggcagatggatcatgaggtcaggagatcaagaccatcctggccaaaatgctgaaacctgatctctactaaaaatacaaaaattagccaggcatggtggcatgtacctgcagtctgagctactcaggagactgaggcaggagaatcagttgaatccaggaggtggaggttgcagtgagccaagattatgccactgcactacagcctgggtgacagagcgagactccgtctcaaaaaaaaaaaaaataccctgagagctgggaccatgttgcctatgcagttatccatcagtaaataaacacttggttgattccagtgcaaggaaaaggttgacccagtttgattaaccttctggggtcagcagattacttttgtcccttccaattggtttaattcataatgatttttatttgtatcaggtagataaattataatgttgcatagatggaaaatgctctgttgaatggaaatctgaattttccttataaggcttaacatttatagtcttactgggctgctagatagttattggaaaaaagagaatgacacgttcatgacttagtggggggattgctgatttgactcatttaacaatggggtctgccgatggtgcatacatcacagataggaaaaatactttttcttccaccctctccagaatactttagggtaaggagaaccagagaacatgtgttaaatgaatccaaatcaaacctactagttatacaaatgatttaagcgttattgtggaaatttacataaaactcagactcagcgtaaaacagtacaaacaccaaggccaaatgagttaccacagtaataaagtacacacagggcaacgtgcctgtgatatagggaaggctgtctttaaagtacttctggaatgtcagtttcagaaactgaaaaagatgctagaagtttgattttgtgtgatcaaacatcatttagaagctaaggaacagaaggaatattaaggtacccaaagaatattaaggaacctaggaatgtttgtgtttggggtgattagagcttcttgcaagcttagaagtaggaagctaatgataagggatcataaaaagaacaaaatagattgttttaactctgaaggattgtctttttctttagagaaaattggatcacttataggcagccaatctgtttaataatctgacttttatcatccccaaccaaaacatccagatgcattttgttgccttcccctgtctaatgtgaaatagtggttcagtatactgttcatttttcattaagaaattgtcagctgctgttgacaaacaggtaatgagtttgacacaggatcgatgtgctgtcagtcttgagcacaggcatgtgtttatcttgtaaggtggctttttgcatgggcttaaagagttgtttttgactccagggaacctatgaataaacttcattctaataacggttttacaagttttgtcaagtttttaagagagatgatcagttttttgaaccgttttactttttagagggagtttggagttgagaattaaactttgatacttcctgttgtccatcccctagccaacacacacattattataataacatttaccgagtggcttttttctgtatgttaacatttacattgatgttcccatagattataattgagaatttttaggaaggttcttcaaaatcgtttgttgcttaactctgataatttttcaatttgggcagctggtttgattttgcctaaaacaaaaacctcatcatttaaatacagttactttaaacaattaatgtaacaataaacaaaattcgggaactgtaacaggaaaaaaaatcacccatgatcttattatcagtaaagcactgtcatcatttctatatttttcattctctttttttcaaggatcatgcttagttttgcatacacacatggaagggcaggctgtagcaggaagagagacgggatcactcgcccctttctctttggtggttgaggctttctagctgagtgtagctggctctccgaaaggccctgtgtcatgctacagagactaggtccattccccagtacctctccagcctagtctctgaggagccatccctgtcatctgggaggcctctgccttccttctctggtacatggaagcagcagaaggaacaggtgcccttctgtcttctcttgagaagtcctcccctcccttcctgtaaggtggcaggcctcaacatttttggcaccagagactagtttcatggaagacaatttttccacagatggggtggggtggggatggtttgcaggatgattcaagtgcattacatttattgtgccctttattcctattattacattgtaatatataatgaaacaaatatataactcaccataatgcagaatcagtgggagccctgagctggttttcctgcaactagacggtcccatcttggggtgataggagacagtgacagatcatcagggattagattctcattaggagcgtgcaacctagatcccccgcatacacagttcacaatagggtgtgcactcctatgagaatctgacactgctgctgatctgacaggaggtggagctcaggcagtaatgctcgcgagccgccactcatttcctgctgtgccgctaggttcctgacaggccgtgactggtagcagtccatggcctgtgggttgtggacccctgatttaagggacatcaggaaagtccagctgggttcctgttaggatgctggttttttagacagggtctcactctgttgccaaggctggagtgtggtggtgccatcactgctcactgcggccttgacctcttggtcaaggctgtgatcttcctgcctcagcctcctgagtacatggactacaggcatagtgccaccacaccctgctaatttttaaaatttttgttgagttgggggtctcacagtgttgcccttggggtcttgaacttctgggcccaaggtatgctcctgcctcagcctcccagagtgcacccaaacgtggtgtttcagacatgccacaatgctccactgcagatctcactccacacctgaccaggggagcagcccaaggtcttgggatcactcacccctttctctttggtggttgtggctctctagctgagtgttgctggttctcagaaaggcccagtgttgtgcggcagagactgggtccattccccactaccagcccgggcacccctcactcgtgggcccgcctctttcctctttgtctcccatccctggcttggtttcctggaagaatgccttgagagaagctgcagccagtttgtgctggtgaggaaagcatagttttcagaagcttgtcctctggtccccatcctgcctgtcttcccacttggggtgggaggcctggggagatctgcctgttctcactcgcatggccaagctgatcctggtgtctgttgtttgtctggcctgctctcctggccagcgcccaggatgtgcttccttagtgcttccacatgtgagtggctgggctggggtgggttagtcgaggttgttctcactgtcagcacctctctgatcaaacagaagtacagagagggaggttctgcattcacaaaaaatcagaagggtattaaacgtaatatgtttgagtagatgccttagaaatagaattcacagcagaatgccctctttccagtagagaataattcaggaccccatactgtagcatggtggagcatgtttggaagtcacccatccccattatcagtggaagtgccgagatcattattctgagcacaggatctttttctaagaggattttatggttttaaagggagtttggaaaagggacatttgggaagcttgaagtgatgggacagaaatatcgatttgtaggttgaataattagactcctcctcgatgttcaggtcttgctgcagtgtcccctgcttgatgattttctagtggctgcaatatatgaccattatacattgcagaagttatagttatttgtttaaacacctttctcctctgttaatctgtaagctctttaaaggcataacctcccctttttcttttatttccctggagcaactattatacatacaataaagatttattgaaatgagtcagatagtgtcttcttatttttgggaaaaaacatagttttccagagtaaatttagaagttatttgcttaattgaaaaaatataatccttaatcaaaaaacttaattttaaagagggtttgcaccaagcttaaacactggtgtgtgtgtgtaaatatgcatttttaaatgtaatatatgtgtttctttctcctttccgctggtataagcatttcgtgagaagaggataatcatcaaccgcttgagttaatctgggggaatgtctgggaagtgggaagttgaggaatgccgcattgttgaatacattgagagcatttctggtttcaatttggtttacctactcttggtctgggagatctggaatgctgccctggactttcggttttgtgtgaattggctctgaggaaaaggattgctagaattagctgttggaatgaggagcggcagagactgggctcttgagaagcgagtggactggaatctgttctctgagatgttgccttgaatctgacttgttgatgacagacccatattggaaatattattccactgttaataagaacattttattttcacatgcaacttgttaaatatgtagccaaaaatcctgaaacaaaacaaaccccctctccactcaaaaaacttttctggaagtggttacttaatagtgcacatttcaatagaccgttgaatgaaacactaagataaagaaaatgttccctgagggaagagtcctgagttaatggcttagaaaggtgttgtaatcaactaagttttcatgcctctttcttcttctcattactgccatttcccttattctgatttactgattatttttttgaataatacattttaaaagagtatttgtttctctcactttaactcagatttatcacagtttgaaacttctatttagtatagtaataaaattagttttagtaggagtagtaaattgaggatgtgacaagtgaataaattactgaaggctcaaaacaaaaagcaatacaaaaaacctgaaaggaaaaaaacccaaaaataaatccccaaacctgtttgcccacatctactatctttcagaaccaagtaagaatctcagttctgcagcacctttcctcgttcttcttttcatagtttgtaccctttgatttgtgatgccttttacttcaccccaaacccccgtgacatttaagatgcgtgctatacaaaatacggttcctggctaaccagcaccataacgcttgttaagctttttctattctgcagaggcgatagctctgaaatatagaagtgattgcattaaatccttggctggcaattttgtgtgggattgggtattgaaatgcagcaaagcaaataatgaaggcatatgtttacctataattcttttttaccttgggagaaggattaaataggaacagtttggttgttgtcaaattcttaacagttgctttcaagcatgaaacagtccccgggctctcggaggatttacttagcagtttgaatagagaggtctttactgctaatggaactgagatggcaggcttaagcaatggggtgctttatagcctctttagccacttgagaagatgtaacatcaaatagctgaaaccatcctgatctccattggtgtttaggaagttgtgcaaagattggtgaataaataattcagggttgtatgaatgtctggatgccaggaatgttgagagtatctaaaagcttgattcacagaggatttagttctgggagaaactctggagcccctccttgagcttggcaccagggaacatttacagatgatgacattttctaagaaagaaagaactttcacttgggattgactgggctttgtaaagcaacatttcactggggactccagtcccggaaaagtcttatttgtaaaataaagaatattttcagtacagatggttggcagttgctgctgtgtgtgtgtgaatgtgtgtgtgtttaaaatacaggatggtgatgattatttagggtcttaaataaccatttaagttctgtactatttaatggttaagctttaagaaatcacttgttgaagacacaggggagaagtagtcacagtttgtctgttgaagcttctgcttcacgctctcgtcatctgtttcagaccttagtaaagacgtcccgaatgtgttgtccaatgaacaggtgggcagcaggtgttggggacccactggatatatgaatattcacaaatattcggactctcctcctgcgcatagagtagatagcagttccctgttcatttggacataggcgtgaccatatgacttgctttggccaattaaatgtcacttctgagcagaagcaggaaagctcgtgcttgtttcaccacatcctgtgccatggaaacttgcagttgattcttcagccccagggtgaggatgacttggaaaagagctcccagctgatggccagtgggcatggagggtgcacaagaagtgatatgttccttgatattttgtgattgttactgcagcatgacttagcctgccccgatgcatacaacctataaagtactagatttttctctaggagaaaaccactcaggcggtccatgggtgtttccctaccttaggctgaatagagaacttcccatggtgatgtggtggacaggagttagggcagagaaaccgctggctgctacacaggaaccactgtaccaggcattggcctttctcctttgtttcttgttgtctgtttcccataggtttctacaacattctttctcttcctgcttctacccgctaagtctgtttctatcctttgcatggtatcttggtgggaattctcaattttatgctaaccaaacatggaaagcagcttctgttcttccattacatgactcagaatgcctggacccccgacccctcttctctgccacagatgaggacaactctgtgtcctagagtgggtgaaagtgcttgtaattgccaagtgagggagattcacatgctttcatcaagccagagctgggcggctggggaatcggattctagacctattatccttaggtgcattgcagtgcttgagagaatctgcttttcacaaatgttttccactcttcacaaaactcttgggaattggaaatataatgcacactttatagctgggaagttgaggctcacagaaggtaagtactgtgctcagatcatcacatggacatgatatcactgaagcagctccaagaagtctctcattccaagatgtacactctttctactgctgtattatacacttctgagtgtgattaaataggcatagttgaaagaggcagtaatatttgaacctatcaaaagccagttcaaatagatcataacagtaatacagcaacaataaaataataataggctgggtgcagtggctcacacctataaccccagtgatttgggaggctcaggaggattgcttgaggccaggagtttgagaccagtcggcaacctagtgagaccccgtgtctactaagtaaataaataaataaataaacaaaactttataaaataatagcagctaaaacttacgcagtgcttattgtatgctgcaatattctaaggcctttaaatttattaatgcatttaatcctcataacactgtgagtaaatattcatatgaggcagtagaggcacagagaggttaagaaacttgcccaaggtcacatagctaataattggtaaactgggatttgaacccagactctagaatccttgatctaaagaacaaatgtttgaaactctgttaaattaagactaaaagagtattttttaaagaagagcagttttatgttcacagcagatttgagaaggtgctagagttcccatatagccctgcccccacacatgcatagccccccattatcaacagctcccacagagtggtgcattgttaaagctgatgaacccacattgacatgccgttatcacccagagccacagtttacattagtgggccacatttgatgttgaacattatgtgggtttggacaaatatgtaatggcatatatctgccattatagtatcctacagggtatttttactgccctaaaaatcctctgtgctccatctatacatccatcacctgattccaacccctgacaacgactgatctttttgctttctccatagttttgccctttccagaatgtcgtatagttggaatcccaaaatacgtagctttttcagattgtcttctttcacttaataatatgcatttaaattccctccatgtctttttgtggcttgatagctcatttctatttagtgcctaataatactctcatcatctgtatgtaccacagtttatccattcacctactgaaggatatcttggttgcttccaatttggcaaattctgtataaagctgccataaacatccatgtacaggtttttgtgtggacataagttttcaactccattggataactatcaagaactgtgattgctggatcatatggtaagaatgtggttaattttgtaaaaacctgcccaactgtcttctaagtggctagaccatttctcattccagtgatgaatgagggttcctgctgctccatatcctagccagaatttggtggtgtcagtgttcgagattttgaccattctaatagatgtgtgagaagaatattctaaaaattgaatttttataaataataacatggcctgcaatttctgaaatacgtagtgtatttgttctttttttttggtttaagaatcctaaaatatgtactgtgtatatgcattattcctttatcgatcaagcttctagctacttcctctaccctctcacaccctccttaccatagcagccatggttcatggtcaggcctctcatatgctgctatgagaggaattgatactgggctcccaggggtctatactgggttttctgtggtctgtgctggactcccttatttacctgttttgtcctttcaaaaaggctattaacagggctcttgtctgtatgatgtaaacaattagaaggaaggacaccctagataaataccttgggatggtgctgaaatttgttagtcatcaagagatgctgtcctgtggaaccctagggagtcagggtggttacagaatggcaagccccaagtcaggcctgctgccctcctgcagggctggagaggacagtgagatgggcataggagaaaatgacgtccctgctgaagtcagtttcagcatcaggcagcaggtacatggtgctgctaggggagtaggggaaggtagattcttgtatttttcttttaatctgagagttgagagtgaaatacttcactaggcccagctttgtgtatgtgtctgttgaggagagagaaagagaataaaaattgggcttgttgaaacaagccaaagttcagccaagttctcatctgaacctctaatccctccaagattttttttccaggcataagaagaaaaatcattttctaaaactttccatttctgatttttctgtgattctgggcagtcaaacttgtgtaaaatttttatgatacctttttattttataaattctcagcatgttaaacttgcttattttagtttgaatttttggaaattataatttttctattactcttcttggcataaggtaatttcttgttggggtgatattttacaatttagttacttaaaacgattttgcttttagtgtaaatcttacctttttttggaaaaatatgtattgggtgtcagaatcactttgtttttaaccctttttctgattatgagtctaatattgttattgtaggaaaaactaggaaataccagaaagtattaaaaggaagataaaacatactacctactcaaagtagcactactaacaatttgttgtatttttgcagatttccatgcacgtatatatgtattatacatgtgtacttactgttgtgtataatagtgaatacagctatataggcagtttttacagcctgcctgtttcagtggtcgagatcatcatgatttttccatgctttgaaatagtcttagaaaatatgatttttaatagctgcatgtgactttaatactattccataatttatatattattttttgggttgttggtatttaggctcctaacagtttttcattattaataatgttaccttgagtgtctttgcttgcattttttatgaggcttaacagttcaggtaagaggcctagaatattaaaaataactcttattcacaagctcctcccatgtgacaggtgtttgacactttacttacccccagaacaagcatgtgaggtaggtggcattgttcctcctaaaaaaacaaactggtggctgcaagctggtcagccatggaggtggacacaggactttctggaccaaccccagctctttcttgctgcactgttctgccttgggcacacttggagtgaactgtgagaccaaattatgagagaaggactatagaaaatcatgcagggggtgggggtaactattatgatgaaacatactggccagtactggtggatctgaaactggatcaggcggtgtatactggaaactattatacagatcctctttcccctgcctctgggattttacattttaaaaataaggtctcctgaagcaaagtgatttgcctgaggccatacaactaactatttatagcggtgagtgggaccttaactcccagcaactgcttttcccagcaactgctcttccatgttctttccactgtgcttgactctacaggcttcccaaaggatgaaggctagaggtctgaactctgtattcataataaggtcagagtacatccttaaagggacatctcccctagttatctagtttgaaatcagttagcctctactgaactatgaggatggcagtactgtagactgactgactggattttgatcctagttctacctttttcttgtcgtgtatcctgggcaagtttcttaacctctttgtgcctcagattctgcttttttttttgggacagggtatcactctgttgtccaggctggagtgcagtggcgtcatcatggcttactgcagccttgacttcctgggttcaagtgatccttctcccaagtagctgggactgtaggtgcgtgctgccacattcagctaatttttgtatttctgggtagagatggggttttgctacgttgctcaggctgatcttgaattcctgagctcaagcaatcagcccaccttggcctaccaaagtgctgggattacaggcgtgagctaccgcactcgccatcagattctgcttttattaaatagagacagcagtagtatctactgcatgagattgttgcgaaggctgcatgaatgcactgtgcagagctcctagaacagtgctgggcgtgtagcaagcctggtgtaggtgtagtgagcctggtgtgtgtgtggcgagcctaatgtgtgtatcagctgctgctgctgagtaaccaggcacattccctctgctgttcctccattagctactattttcaaggaactcaaaatgatcactttttgcctctaacagaatttacagaaactctacaagagcttgaaatgcacctatagtggtcagggagcgtatatatttagggagagtaataagataaaatctttcatgaaaaaagcttttagaagactaagaaaacataaaggtctttttaagcaggcatcagaatgtcatctcgaatctgtttcctttgtttcttgataggaaagtagttaaaacaacctaatagcttatcaataaatcagaagtttccagatttcctgatttgcttttgcttgctagtaattttcccgactcttatcaaattggatacaaatagatgtttttaaaagtcaagttgcccacactatttgattctgtttgctatttttggcttaaaaatgaagaagaaatatggcctaattcttgccctgtggtgaaattatattgcaaggtaagagaatagaaaataaagcttttcattatcacctctccatgacctcttgaatgaaaaggttgggagtttgagaggttctttttttttgagacagagtctcgctctgtcacccagactggagtgcagtggcgtgatctcggctcactgcaacctccgcctcacgggtccaagcgattctcctgcctcagcctcctgagtagctgggattacaggcacctgccatgatgcccggttaatttttgtatttttaataaagactgggttttgccatgttggccaggctggtcttgaactcctgatgtcaggtgatccgcccgcctcggcctcccacagtgctgggattacaggcgtgagcaacagcgcctggccaagggggtttgttcatcaagatagacttcctctgtctctatcaataactggcaaagttgcagtgagaccagttactagtggtcagtgtgtgacattggggcccatgagcctgggtttgaaacccaggtcctcggcatccagctgaaacagccgtttcagcctctcagcttcattttcctgtaatatagagaaaatacttcctactgtgaggctaaaatgccttaacattcataaaagcatctaatgctaggctcttgtaattttagcaccttttcctctgatgacattcactgggaaaaggaaaggctctgtagccccgtcttcagaactaaattctccaaagcaggacttcattctaggcttgcttttaaacaagattatttccatataccatccaatcaggtaatatgacataggaaatgcccttccctctgtgagacatgcactcgcgtttggcaaagactgtggtcaccaccttcatttaaaagggtttaatgatctttggactttagcagactccatagagtacagccctgatggacagagtttaggcagagagaatattttccatttcataatctcatacacagggacctaaattccactatcagggacttctttaatgactccaactgtcagcctggacatgagtgacctgaagaacctgtatggagagtggaaggggcatacagatgacttctgctggtatgaccctctcccctctcccagccacacagctggtggcttcacaaagagctaggttagcagtgaggttgtcctgtgtacaatttcagtgccccttgctcagggtctaagcctgacccatgttgctgcagattgtacactggggttatctgggttatttatttatttttagagacaggatctcactctgtcatccaggctggagtgcagtggtgcaatagctcactgtaaccttgaactccagggctcaagtaatccccccaatttggcctcctgactagctgggactgctcctgagtatctggaactcctgtgtaaacattttaaaaatttaaaatttttgtagacacaaggtctcgctctgttgctggggctggagtcgggagatttttgacacaattccgtggtttatccaatccatgcctgcacctgggagtgcatcacactcagctcactctcccctcggcactatccccctctgcaggtggcttagtgtccttcctccaagcagagggacttccctggtctccttcctcttctcgaggttctgggatgactcacactgaaatattggtggaatgagaatcccctgtggaagttgttgtttccatccctgccatttctactcacctcctgacctcactgacttgcacaaccagccaccctgtcattactctgggtgggacaatttcccttttcaatttttggttatcagatgttaccatccttttgggcctccggatatgggccttttcctttgcagggttatagctgtctccctcaaaggcttggtttagtccagcagccaggcggggaagcattttattcctctctgtcctgaggcatatgtcctgaaaccattctgttcttggcctcctcagcccttgtatgagatcctgtcttcccagagaactggcccttcccagtgaccacccatctttggggtaaaggtctttatcctcatgtttcaggacctgactctgggccttagggtacatggaaggagggagatttggggacacagaatgcccagtaacctgcggtgaggctcggttcattctaggaagtatttaggaagtattttgcaggccttgtgctaagggaatgtgaagatgagaaaattcggcgggcaccagaggcatgggagttgagtacttggctttgccaatgttaaatgcctccttcaacatttcagacagggaatttttgtagtggagagtagagctgaactttaactcggtgatttttcctgacagaaggtcctctctaaggacagcaaggaaatcaacagtagcagttagttaggaaatggggtgttgtgcggtgctacagtgactagagtcagaaggagttccattgattccaaataagaggccctgcacaaatggagattctgatgtatgcagctctctacctgtgtctatttgaaaacaaaaagccaccttattttgtctaaaataatttgaagaatttttagatggccacatgacaaagataccatttcaataagtaatataaaaaatatgtggtgtgaacctgggaggcggagcttgcagtgagccgagattgcaccactgaactccaacctgggtgacaagagtgagactccatcacacacacacacaaacacacatgcacgcacacacacacaggatatgtattctgtgaaccactattcatttctgtataccagactgaatttttaaaagcatttgaagcattcactatttttcacattaatatcaaagcagtaaaataatccagaaacaaaaaaagataagtagcttaatgattctacttaaaattaatgcaactaatgtatttctgttattccctagtgtattgttgttgcaaagtagttactgtctttcaaatgaaagtttaaaacgataactttctgaaaattgcagctatcatacaaaaacgtgattgtaaatcgtttgtcttttgccatttttcttaaaagaattagatatttaaaagatcatataatctgttaaaaccattagttggcattttaagagtcacttcaagaatgtgctttaatttaaaggaaaactaagcttgaattcattttcatcttttttttactatattgaaaattttaacatttcaattctagttttgtccatgactgttaataattcagtcattcagcagataattgagggcccaccctgtcaggcactgtcctaaatgctgctgctgcccaacaaaatagacccaaaatgctggcttcatggagctcacattccatttgtgtacatttctatggaacaggcactgtgtactttccgtgcatgcttgagcaattttaattcttctatcagcccaaagaaggcactattactatcccagtttaacaatgaggaagctgaggttggcaaggttcgcagtttccagctcatctccatctacgtgatgctggtttcatgaccactgtgcagtcacttgctttagagtggtttgaaccattgagttagcttcactgagaagtatcatggaaccacttacactgatattacgaagtatgcttcaaaatgatggtacactcatggaagcagcctcagaggaaagccattaagatggcgggggtgccaatcatgtcatatgagggcaattgtaagatattattgaactaagatcaatgggtacagggtttgggaggaaggattcaggtcaatgtagggaagaaccatctaacctgtccacagaagggatggattgcctaattaaatgccgagattagagaatttagcctcgtggatgtggtcaagaggattcaagcattaggttgatgatcatttagatcagcttcccacacctgctcatcagaatgatccagccacttgttgaaaggatgtgttctggttaccctgagatgttttcattcattagatttagggtggggcctgaacatctgaatttttaatcaacacaataggggacctgttgctgggtagagggtggtggggtataacagaggtcacaaatgtacaaaagccctttttggaggagcatgtatgaaatgttttaggaactgaaaggtcagctttgtggttgtactcaagagagtgaagggcaagttgtattagaaaaaagtagacatataggtgtgagccagaaattggaggttttccagaaccacattaaagattttaagcacaactgaaaccattttagcctagagtaacatagggtaaccagattttgtgtgtgtgtagtgtgtgtgtgtgaatgtgcagacccacacactcaaaatacacatcatatttttaaagatctctcagactgtgaagagaatggacttaaaaatgttcatggaggaggtagagtgggtggcagtggactggttaatagactattgaagtattccaggtgaatgacaaggggacatgaggaggtttttttgggagctaaaatcagctggcctggatggtagaccagatcatggggataagggtaagagggtattcagggtggagagggatgccatttactcacccagggaataggtttgtgggaatgttttgaacgaatggaaattgaggtgcctgagatggccactctgacatgtctaatgggtggttgggtatgtggggttagagctcagaaggagaggtcagatggttgaagccaaaggggtggatgaaattgtcgagggagcaggaagagtgttagaagagggctccagacatctaatgtctggtggtggagaggaggaaaaccaggattcggccgtcaccagggaagcccctgaagagggaggagggtgtttcccaaaggtgatatagacaagagagcaggagagatgagacctgagaagaacagccttggattccttggcctggatgtccctgtgacttcagcaagagccgtttaggtgccacactggaggctgcagggagttggggtgaggaccagagagagtgattatggagactgtctcctgagagatgtggttatgaggaggagcagagacctaggacagtcacttacgcgcaacgtggaagggaggtttttaaacatttttaaaagatggagtagccttttgggctattttgctggtttattttagaattaaaagtgggggaattaaagaaaaaagttttgagtaatgcttttaaagtttcatctttgttattttaaaatgttttctatcatgaactctgaagaaatctttgagaggatgatggatttacattgtcagtctcttatacaagtgagcccttgtgaagtaattttttcaaaactaaagctttgtttttctctccttgagataagataaacacagacaccattaatagcacattttgccttgttatctatgaagggggatggttgcaggcatatagtgtagtgtcacgtgagccagtggtaatttacatggggacccttaggttgggttggcttatgtgccatgtgaaagtgagagcctgtgcccaggatctgatttcctctttaattgagtatcaaattaaattcagagatcccggggactaccggccagaaacattttccctcatcctgatttgcttttctgttctacacttctgtgtcctgttttatttaaaacaaatgtaagactttaattaagaaggttttaaagtcatgagattacaaagtaatcttgaatccaatcctctgtaattttaaccaaatcactcagtatctttaagctcaaaatgtcctgtcagctttaaattgaaactgaatcccactgagaaaatattatgcagtctcatcaaaacctgtgctaatttcttttttgtttttacccatcctttcttaaagaatcaataagcttgcttttctataatagtgattctcagtgttgataactgtgataagatatatttctttccattaactttgctgtaataacacatttacgttcagaactacaaggctgttttttttttttttgtaatttcacgatatgccgggggattaattggtgggtgctgtgctcttgaggattaaagagtccaatttgggagatagataattgtctagagcaaggttgtccagcccgcggcccaggatggctttgaatgtggcccaacacaaatttgtaaaatttcttaaaacattatgattttttttgcaatttttaagaagttcatcagctattgttagtgttggtatgttttatgtgtggcccaagacaattattcttcttccagtgtggcccaggaaagccaaaagaccgggcacccctggtctagagatacagactatttcccagatagacgggtaggttccctgttactgccctctctcttgagtctggggtatttttgcaattattctagcactacagatctgtcaaggataataatgcatagttattaacactaagtatggatgttatgaaatttgattgtcaatatatcctgtgctgattgtactcattcaagttaaaatcacagggtgcagatatataaaaatctcaaatgctagtttatcactttacagatagaactgtgatatagtgttctatgctaggcacgttgtgctcagaactaaatagcctaagtaggaagccaagttagaaggttggtccagtatggaatcagcacaaggggagttgatcggatgatgtcagaggccaattgtcatgaagctgtttgcctagcatatccatttcactgtagtgacatacctatgatgagaaccagaccatggtgtttttctggatcaatggctgtgctgtgtttctagcagtgctctactctagacattttatatgtaaagaaatgatgttatatgctcattttagagaagaggaaagtgaggctcagagatgttgcgtaattggcctacaagttgcacagatagtaagggtaaaattagaattggaacttgcgtttaattccacagtctgtgtttctactctttttgcttcattgctaagatttgggcaatccataggtcttcagtgatgcaaatcacctccaagaaaccccagtgccttagcacttggtgtcgtttccatgaacagagcttttggtttcctttgctcagacactgtccaagttggggcggctgaaaaaggctccctgagctggccacatctgttttaattagggatgtgtaaaattccagccatcaactgtgccagaagtctggataggctgcatgttacagctgataaatgatctaaggcaaattatctggatttagggatggtatttgggatgaaataatggagagttagaatggtctctcagcaaagctacgtgctgtttactgtaggaattagcatgcctgattagtacagctctgagaagggatgaaaatgtctaaaaaaattcagcaattgcctcagtgccctaaatagtcttatgtcagcaattagcagtaacagtctttcattaatccatcagatttctgatgctgcacatcctaatgcaggagataatagagaatcctcaggattagccactgatgcatcacaccacagtatgtcattacagcagcagtgttgagacagcatattgaagcagaaaaacggtagagcaacaattctctgaaagcaggaaagtgctccttttcttcattcatttcagagtgccatgtgcaatgagccatgaccaggcagcagtctgtatcaccaactctttggaggtgtgtaagtcggctttttagttgtattaatgagatgttgcaaaaataagagagtccaaggaaagaaacatattgctggtaaattcaaaggggttcagattttgcaaccattccttgatgaaatggactctctttcatgtattctgtggtcgtgttacctaatcttaggaggagtcaccatgtttttgctcttccccaaattcatctttggatggctgtgtctcagaatcattcagcaaatatttcacatcctttctggtttcttcaagtctccaaatgccttcccttcccctcattcctggcagggagtcttgccttgtacttgacttccatcttcttagcatcatgtgaactctcccaccttcccttcactcctcttggaatccccatgttgtcacctgtgtgtgtagtgtgtggttgtcacactttgacagatctaatttcaaatctgacctgctctctctatctggcagagtgaccaggcactactcacttggaacctttgatcccctcctttctttccaaatgctcttcctgcatcctccgcatcgcaggaaaggacagcatcttttgtctggttctcaagctgagaaacttggagtcatcctgattcctgtttctctcatgcctacattcagccagtcagcagatcctgttgattctaccttcacagtatttccaaccaccatcccggccctcctgcaggtctttgctggcgtgattcttccctaggactttccccttttcagcattgccccataatggtctagtctgaccattccaaaatatgaatctgatcacagagcctccaaagtcttccatttttcacctgggaaaacacagaatcttttccaaggcccgctgggtatggtgtgatttgcttctagcacttctctttgttcatctcctacagcttcatcccatctcctgccatgggccctgatgctcctcaaacactcaagcatatgtcctccttgtagctcctttctgttttttcttgttgctgtttttgttttagttggctgtatcctccgtgagaatgttcattccataaagaacaggattttttttttcccattttgttcactgccatctccagcctctcgattcccattgtactgttgcctctcttcaatttgagaaatgcagacctatagaatgaagttcaggctctttatcatagtatttggtcttctccacaatgcccagttccctgtctttgggccattactgtttgtatactcacaggaaccctagctacacccagttataccatggctatgtctttgtccccatggctgtgaaggtaggacatgctgaaaagctctttcctcatttttacttgttaaaggtctattccttatctttaatgcccaaatggattgaacaatattttagatttctcccaataaacatttatcctcctttcctctgaaatttgctgccacttgtatagcatttatcacatttcgcctttgtaagttatttgtgaacatctttctcttttgttattcttgtaaaatccttgacgatggatttcttttcatttcagatctattgttgcatccctagttatcaccttttacacagtgtttagccaacttatttacaaatagaaacagccttaagttcatatttcaaatgatctcaattagtgtagaaagcttttattatttcctcttgtgtgaattatttacatgaacaagaaataacatgcatatgacaacaaattaggatatgttattttcatattaaatgtccctaagataataagcaatgaattattaatgtatcacacaggcatatcttttattttattttttgttttttcaaatgtaaaaacaaaactaaatttgtcctaccagaagctcatagggtatgtttaggctttcagggaaaataattatttttacttagagatcagtagctaaatataaaaaagaacttaaaatttgcattgtgccccccaaaattatgccatgtatttggaatgtgtatttcatatatgttggagtttaaaatatttttccagcagtatagaaaaacagaagaaaatggacttacatttattgttaaagcaacgtgtattttatatttttatatttaaaatgcttttgattataatagctaaggcaattttataatgcagggcccaagtctcatttcctttctgctcttccaccaggtaagtagtacttcttgatttaatgcactgatattttctataaagtgcttagcatagtactatgtgcttaataggtagttagcacccaataaatattagcttctattattcataaagaagtgaccttctcttttcagagtccttcttggcctgtcatttatcatattattgccttgtattatttttatgtcttttccagctaagtgtcctttaatattgtagataattttgtacattgtaaaggattaataaattatttatccactgaataaataatgaacttgtgaacattcttttaaaatttaagtagctctgaagtttgctcatattgagcccaaacatggcggaaacttctgagcatagacaagttaatgccataaataatcccagaaaagccactggacacagaacgagtctctggggatgaaccagaagtcacatttgcctgcctacattttccttgcggaggcagttctactaaattaacaggggatatattagcatgttcagagacctctaaggtacagtaaaatccatagaatgcccacttccactacatttgatagagttacccattgggttaagattagttactcagtttatttatgttgtaaatgacttatttggccatttgtttgggaaaggtaggaagagcagtggagagaatgagagactgcagggcagacaaacgcttctgttttctgactgtgcactcacatgagagaaagagagcctttcaaaaagtatttgcttgggtgcttcacatggaagatgtgagctgctgaactctgggagctggcagccagcctgaatatgtcctttaaagtgtacctacctgttaaccactgcagtgcttggaatctagtaggcattcaaggaaacttggatgtatagatgacaaactggaagtgacaatgttccaggtagaggagatagcttgctttttatggatggcttagttgcaggcctccattgggttctcccaaggctcagtgttttgcctggaagttaagccattttcagatctatgagtgcataggtaatgtaaccattacattattattgttctatttcatttacttccaagtaaaccccagtcttccttgtcatgattatattgattgtattcattcccacaatgattcaaaaatactgtgtgtctcagaattgcatggccctccattggacaagtggggctaaaatgtaagcaaggtgggcttcctagagaagcctacagcctaagggggagatgagacctgcttacatggctgtcagtacaggacagaggaggcgcgtgctacacagtaaaggacttcagaggagggaaatagtctgtacagtctgcaggatgccaaagcacttcagagaagaagttgcattttaagcaagactttgaaggagatgttggatttaaacaaagggactgggttggaggtttagagtgaggacattgaagagaaagcaacaggcatagtaattggtaactttacagtcatatcaattaatttatgttaattaaaagtgtaattcaggctgggtgtgatggctcactcctgtaatcccagaactttgggaggcctaggctggcagatgacatgaggccaggagtttgagaccagcttggccaacatggtgaaaccccatctctactaaaaatgcaaaaattaaccaggcaaggtggtgcatgtctgtaatcccagctacttgggaggctgaggcacaagaatcacttgaacccaggaggtggaggttgcagtgagctgagactgcaccactgcactttagcctgggtgacagagcgagaccctgactcaaaaaaaaaaaaaaaaaaacagtgtaattcatttgcacatgtgtatctggctaagtaaaatgttgtatattgtcaagtttaagataaattttatttccctttatatcctgtaggacatcacaataaaattttgtttggtcaggcttttcttatactgttttatttcttttaagcattgggattcttcatactcaagataaaaaaggaagtcataattgcatgttatgatattctttgaagttatgttggacagcgtccacagtagaaaaggttaagttcatttcttaatgtgtacacactgcctcttacccactagcattggggccacctcattcatttgtttgctcattcaacaaatatttattaggcatctactgtgtgccaggcagtgtctagtgtctttcaattgtgtttgcattcctcatggtatgttttatattctttttctttcttctattctatgaacgtttctttgggggatatagtaggttcttaataatcattgaattaatgcacattgaaaaatctcacaaaggaattcaggcatgaataagcaagatggacttgttgaaagttccactgcagttttggacttgagtacaaatattgaatactatgtttcatagggtttcattagaacagaatgcgtttacaacttttgaaaattttctggtgcttttccttaatttaacaaataatcccacacatgaatcacatcactgttcaaaaatgtaactttgtattttgactaaccttacctaatggggttttggtattaatttaagcatgaagaactattcttggcttttgccaggaaacaggtagttaaagttctctatacttttattaatcataacatttctttaggccatttcagctcttatatgacttgagggtgaatgaaaaaccattcagttaaccaaacagagaaaactgaagactgattagttgaagtctcacagagtatatgccccttctactctaccctaaacactgagatagtcacatttcctagaaagacccagcgaaaccagattagtagaaagaggtccagaataaagtatctgagaaagcattatatctgtaagaggagagtgttttacagaagatgaagactaataatttcaacttcatgtgataaatccagtttgtttcatttttaaatttatgcttcctaataaagtaatttattctagggctcaaggttttataaatggagaaagacagtgcatatgattaagatttcaaactctgtcatgaaaagaattatccatgtttctgcctgccccatgttgtataaatttctctgtgacttataatttcttagacatatttatctaatgatgtgtgtttgaaagcatccacattttgtgtctgccctagttttttaatgattttaagtgcatttttaatggttgaaactgttatgtagaccatcttctgaggcaaaaacatgaagtactacatcacaatattaagttcttcaaattagaattacagttttagtgcatttgttatttaagtattattaggttagttcttatgctaattttagatttattaacagataggctggagcctgccaattaatgctttttactcttgattcagcaataatttgggtagtcagaaatgcagatgcatttcttatggtcttttagaaaattattttcttttgatttaattacttggtgcaggacatatttcattacgacacttctaaatccaattaaatatttttctacaggcaacaattattctaaactcttttcctcacagtggaaaagttgatcatcttgaataatcttaaccatgtttatttctccaaaactgtagtgttttaccttgtaaattttcttgttttccaggtgaatttaaactagatatctcatttccatttttcagcattttctccaatttgattgacttgtactaattgctctgttgcccaggctggagtgcagtggggcgatctccactcactgcaagctccacctccagggttcacgccattctcctgcctcagcctcccgagtacctggggctacagatgcctgccaccacacctggctaactttatttttagtagagatggggtttcaccgtgttagccagaatcgtctcgatctcctgacctcgtgatccgcctgccttggcctcccaaagtgctgggattacaggcgtgagccaccgcacccagcctgacttgtattattctatatgcttttttttttttgagatgaagtctcgctcttgtccaccaggctggagtgcgatggcgtgatcttggctcactgtaacctctgcctcttgagtttaagtgattctcctgcctcagcctcctgagtagctgggattacaggcacctgccaccacgcctggctgatttttgtatttttagtagagatggggtttcaccgtgttggctgggctggtctggtctcgaactcctgacctcaggtgacccacccgccttggcctcccaaagtgctgggattacaggcttgagccaccgctctcggcctctatatgcttttatattcatattccacatgctgtttacatttatatggtgaacaagcagatatcatcctgatattgtagagcacatgatttcttgctgtattttcattgacttttttccagtgagcaaatagaatattttttacattagttttcacttctagttagaatatatctgtatttgaaaatttacccaaagagtattgccacatcttaacaagtagattactaaagaaggaaatagccttgttatcatgttttattttacttgtaacaaattccagtttctaaatattcaaaggaagtgcataactagtgttttccagataacttgtttggtaggggttttaggggtggagatggtctgtaatcaaaaataaatggcagaatggatggatgactggcagtgacagatactgagcattgagggggaaatcatacttaaaatgaatttcctatatcttagaatgttaataaaatattatataatttattatgctgatgattagcctgtggggtttctctcctgtttcagtacaggtaggcagaacttgctacagaaagaaacttccagtgtccagttgaatgaattaattatatatatgtcattccaaattatctgatagttatataatttgaagcaaataattatatgaaaggagctttagagatcatcttactgcaattttgtgataatgaggaaattgaggtccgaggaattttacttttctcaggtcattgtgtattaggatgcttttggttgcaagtgtcagagtccccagttgaaactagtttaagtaaactaaaatatatatatatgactgggaaatctaggagtagatttggagtcagaagtgcagcagccaattggtgtggttaggagttgggtattataactttaggtcatccttattcctaaggatgtggtagggagacaggtgattggcagctccactagaaccatggggaaagggaggagccagtctctgaaaaaggaaataaactcacctagtttagtggaagaattgctgctggaatctggcctttagattcccaagttaatgccatctacatcaaaaccttaatatgtagtaggatagttggattaattaagagggtgcttaactcttagttgagtagattgtctacttagttttcattttagagcaccctgaagttggggttctaaagccttgttttaaagccaatagagcctttggctacagtcttttggaagttagggtttttataaaacaaatgcattgttggtgacatgataaatgcagatgagaatagagcacaaatctgctaaaaatttagaatttttaaaaatgataatggaaataactcccaagaacatataaactatgatctgttcaacatgcaggtcttttcagcttttctttctctttgtcccggagctaaagcttgattcaggacctggctgtgtgtcctacttggagctgctgaaaggtccccacacattccagtcaacctatatcttccttctccagggaccttgtcatctcagcgagtagatttaatttgtctttaatattaaatatgttcagtaagtatgtgtgtatgtacgtgtgtctgtttaaactttacatttgatttttcctaattatccttagtgaattcttagaaatgtgatcagaaatacccataatattaagaaaaggagaaagagagacaggaaaggacttagttaattcaaaaactgcataatatatcaagatatgattgctatcacatactaacagaatgtttaagttctctcactcatgaaaaaaaacacacatcttccagataaaaaggtaacacaaatgtgtgtaccttaatcatacccatatgtaaaactagagcggtggcatgaatcccaagaagtgggcggttgcccacagctgtacttctgtctcagatggataactgcaatcactaaccttttttgaagaatttgatatgatactgagaaaatagtgattaatcaaagccccttttaaaatggaagactttcatctataggcattaactttttatgatcagagaaaaaagcagtaaagaataggtgaaacatttattgtatacttactttcggtccagcattatgctttacatacttaaatttctaattcatcttatctgtgaagtgagtactattgcaaatatgaattcactttacagatgaggaaactgaggcctggagaggttaagtaaatgatctaaggcgaatccaggtcagaatgtgtgctcttgagggctatgagggatgtggaggattagtataggagcactgtctggttgtaaatggcagggcagaaacctgacctttgaaccactctgtgttctacctgcttccgtggcagaccttgtcccaaatatttcaggattgatcaagcaagtaacaatactaggttattgactcacggttctgtgaaggaaagaaaattgaatatttctgagaaaaattgtaccaaaatagagagtgcccttaaactgtatcagcttgtgagacgtgttttaggcaagaagtttccagtttttttcctgggaaatgctgtacagcagtgggccctgggaggaacggcatatacattaaactccttccagagaactatttgttctcttttagggacaagatgtgttcttaaaagttgggcagacttcacatctaattcttctactgtcgttacaatttcctacactaatcctaaattccgtggagtttttattacattggttggtggcattagcctgtcaacagctggatgagatagaagttagaaaatggactttttgaggtcaggaagctaagcaaccagaagaaccaatttgtcaacttaaatcatctggggaatggaaaaaattattccacaatgtgggaaataaaagaccgcctggagctactggtttttgtttttattttctttttgttattcctctttgcacttcccttttccgagcagcattatgtgtgggttatagaaagcttacatgttgactttgttatgtggtcatttgatgtggtcgcgctaacgtttattgtaaatactgtgagtatttttcacccttctggcttaattacctgtggccacatcaacctgaatgtatttgagaggtaaaggggcccaagacttcagtaagagcctttacttaaaaaaaaaaaaaaaaaaagaagaagaaagaaaaaattttcatctttgtgttgtttatcttttaataatggggcattcatgcattttccatatttggggtgatagtatttgggaaggtgaacttcatttgcaggttttataaaacttatttcttcacaatacttaggaatatatttagtataatattttataaaatttaaatactgtcttattcccttaaaaaggatattccttatgctctggtacaagaaaaaagacataagattcttttgtgaaaccatgagatgatgatgttcatgactgaaaacacatgtcctcccatgggtattggctgggtgctctctttcaattacttttgcttagtttttccctagtataatgctttataaaataaaactttatgtactgacatggcccaaaataaaacccattattggaaaaacctatgtttcttaaggccaaaaggtacattcctttattttttatttttatttttatttatttattttgagacagagtctcgctctgttgaccaggctggagtgcagtggtgcaatcttggcttactgcaagctcccccgcccaggttcatgccattcttctgtctcagcctcccgagtagctgggactacaggtgccagccaccatgcctggctaatttttttgtatttttattagagacgggatttcaccatgttagccaggatggtctcgatctcctgaccttgtgatctgcccgctttggcctcgcaaagtgctgggattacaggcatgagccactgtgcccagccctcattcctttattttttatgtgaatttcttctctatttttttggggtgatttcaatggaccatgaaatccaggttactgtttctttaaatagtgaagcaaatacacaatttaaaataatctgagcttttttcttagcagcccgaagaaaagtggttaatttttactcagattatctctttttcttttgaccattgtgcttttacatatgagcacaattcatgaatggataatcttagtcattaatttcaaaacattctattatgaaaacaatttaatattgatgaaatcaagttttaaaaaaaggtttaaaggggagaaaacttgtaataaccagacagcacatatttaaatataatagtgtaatgggaatgttttctcttttcaaatgaatttccttgtctgctagtattacttattaaaataagagtatttttctcttaaaaggtccaatgaattgaattgcaatgagtttaaatgccataaatagaatattttataatactttggaggtttctacttacaaaaggtgctctgagattcttttgcaaaatgagaaatgagttttcaaaataaacaccctgttatttgtgtttataatagattgttagatactatattacctttacttaaagagaaagatgctcgtatttatgttattttcaaattagaaaatctttctatactgtggaaacattttaaactaatacacttgactaataattctctattacctctgtagaacatgtaaactgatgcccacccatgctaaacacagtagaattgtacgtcagttctactatgtagaagagtcagctttatgtcaattcatctatgtagaagggtcagttgtatatatctcaactgtctttatgccaaatctatttgtaatttaattaatttacaagattactctatcaagaaaattgaagaaatatgagtaggggaatagaaagagagttattccataaaaactcagatgagtcccttggaaagactaaaagtgagctattaaaaaaatgctattgcactagggtaagcaagccagctgaaaaaaaattggaaaataagtagaggaaatctaagtaggaaatcagacaaagtataaatggttgaggtttatgcaagacaaatgagtgggtattctaattagcacacctatgctctgaaaagactatggccatacagtagaagatgatatacgcttatatcagttaagttcaaaatgaattatttattttgcaattttcattttgaaacgatgatctttccaattacctaaacaattaatcattcctcaaggttgaacaaaagaccttctgtgctaatgcttactattaagtattcaatatatgtttgcttcatagatttcatttcagttaatatgtctacataaaactgtcatctatttgaaacagttatgcattttctgtcatattaaagtagttaactagaaaaataatatgtttttccctaaaactctacaaaatttgtatgattagactttggagtagttttctagtttttaaagtgaaacccagcaaataattaaatattaaataattaatgtaaaagccaccttttaatttatacaaaagctaattttaagtaacaaatctcatttggcactatttattaggggagtagttcagaatcgggcacattttcatgcctgtggtttaatcatctttccattttacttatgtaacgatttcaacaattccaggaaaatccttagtgtttagaaatgaatttgattcatgacccacctattttgtcaaaatggtaaagctttagttgtttttgtttgggtgacttcctaatcattaaaaaataaagacattttgagaaggcttataaaaataaaaaaagtcatttcagttgtaggctgctgaaatgggccttggttgttgcaaagtattaaaagcacaaatgctaatataaactgtgtagcctcagaagcaatatatgtgtgagctgtcttttctgccactgtggaatgctactcattttggctgtgagaccaataataattcaatatataacacagataaagaccagcgatggtgccattctcttctgaatttataatacctgggaaattagaagtccatccagggagtgacactgtagaagaatagaccatgtagcaaccctgataatctcctcagagggtgccatctcctcaggagtttgcaaggatcttagaatccagagtctgtcccttgctcttttgagagacagtagccagggttttgtcagtctgccaggattgggtctctgccaaaacaggtcatgttggtattttattaatttataatgagaaaataagacaagcctggggaaactgtgtgcccacaacctttagccagccaggacagtcattctttctggcgagctctgtggggaacccattaaaatctggtttttcttggtgagcctggaagcagggattggaatccattggaagacatcaggtttcttttgtaaacatatgcccaggatttgaagtgagctgtgtcaatactcacaaaaacccattctcctcccttgcctgtgtcctgcctgtacagataaggggtgcaggtgggattactgtctccagagtttgcacctgggatctttgttagcatggccttaggcagtcattgcagagtcacacacacctgtgtcccccaggtccagcctttgggcaggggcatcctcattgcctctgggctttgatggacattgctggtggtggtagatcaccattgatgacaagatgataacggtggataaacatggcttttactttgatgtgtcttttgtaaatgttacttgcatacctttgttgtgattatagtccattccaggctcttcccatcttgttccagctgtgtttctgacttatctctcgtatactggaggactcgctcttcccacaggaagctgggaacctcagtatttgtgtgatttttattacctggctttgcatttcattatacccatttctctgctccagagccttcctctgctctcctgtgctgaaatccgagctttccattaaggcctagcacctgtcttacctgagcagggactgcttgcacatcctgtggtgtgctcagagcgctttgttagtgattctaggtggtactggccgctccttcatactgtgacagttatttgagtaacctatgcaagattgagagcccttcttgagtgagtggcttgtgttcacatcatccttgtttcctccaagttggaattgtctagggaggtctctgtatttttagggggaggtgggggatggttggaggggagaatggcacggacaaggagaaacgggtttctgctctagcattttgcatgctttactattttttgccatgtgtcttagcacattcggaggccaccacaggccctgtttatcttaaacaacatgttcctgagacacgtaacagtgataccggggtgggtgaaatgaattcagggtaccattttcttatgtatttagctattgaatgagcaataattttaagatgcacactgagggtaaactcttactcataaagcagccaggcaaaactctgatgaaatatgaatcaatagtctcctgtcaagtgcaagaattccattgaaaaactcaatctcacaagggcaaattcagattatttctgcaatgtgttgaaataaaatctggtataaaaatcttgagttagattttttgacattatctctcactaatatatttctgggcttctcccttaattcttacaaaggttagagtgagaaagttattaggtaagttattgtgacccaggcagccatccagataaaggttcattctagacaaggtatgtatttcatgggcagtgagagggaatatatgaagatacagtttcctacaagatggtgaaattttggttctactttaattgtagcataataaagaaatatgatatagtcagaactgctctacatttgtaaggctacgctggtgtgtcctggtcatgcccatagccagctctctttgagcctgtctctgaacagattggaatctggcacgtggtgattaacaacacttgctcccttgacttcaggggttgttgacttggtcatgtagatcagtgattcacagccattacagtgcatcagaatcacctgccaggaggacttgtgaaaacacagattgctgggccccagctccaaagttggggtcgggcctaataatttgcatttttaatgtattctcaggtgatgcacatgctgctggtctttggaccacccttggagaactgttggtatacaggcttacctcgttttattgtgctttgctttattgcgtttcatagatatacttttttacaaattgaaggtttgtggcaatctttcatctagcaaatctattggtgctttttttccaacagcatatttggaaaataggcccactttgtatttctttttcagattttgataattctcacagtattttaaactttttcattagtattgtatctgttacggtgatctgtgattagtgatcatcgatgttactattgtaattgttttgggatgccatgaaccgtgcccatataagactgtcaacttaattgataaatgtgtgcttttcactcctctgctgctgggctggctgttaccccatctctctgcctttccttgggcctccctctttcctgagactcaacaatattaaaattaggacaattaataaccccacagtggcctctaagtgtttaagagaaaggaagagtcacatctctcactttaaatcaaaagctagaaatgattttgcttggtgaggaaagcatgttgaaagccgagataggcagaaagctaggtctcttgtgccagttaacccaactgtgattgcagaggaaaagttcttgaaggagattgaaagtgccactacagtgaacgaatgataagaaagtgaaacagctttattgctgatatggataatgtttgagtggtctgaatagaagattagatcaggacaaagcctaatccagaccaaggccctaactctcttcaattctgtgaaggttgagagaggtgaggaagctgcagaataaaagctggaagctagcagagtttggttcataaggtttaaggaaagaggctgtttccagaacataaaagtgcaaggtgaagcagcaagtgcagatgcagaatctgttatccagattctgcagatgcagcctgttatccagaagatctggctgagataattgatgaaggtggctacactaaacaacagattttcagtgaagataaattagccttctattggaagaagatgccatctaggtctttcataagttgagaggagaagtcaattcctggcttcaaggagaggccaactctcttgttagggactaatgcagctggtgactttaagttgaagccaatgcttattgaccattttgaaaaatcctagggcccttaagaatgatgctaagtctactctgcctgtgctctgtaaagggaacaacaaagcctggatgacagcacatctgtttacagtatggcttactgaatattttaagcctgctgttgagatctactactcagacaaaaagattcctttcaaaatattactgctcattgacaatgcacctggtcacacaagagctctgctggagatgtacaaggagattaatgttgctttcatgcctgctaacacagcatccattttgtagtctacggatcaaggaataatttgtacttccaagtcttattgtttaataaatatattttgtaaggctatagctatcatagatagttatttctctgattgatctgggcaaagtaaatggaaaacctcctggaaagtgttcactgttctagatgtcattaaaaacatttgtgattcatgggaggaggtgaacatatcagcaggagtgtaatattaacaggagtttggaagaagttgattccaaccctcgtgaatgactttgatgagttcaggacttcagtggagaaagtaactacagatggtgtagttacccgggaggcggatgttgcagtgagctcagatggcaccactgcattccagcctgggcaacagagtgagactccatcttaaaataatactaataataaagaaaaagaaaaagaaaaaaaatgaaattgccacagccactccaaccttcagcagccattaccctcatcagccagcagccatccacatcaaggcaagaccttccaccacaaaaaaaattatgactagccataggctcagataacgattagcattttttttagcaataacatatttttaaattaaggtatgtacatttttttaaagacataatgctattacatacttaataaaatacagtatagtgtaaacataacttttatatgcactgggaaacaaaacaaaattatgtgactcagtttattgctatatttgccttgttgaggttgtcagacccacagtatctgtgcggattactggtacagtattcaggggatgcagagctcttagatgtggagggctgactttttgtattaatgggttctgcagggtgtactacaggacttcggcattcgtaggttttcatatcttcaaggggccctggaaccaatccttgcagatactaagggccaactgcattcttgggataaaaggtagattttaaccagccctatatttgtttaaggaaaggataaaaagtctttaaaacaaataatttactatgtctgaagccaatgatcattttgcttgattctgaaattcttaatgagaaaactcatttgtatattatatccctcttggaaacaatatacaactttcaaatcccccccccccccactgtaatttattgtggttttgggcaaaaagacttaaaaataataaaactctgatatcttagtttacaaatatttaaattttcacattaaagagccttaaaagtttatttgaagcacgtaacagtatttttctttaccctgatctgtgaccaaccctatacattcttattcctagaaggaagactcttataggcactatcacagtgatatagagattcatgatgcagactgtaccgaaccaccttacagtatgctgtttgttcattagacacttgtcagcagaaatggttgaagaaacattataaaacacacatgggtcctttcaacaaatgatgtcagttcaacatctacatgaaaaaaaaaatgaatctagacactgaccttacaccttctacaaaaaccaactctaaatggatcataaactcaatgtaaaatgcaaagttataaaattagacaataagataagagaaatatctttttttttttttttttgagacagtgtcttgcactgttgcccaggctggagtgcagtggtgtggtcttggctcactgcaaactctgcctctcaggttcaagtgattttcctgcctcagcctccctagtagctgggattacaggctcctgacatgacagctggctaatttttgtatttttagtagagatggagtttcaccaggctggtctcaaactcctgacctcaggtgattcgcccgcctcagcctccaaaaatgctagaattacaggtgttagccaccgcgcctgaccaagatgagaggaagcccatgtgaccaggcttcacaatacatttttagatacaacaaaagcttgactgatgaaagaaaacattgctaaactggacttcgttaaaattaaaaactgctcttcaaaaaacacccttaagagaataaaaagccacagactaggggaaagtgttcataaaacataaaaagggttcatacccaccaaaaaagagcccgcatcgccaagtcaatcctaagccaaaagaacaaagctggaggcatcatgctacctgacttcaaactatgctacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttcgttacaccttatacaaaaatcaattcaagatggattaaagacttaaacgttagacctaaaaccataaaaccgctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacccacaaaatgggagaaaattttcgcaacctactcttctgacaaagggctaatatccagaatctacaatgaactcaaacaaatttacaaggaaaaaacaaacaaccccatctaaaaatgggcgaaggacatggacacactcttctcaaaagaagacatttatgcagctaaaaaacacatgaaaaaatgctcaccatcactggccatcagagaaatgcaaatcaaaaccacaatgagatatcatctaacaccagttagaatggcagtcattaaaaagtcaggaaacaacaggtgctggagaggatgtagagaaataggaacacttttacactgttggtgggactgtaaactagttcaaccattgtggaagtcagtgtggcgattcctcagggatctagaaccagaaataccatttgacccagccatcccattactgggtatatacccaaaggactataaatcatgctgctataaagacacatgcaaacgtatgtttattgcggcactattcacaaaagcaaagacttggaaccaacccaaatgtccaacaatgatagactggattaagaaaatgtggcacatatacaccatggaatactatgcagccataaaaaatgatgagttcatgtcctttgtagggacatggatgaagttggaaatcatcattctcagtaaactatcgcaagaacaaaaaaccaaacaccgcatattctcactcataggtgggaattgaacagtgagaacatatggacacaggcaggggaacatcacactctggggactgttgtggggtggggggaggggggagggatagcattgggagatatacctaatgttaaatgacgagttaatgggtgcggcacaccagcatggcacatgtatacatatgtaactaacctgcacattgtgcacatgtaccctaaaacttaaagtatactactactactactactaataaaaaagggttcatgccccaaatatacgattcttaaaattcaacaataagaaaacaaataacccagttaaaaaataggcaaaagatctgaacagatacctcatcaaagaaaatggcaaataagcttatgaaaaaaatgtctgaacaatacatgtcattagggaattggaaattaaaacagagataccactatgtactttattattattattattattattattattattatcattattgttttaagacagggtctcactctgttgcccaggtgggagtgcagtggcatgaacatggctcactgctttctcgacctcctgagctcatgtgatcctcccaggtcagcctcccaagtagctgggaccacaggcatgcaccaccacacttggctaattttgttttaaaatttaacttttaagttctagggtacgtgtatagctttgttatataggtaaactatgtcatgaaggtttgttgtacagattgtttcatcacccatgtattaagcctagtacccattagttttcctgatcctctccctcctcccaccctctgccctctttcccatagaccgcagtgtgtgttgttcccctctttgtgtccatgagttcccatcatttagctcccccttatcagtgagaacatgttttacttggttttctgttcctgtgtagtttgctaaggataatggtctccagctccatccacattcctgcaaaggacaatcttgttctttttatggctgcatggtattctatggtgtgtatgtactacattttctttatcctatctgtcattgatgggcatttatgttgattccatgtccttgctgttgtgaatagtgctgcagtgaacatacacatgcatgtgtctttatggtagaatgatttatattcctctgggtatatacccagtaatggggttgctgggttgaatgggatttctgtttttaggtctttgagggatcatcacagtgctttccacaatggctgaactgatttacactcccaccaccagtgtataagtgttctgttttctctgcaacctcacaggcagttgttattttttgactttttaataatagtcattccgactggtgtgagatggtatctcactgtggttttgatttgcatttctctaatgatcggtgatgttgaactttttttcatatgcttgttggccatatgtatgtcttcttttgaaaattatctctgttcttgtcttttgcccactttttaaggcagttgttcatttttttcttgtaaatttaagttccttagagatgctggatattagacttttgtcagataatatagcttgcaaaatttttctcccatttggtaggttgtctgttcattctgttgatagtttcttgctgtacagaagatcttcagtttaacccacttgtgctggaggttacaaatttttttgtgtgaaaaattagaccttggcgatgaccttgagtagcaggatataaaaaaccccacaagcttagtgttccaataatggaacactaggcataaataggttaattagatcctgtttgtcaatttttgcttctgttgcagttgctttgcttttggcatctttgtcatgaaatctttgccttttcctatgtccagaatagtattgcctaagttgtcttccagggtttttatagttttgagttttacgtttaaagtctttaatccatcttaattttagcatagtatgtagagaaggggtcaagtttcaatcttctgcatatggctagtcagttacaccagtgccatttattgaatagggagtcctttccccattgcttgcttttgttagcgttgtcaaagatcagatagttgtaggtgtgtggccttatttctggtttctctgttctgttccattggtatatgtgtctggttttgtaccagtaccatgctgtcttgtttactgtagccctgtagtatagtttgaagtcaggtagcatgatgcctctagattttgttctttttgcttaggattgcattggctattcaggctctttttttgttccatatgaattttaaatagatttttctagttctgtgaagaatgtcagtggtagtttactaagaatagcattgaatctatataaattgctttgagcagtatggccattttaatgatattgattcttcatattcaggagcatggaattttttccagttgttcatgtctctgatttctttgagcagtgttttgtagttcttgaataggtcctttacttatcttgtttgttagctgtattcctagtttttttgtttctttctttcttttttcacaccggctaatttaaaacattttagagatgggatctcaccaagttgcccaggctggtctcaaactcctgggcttaagtgatggtcctcctgcctcagcgtcccaaagtgctacgattacaggcatgagccaccacgccccacctacacacatgttagaatggctaaaatctaaaacacttacaatgccaaatgctggcaaggatgtggaacaagaaggaccttcattcattgctggtgggaatgcaaaatagaacagctgcttcagaaagcagtctggcagtttcttacaaaggtaatcatagtcttagatatgatccagcaattctgctcctaagtttttgtcaaaaacatatgttcacataaaaatctgcacacatggttatagcagctttattcatttttgccaaaagttggaatcaaccaagatgtcttttaccaggtgactggataaactggtacattgagacaatggaatattactcaatgctaagaagaaatgagttttcaagcccccaaaagacattgaggaatcttaaatacatattattaagtgaaagaagtcagtttgaataagtctgtatgttttatgattccagttatctcacattttcgaaaaggcaaaactatgtacataggaaaaagataagtattgtctcacatccattaggagcaaaagaacaaggaaaagaaatgaaaaaggaaactaatgactattagtgaggatgcagagaaagcagaacccttatgcacagttgataggactgtaaatggttcaaccactgtggaaaacagtatggcagttcctcaaaaaactaaaaagagaatgatccaacattggatgcaacattccacttcagtatatatacccaaaataattaaaatcaaagtctctaaaagaaatttgcacacacatgttcattgcagcattatacacgatagccaaaaggtagaagaaaccccaggtgttcatcagtgaatgaaagggataaacaaaatgaagtatattcctttgatgtaatattattcagctttaaaagggacacgtgttacaacacaaatgaaccttgaggacgttgtgctgagtgaaataagctgatcacagaaagacaaattccaaataatttcacttttatcaggcatcaagagtagtcagatttggaaacagaaagtagaattgtggttccccggggtgaggggagggcagttgagataggagagaagggagtggggagttatgtaatggggatggtgtttctgttttgcggggatgaaaagagttctggtggcgatggttgcttaacactgtaaatgcacttaagactgtgaattttatgttatttgtattttcctataatttaaagaagaaaagatcaatggttgccagaaaagttcagtggttggggatggtggagagggatataaggtagaacagaaggggtttttagggtagtgaaacccttctgtatgatgttgtgatggtgaatatgtgacgtgcatttgacaaaacccatttggtggaactatggaactaggaaaagttctcattgttttccctattcatggtggggattcatttatgctaattgttttatcttctctccatcctcaaaatttgtcctcctcctcctgagaacaggtagccagcttgcagtagtagcagctttatcttgtgcagtcatctggttgtcttattttcatcttccttccccagttctttccccctttcactgctgtaaggccaaggtggatgtgtaggaagcagaggtatctccattttcctttggaaactttctgcttcttaccagctctacactttccgacatacaatgaccctttttgctaaaatttggattctcagtttaacaaaagattgagagaaaatagttgtgtccctgtcccttgactcttcctttaaaagatgtttccagtcaccatacttaccctctgagtttagattttgccaaattgttggcagggtttgaaggccaggacgctctgtgtgctgctatttctggatctgccattgacagcaaccagattacagtgaagcccgtgaactgacagtccagggcaagtgtgctgttgccgtgggcagtccacgatgggggcctctccatccttctgagttaggacagtcattcctcccgaggtggcttgtcctttctgatgatagattgagggagacaagcagcacatgagtagacacacaccttgcccgagcagttggtgccatttaacagtttcttcccactcttgacattttcattttcctccttcacctcgctcatcactagttgtttgcatcttattttctatacacagccgtaatgcagaatgacagaacacacacacaagctccattactcattttctatgccgtattctactcaaattacacagtgattttgcatgagctgagccatgaaaggggcatacgattttaattgtacactggccttgtgcagggcatcattcaagatggaccgaaattttcatgaagcatggctgcttaaaaaagcagcagtgaaatgaaaaggtgttgcatttttgtttcgctcatgctggcttgcacttgccttgtttatcaagaagtctctttcccagggaacaatgaggatttttaaatcacattcctgggggaagaacattgtgttgtcaccctttcattctccctcccctcccccagttttactgaggtataactagcaaataaaaattgtgtatatttaaggtgtacatcatgatgtttcgatacatatatacattgtgaaatgattaccacccctcacctcacatagttaccttttattatttgtggtaaggaaagttaagatttactctctcagcagattgcaaggatacaatacagtattatcagctgtagtcaccatgctgtacattacatccccagaatttgtttatcttgcacaactgaagcttcatgccctttgaccagcctctcctggtccgttcattcttaaatgctgttctgggctctggggtgactcaattgtagaagctatacagcatttgtctctttttctccagcatgatccctagaaagcctgagaatctattaaaaacattgtggcttcctaaaattaaagtaaatttatatatatatatatatatatatatatatacatacacacacacacacgctataaaaatgaacaactttagtacaagaggtagcagaatggtcggtcactgatgcagacgtttctcaaggattttagcttcagacttacatggaatcaaccagcctctctacttccttatttccatgatactcaagtcaccagctgtgttaggggttgcatgtctgatgcctttgattttgagtgctgctttcccctccttgtaaagacgttttattcaaggatggaaggttggctctgaagcctaacataacttacagaaaaagtgccgcacacagtgtcttaactcaggtaggtcctgggtttaatgtttgacgtagtaaacagctgaggacatgagaacatgctgggacatgagaatgtgctgtttttctcacatgaagttttcctagtaaatagactgaatggtgaatgttagcagaaaccatttcttttggccgcttgttttggtttctggcagtgcttttgtgctggtcactgctcttacctcattcattccccagttcttgttatctttgctttagtcacattgatgagatttccaaccttttagctcaccaaccttgcttctgcctcagggcctttgccctttctgtgcatctgcctgaagctctccccagttctgcagacagctaccatttccatattcaggtcttcagtcaaattgtccctggttgctaatgagttcttatttgatgaccatatttaaaattgcaggtatacacatgcacatgtatgtacacacacacacacacacacacacacacacacacacacaatctcccttctctgctttatttttttcactgactgttctccatcttacatactaaatattttcctattttcgtttgtctcctgctactagtatgtgagtccatgaattcaggaatccctctgctctgtattctctgaattcatttctgtgttcccagtctccagaacaatgtctggcacttaggatatccataactatctattgaataagtgaatgaatggtggccagcctgcccacactgtctacagcatcaccacaattcattttccacctaggcacttacctgcagtctaaagttatcttgtttattaatgtgtttccttaattatcacctgtgtctcctttcctgaagtgaaaggaagctccaagtgaggacaggcctggcttaccttgcttaactgacattccagcacctactacagtgcttgacagatagtaaatgctcagtaaacagcagttggatcagtgaagggcttgttcttcctgcttcccgtcttcctaatacagcagttttatgtcattcttcatagcactagctccactgaatatatcttttttatattcgtgacacatgttttctttgacctttggggtgcctctggcaatgaagactcaagtgtcaatgggttgatgggaatcctggtgccaaaagaaatggcccggtctgtaaacttgcttaatctagtgcagaagccttagatctttcctagaaagtcagtgattttgactttcttgcctcatttcaaagtcatctgtcatgtgttcccactctgttgggttcagagggctctgtggacagtttggcttgaagatttcctctccatccagccttctggagggtgaaagtggacgtgctacacttgcttacaaaaaggaaagatgaccataatgtagcattttctggctgggtgcagtggctcacacctgtaatcccagcactttgggaggctgagatagatcacttgaggtcagtagttcaagaccagcctggccaacatgacaaaagcccatctctactaaaaataaaaaaatcagctggcatggtggcgcatgcctgtagtcccagctacttgggaggccaagacagcagaatcgcttgaaccttggaggctgaggttacagtgagtcgagatcatgccactgcattccagcctgggtgacaaagagagacaatttctcaaaaaaaaaaataataaaataagtaaagcaagcagtagaagtgggtttggtcgatttatgcttcaagaggtttttgtatggtggcccaggctgagaagctgagtgtgattaaaaattttcttttggggaaccccttcccaaagtagggaagacagagatctggaatgttcctgctacccctatggatctattctagattcttttcctcagcctccgggagtctgctggattggggccggtgggccacactcctagttgagatcagaaggtatgtcctgctcatgttttccctgagtttcttctcttgggccttagcagtgtccacacaaaacctctagaatgggctctcttgagaccatcacagcctccagagccacagtgtgctggtttagcgtggccttggctgcagtcagacgtggaatttctgttttgccttttacacacctacacatgatgaaaccttgtctctaccaaaaaacagaaaaattaactgggcacggtggcgtgtgcctgtagtcccagctactcaggaggctgatgcaggagaatcgcttgaacctgggagatggaggttgcagtgatacgagatcacgccattgcactccagcctaggtgacagagcaagactccatctcaaaaaagaaagaaaaaaaaagcaaagaaaagaaagaacatagcattttctaacatgacaatgtcagcttagtgacaggatgaatcacttcaggctacagcagaaatatgttttgaagaacaggactatctttgcacagggaaaaatgatgaagaggcaaagcaaaagatctgttcaatttacagatttttttaaaagctgtttttcttttcataaggaatgatctttaggatctttattggtctttctaacactcagaatattcatattacgagctaatgtggcactgatgtgacttttagaagctccccttacagatgtggttaaatttctgaattccactaagaagacctgagatctcccattggttttgtttcttgtgtcagctgcatctgcagagcatataaactgctcatgtgggattcttgccagtgcagtttgctgttgtaaagaccttagccctgactgaattctccacagggaatggttgggatgagtccttgggaaggcagtgacaatgaatgtgccaagaagagggagacaactgtctcttgccaatttccaggctagtaaatggaaatgtaatctgcaccaagtcagaagaatgtcttttacccaatcattcataaaaatgaagtcatggataaaaaccatccagggggatcaagaagacccagtaagtaatcctgtggagaggtgagcatgtttctgctacaaacatgcaactcctgccacatgcaaaatgatttgcactgccagaatataatacttccaatagactcctggtgtataccttctttgtcctgattgggtaagtattgaatggcatctgatggtgaggagcaatgtgggatcatggggtgaagactgcagtaagcctgaataataattgttattgccattctgatcttatttttaatggcaatatagtttgacaggtgtgctcatgtatatgattttttttttgagacagggtcttgctctgttgcccagactggaatgcagtggtacaatcacagctcactgcagccttgagttcctggagtcaggtgatcctctcatctcagtcttctgaatagtggggaccacaggcgggtgccaccggtgggtgccaccatgcctggctaaatttttttttgtattttttgtagagatgaggtttcttcatgttgcccaggctggtctcaaactcctgggctcaagcaatctgttcaccttggccttccaaaatgctagggttacaggcatgagccactatatccagaccatatatatgatcttgatagaagattatgctgagatgcagcactattcacaatagccaagatttggaagcaatctaagtgtgtatcaagagatgaatggataaagaaaatatggtatgtatacccagtggagtattgttcagccataaaaaagaatgagatcctgtcatttgcaacaatatggatggaactggaggtcattatggtaagtgaaataagccaggaacaaaaagacaaacttaacatgctctcacttatttgtaggagctaaaaattaaaacagttgaattcatggaaatagagagtaggacgatggttaccagagtctgggaatggtagtggtagtggggaaagagggagggttaaagagtactaaaaaaaatagaaagaatgaataagatctagtatttgataacacaacagtgtgattataatcaataataatttaattgtacatttaaaaataacaagtataattgaattgtttgtaacacaaaggataaatacttcacgtgatgtataccccgtttaccctgatgtgattattacacattgtatgcctgcatcagaatatctcatgtatcccataaatatatacacctatcagtatggatacctattataatgtatccacaaaaaaattaagaattaaaaaagatatatacattttaataacattatgctgaggaccatgtcttcatcatgtttgcacctccttcacttgcctggaatacttgcttaggacagagtaagtgttctgaacttgtttttgaaatagatgtatcatcccctctgctcttcttggcaggtctgtgtggcagcacattggtcatgggccaggacgtggactctgagggctaagtgactggtcaggagcaaggaaggcaagtcctgcttgcacagtcctaacttggtgccctctccccagaacccccaggccatggacataaggaaaggtcacgcactcactaagcacactggcagtcagcagcatcattgcacactttccaactgtttactgccagtattttaaactagttaaaaacttaactctactggtgaccacctaaagatcaagtttcagcaaagtgggacttcattcatttattgggcaactgagaggggtggggcagtgttctaggcactgggaatacagcagtgaacaaaacaccctcaaaatcactgccttcatggagcttcagtcaaacttgaacaggggttggaaaagaaactgcaaagtaagtgttcttgatattttgttgcacaatcagccaccccagactcagtgacttaaaggaatatagcagccatttccgttgcttacagatctgcagtctgggcagggttccgtgggggaaggcttgtctcagcttcacagggtgtcagccgaatgctggagcagggctcatgtaccatgaagaggacaagggccttttgtttgaaaagcagggtaaaagtgccattaaacatactgaaatagaaaacatttttcctttctcttgtggtctgtttctggacatgtcgtggtgttttcatttgcctcatattgatgggttccctcagggctgaggataattgctgggcagagcagaccgtcataggcacctgggggtcctgcctcagtgcccccatgggactagctgccaggtccctctgcccccctccagccccaggacagatgactcatgccttagctctgagtggggatgtcaagccagacttttccctttcgcttgggcccgccacctcaacccacagtggactggtgaccctctagggatttcagcctccgtgctggatgtgcttggtagctagattgggaaagggtaagggcttactcatacagagtcacctgtcatacatgtcagggttctgctagcccaggatgggacagccgcaacatcccacactctgaaacatcataggcatgtgtgtacccagccctctttgtgtctctctgccaggggcagatgaggcagccctcactgtgtggaggagccagggtggggccagggcgccaagagagtgggtagtgagtggctgagaacctgtcctggggatgtgggattacgcaggagctaaggatccaggtccacagctcatgtgccattgttccacctaaagaacacatattcacagataaaataagactgtgaccacagagcattaaacattgagcataagcccttgtgagcacagggccctggagcctgcgctgttctcatatccacggccctaagctggaggagatgcttccaggtgactgtctcccaaggccagtgggctggtgctggctgttgtctaggagcgcatcccaggtcttgggaggatagagttttctccatatgggcctcttcatgctactcttcatgtggctgggctttccttgcagcgtggtggctgggttccaggaaccagtcctgggagatccaggcagagctgcattgcatttttagggtctagctatgggaaccacagagtcacttctgacataactcttttgttgagggaatcacaaggacccagccaggttcaaggggagaagatacagatgtctggatatattactggggctgtatttttacaaaatactatctgccaccgtaagatggtatgtgagatggggatgagataggatgtgagatgtcattaactgtgatgtagaagtttgtgggggaaaacaggtttggggtgtgatggggaaaatcagaagtttggcttggacattttaaatttgagatgtcactaccttagtggagacgagaagtatgtattggacctgtgggctggtgtccatggaagagaagtctgggttggaggtgaaaatgtaggagttgtcataaaattactaagtgtgaatgtatttcctggtaggggacccctcagggattgcaattaatttgctattgaaggtgacctattcattttatgtttagactgatgatttagaaggttttattgtcaaatcttttcaacttatgtatttcgatagaaatgacagtcagccaagcaattttccttatgagggctctgagtgtgtgtgcatgcatgtttacctgcacatatgtgtaagtactgcattctagaaatctcagccttgaacttttccttatgatgttgtacagtctatggtttttagtttatgtgtattttgagatattcaaattttcatttacatagatatatgcattttacttattacctcgtaaatttttccaggcatactatgtaagatcaggttctagtttaaatagtgcttcaaagattgggaggcaaaattattctttcttctgtcttctggtgattttattttgcttgaagttataatttagaagagcattaaattaggatatttggaattattctttggaccttacctatacttgaatcagggtttaatagaatatattggacaggcgcagtggctcacacctgtaatcccagcacttttggaggccgaggggggtggatcatgaggtcaggagatcgagaccatcctggccaatgtgaagcctcatctctactaaaaatacaaaaattagctgggtgtggtggtgcatgcctatagtctcagatgctcaggaggctgaggcaggagaatcgcttgaacccgggaggcggagattgcagtgagttgggatcgcgccactgcactccagcctggtgacagagcaagactctgtctcaaaaaaaaaatagaatatatttaacttttattaatattctatgaatcataagtagcaaatttcctctcaaacagtaagataaattgactgatggcaaatgatgggatgtgttttgatcttaggagaaagacatgccatcataaaatattttaaagacatatcgttagaatacatttcatttaataaagaatgtttccataaaagacttgaggcaaagctattgaagttttatttaaaaagcattttattcctccttccgtgaagattttcccctttaatcttctgtgttttcctttctttcccactttctctgttccctttattttctcttctctttctgttcccttcctttgtcttctcttcccagaacaaagacctggattcttgcttgcaagggggagattgaaatgcaaatggaaaggaaaacacgaatgataacactaataacactcctgtccatgttactcccgcctttcactgtaactgaacctgaagagggagcaggtatcagggtgcttttgctagcataaacactggggcacccttatgtcttagctaactgttctctttgagttatttaatagaaagacaccagcgtctgacgagtcttcacagtactttgtcccaacactaggggcaattatatagatttaattccacctccaacagttctaggctgtcttctggaaacccaacacattgtcctctcctgatctttccagttcttagtcagtatatcaggaatacagtcttcagactaaggccctgctgtttttgtctaaacatttttgtttttatttatccccttcaagcaacatttttcccactatatccaatgtaaacaatttgcatagcagtttacaaaagggttgtaaaccttattttacttggaggttccaagaaaatcagcagacttcttgagagaactagggatttggcagggggtaggtgggaggtattaagaggaagtcaaaagcagggactgatgatcttattttagggctggcctgggaggatgctgggagtgtgccactccaggccatgtttcaggtgcacagtaattgttttgtattgaagcagattttcagtaaacaatactagggaccaactctgcccagctgagaggaaattaagcacagttacttgactgataatgatgccaaacagtttcaggtgttaggatttcattacgactgtgtgttgtctctggctgtacatttacattttgtgtcaggtatttcaaattaatcatgagcataattaatagttgtagtaattagattaccattttatgatgatatcatgtaacagaatatgaagcagcaggaaaaatgcggaggaccactcaggtctagatagaatcagtgttctgtgagacttatcaaaacaggtcagctctaagagttaacgtattgatgcttcattacacagcagcttcttattacaacaggtgcaaatgaagacaattttaatattaaatggaaccccctcgggcctataggtcccaaagcactaacacagaattattttatgaggataatattttaacaggcattctagttgaattataggttatttgataactgtgaagaagccagaaagcaatgtatggttttacatttcttaaaagctaaattgagttaaggatcagtgtgcgtaataagctaagaaaaaagggagtttggctttttagaactttaatgaattattgaacatatttcagaaagaggatctttaaacagcttttcgaatagctcttgttaacctaaagagacacttagtaaactatccataggctgatagaaaaaggacatttgcatggaagtcacttttttttttccgccatggtttgcctcggaaagatttcaaatgattgtataatgagggcagaaagttgcaaggctacatataaactgcatgctacttaataaattattcatgttagcccaaaggtataattattcagtgaaatgagaactcagaaaattagttctgtattaatgtttatttatactgatcattttttttttctttacatgctcacattttcctgctcagagaggtaatcgaagggcagtccacctacgtgccacaagttctgagtaaatgtggaatcaggttggaagtcccagggttcatagtgtcccccgttttttatttttatggtggtggttgtaatgtatttgcttttagagaaatggtttcttttgtatgaaagggaaagtcaagctcttattatttagcagtccttcttcaaagggtgtgcatggtgaggagctgcaccacggtggtgcccgcagacgctgcttcgtgtcccccatgacagctctggtgtgaatagtcacagtgccaccattttgggtcctggtaatggtggttttccccacttctgtcacttaccacccacagccttttctctctcagcccagagcagacaccattattcttatctttgtcttgtttgttattatgtagctctcagctgcaacggtatttaacacgttttacacatttttgttggatattccctgcttggccccttgactcctagagaagaatcctcagaacattaggcaggtgctcctttcgagacagacacaaggcagagtgaatcattcctctgccattccagaggctgcagtcctcacagtggcctctgagtcctgcatggcctggccccatcacctctgtgaccttctgtctctctgcccctcatgcagctgcctcctgccagtggggcctctgctgcctcagctccctccctggaggctgtaatggctgctttctcaccttcttaggtcctagtgtcaacttctcagcaaggctcaccctggccactgccacagaactgccattcctgcacccagaggcctagaacttccttaccctgagctgtttttatttctgcttagtcaccaccttctagaatactatataatttgtcttttaattatctttgttgtttattgcctgcctctctgcttgaacaggggatctttgtctcttttcctcaatgacatgtgtcagatgccttagaccagtgcctggcacatagtaggagctctataaacatttgttgaatgagtgaatgactgagtttcctgaaattcttcctggaaacactaaatctgctgccccagggtctgttagagagtgctggactgccatgctatgaatgctcaatgaccagtgtgggtttccagttatccttgaaacctaggaaagaaagggcagggagatgtgaaaccactgaagcagtggggagctttcggaggcttaggggagaattcagcagggggatcctgctggtcacaacaccgaatccattcctccattgcttcttggttaccagtcctttggaaagtatgcctctgcctggtaggagtgacaatactacgagagccacacatgtggcttgggtgttgagcagggatggccacatgtgtgttgaagccctgcttgtgtttaactgagagggttttgtgaactcctacaggtgtctgtccatttgcatgcctattgggcccccagtttctagagcagcattgattgccatagctcagctgatttataaagcatgtgcttgcctgggagattggggtcacggtttgcttggaaactttttgcagcaggaagcagtggagcagaagaaatttttggaagagttaaatgtcagggataaggctaaaggcaatgagctgaatcttttgtttcagtaaacttcctgatggatagctttgccgttccctccccatgcaaggcacatgtggtgagagggttagggagagaatgcatgctatcttttactttattttttttgagacggagttttgctcttgttgcccaggctggagtgcagtggtgcaatcttggcttactgcaacctccacctcctgggttcaagagattctcctgccttagcttcccgaatagctgggattacaagcacctgccaccaagcccggctaatttttctttttctttttttcttttttgtatttttagtagagaaagggtttcacaatattggccaggctggtcttgaactcctgacctcagatgatccgcctgcctcggactcccaaagtgctgggattacaggtgtgagccaccatgcctggccagccacaattttaagttaacattttctagtagccacatttaaaaaagtaaagtttaaatatattttatttaacttaatatgtttgttattattttaatctgtcattaatataaaatttactaatgagatattttacctttttttcatgaagctttcaaaatttgcagtgcattttatgcttacacctcaatttggactagccacgtttcaagtattcagtagccacatgtggctgataaattggacagtgaagctatagagagttccttgataacataaaaagcttatctctttgttatactttttacttatatagattctgtctttcttttcaaaaaagtttgatttaaagtatgttttcagcctataaattatgttgtagcatgcttgatgttatgaagtcagactgtggaacacagaaagaaaatgtgtattactctatagatgatcctgaatatgtttaatagatgaaaccattatatttctccccatttaataattgatgagtcaagaagtcttaaaggtatatccagtagaagcagagaacataggaactgagagatatataaatatctgatacatgtttttattttgcttaagtgacactttatagaggtctggtgtaagaattcatatactgtcgctcttttgtatgttgcaaaattattatcatttcaaaactgggctggaacttatatataggagttatatcttagactttctccaatgaattttggctaccaaacacctcaaatgaattctgcagatagtatttcaaggatgcttatggtatggtaagtgtaacttgattaactacagaagatgattagaagttgtaatagacactgagaatcctgtagtggtctttgatacccatgatagataagatgatgaaggtaactcttaaaattaggaataaatattataacattacatttttgtctttaaatttctgagcaaaacaaagttgatgacctttagatttaaaacaagaaattgttgtttaaagatgttaaagataaacatttttatcgttgaatgagtccctgagtttcagctctctttcacatcaggtctttagtttattgctttctttaaacatcatgcacctccttgtgctgtttttcattccccacccccgattcagagagacaggtaattatatacacaccagctaaatgtctggtaaaatctctaggcaaaactgagttgacttgtgtggaactgaatttaaaaatgcttgacggaatattgctccagtctctgaatacttgtcaggttgcatttactgcaattgcctccattaccaggatgtgtgctttggtcctgagagagacacttttccctgcctctcccccttttcttccttttcactatatagctctggcttctgaggggtcacagtccagcagttattcattttgtccctctgaattagaaaagaagtataataatttaactgaaattaggtttgttttaaacctaggcaactgtctttttatgaagaaaacatttacagtataaaataggagaatgtcacatgagctgtataaatggaatatataatagtgtggatgtataatgattatcatttgtaaggcattctttcaaaagtaagtaactggatttagagaaaattaacctttcattcgtaagtgaattaaataaagaattggacattgccaggtgggggcagagaaagccagagtttttaaattaaaaaaataagcaaataaaatctttaaacataaatggagataagatttgaattgtatcatatatggtaacctcttttttggctggtgtaccgaagtctaaaaatgtacaagtggtagagtttataaaaactcattcctacttggcaagggtaagaaaggaaggtggtcacctagaatcaacatttattaacttttaaacgtcgtttcgtagggaagaatctccctcctcaaagcattcagcctgagtttatttaggattcagttaattgaaagataatctgtggcatcgataggaatcatcattttccaaacatcttatttttagaaacgggcttcacaagctctttacaaacattggaatccatagtcattgaaatgggtggcgtgttttttcatggggattgtgaatcagtctaaagcaaaatatgtgtttatgatttgcatgtaaggtaactgaagtttagcaaaaacaataatttgtcatttagaaatgatcccagtctttggaaatatttagaataataaatttcaggttaagtttttttttcacggtttaatcaagttaagatttttgggatacttagtatttggttggctttactaaaagaaaaatatttattggcattacattaaactgcttaaaaattaaacgaagacctagttaaaagatgctggcattaagacatggttttactcaatttttatacctggaaccccaaaaggaacaaaaagaatgagaaacaaagaagaagatgctatgctctgttaaatagctacaacttcaaaccacattttaaagaatacctgccaaatagagtgacatttggaccaaaggagagaggatgctgtgagcttacatagtcctctaatttgaggcagggtatagttttctcaaggagtcaggcctgtagaaattaaatggcttcactaaaataataagagaatagaggggcgactctctctgtgcaacttagttgtgcaccacagaaaactggaggactcggaggtgagggaggaaaagagcttctgtgtagagttgggcaggctgtgacttaaacagctctagggatcccaggaacataaaagtctagtgagtggaggcccctgatgttggagcccaatctgcacgcacacctgcgtgcacacctaggccaccatcgtgactgagtgccatcttaatgtctagggcagcttcctgagagtgggagacttctcaaagtgagactgaaagaaggctcaggaaggtggtgttcaggagcctgtgacatgaggggcttctttctaacctatatcaatgctgctaaagttttacacttgagtgtaaaatactcccagggtacaggacttgaccatagtggagagaactggagattaatgctggacttgaagctggctgctcttcctatgaactgacaggttgtctccactgcagcatgaatgccttctagttctgcctgccacaccttggcataggcaggcaagttcatagaataatggaacacagacaaagctagatgtggaatatacatcagaagacaaattatctcaccaacaaaagaagaattcagaatcttagtattttgtggccttaaaggaataatgaaaactgggttttctcaaagtttaaaggaaagatatatggttaaagaaaataagaaatataggagatagaaagtgagctgattaatctgcgtgaagaaggagaaaaaccattaggaagagggaagtcacattggaagccaccaaatataacaaacacaaatgaaaacacaggaatcaacagacttgagaaacttctacaaaacaaagtgaaaaagatgagagaaaaaggatttctgtgaagatgatacataggagagacaaaggcttattcatcacatattacttgtttttccaaaggaagagaataaaaatggaaacaaaaacattcaaaggtataataggataaagccttgcttataaaaaaagaaagatgtatatgtgcttgcaggtcagaaggccacactatttactaggaaagaaactagaaacaaatcccaagaaatgtgctgctgagcggtcaaggacattgggaacaacaggactgagggacactggggtgagccacacggcctttggtagcctggtgaaagcagtgccaggagacagcacagcaagttgcaaggcactgggtagagcagagtggaggtgaggaaggggagaagagtacacgcagctcttctgagaagtttcatcatgaagaagctgagggagatgtggatggacctgaagggggagatgggactgagggagcctgtgctttttaagatgggaaagacctgcacatatttaaatacccctagtgaatgtgaggaaagagaagggggttcttaaccttgcctgcacattggagccacttggagtgtttaaaaaaaacactgatggtgggtcccactcagaaggattcctatgtcatcggtgttggggatggctggtgttgagatttttaaaactgcccaggtgattctaaaagggagctgaatttgaaaaccatccttgtaaaagatgaaacaaagcttcaagagttgggtttcctcttccactgtagctagaggaagtgatggaagtactttgagataggtaggtttgtgagaggggagctgaaggagttttactgcttatggcttctgcgttctcttgaagggctggtggtgtgatggggaagcatgttgggaggaagatgggcaggcactgagaggagaggagtgaatttgcagcactctttcatggagaaggagggagaacaccaaagaggtgttgaaccaaagggtgggcaggcagtgctgagaaggccgaagtttgagatgataattttatggaggcagctctttcttcttcctaggtagagagtgggcagcccataatgtgtggagaagtaagttttctagtgaagactagagaagttagttacttgggagattttcttattttgcccataacatagagaatcagacactggtagaaataaaatcaattagttaatacacatagtgcattctgttaaatcctgtctagctctgccttggtaggctcttaatcgtatttctgtagttacatagaaatgaagctgaacactatgattttgcttatagggaaaaacatgactttcagtcccagtgtttcaaacgcatcagtaggaagggctaatttaggcgccgactctttccttaaagtgaagcttttgttatattaatagatctagcctgtgattcttgtaaagagtgttgtaagttgacatggtaataactaagatttgaaacaatgtgcttacccaagctgtatcttgaaatacagtttgaatcaacttggaagaaaacctaaactaaattgggttttagtaaaataatcctgcttcgtaaatattacaaagaaaatgttatcagtctttttgggtattgttggcggagtccttagatcagagatttttgttttcgttagggccttccttctttaatgttttaaaaacattatttcagttgtgcaggtagtttgcattttaaatcatctcacacaacttgctggaaactgaaatggatgctgaggacatggtgactttttaagggaaagatgaataacatccgctgtgcgagagcccttgttccagagcacaccacatgaacaccagggcttaaactcaccaggagcccactgagagcccatgtatttagatggaaacaaaaatggacataaaaattaagtttgaaacaggtagtctaaaacatcaccgggagttcactaatgtcaggacagaataaacattgactactcaggacaagttttcagaagttccccaagccccttctcacttggttgggttctgctgacgctggtttactctgcatctcacccctttgcacacagtaacctttggagatattcggcatcgtagtaaacttggtggttgttggggaaatttttgtttgctttttcattcagcattttttttttttttgagacagagtcccactctgttgcccaggctagagtgcaatggcatggtctcggctcactgcaacctctgcctcccgggttcaagcagtcctcctgcctcagcctcctaagttgctgagataacaggtgcctgccaccacacttagctaatctttttgtatttttagtagagacgaagtttcactgtgttggccaggttggtcttgaactcctgatctcaggtgatctgcccgcctcagtctcccaaagtgctcggattacaggtgtgagccactgtgcccggcctttcagcatttttttaacattgtgaaatggatgtatgggtgatactgtgctaggcaccaaggcatgaagacataattcagacttggctcttattctcaagaagtggactctagacttttagaagcccagggaagcaaagacatttttcttggcttactcttttaagtgtttccacagtattcttagctattagaaaataaaaattatttattgttgcaattgttagaaaaagtcattcatctcctgtctcttggccactgtggagccctggcattaaggaaaaaaaagtttggtggctggcgatcagctataattgtgggtgtaaccttctcttcttctagggtgttggtgagctttagcctcctgtccgtcttgtcctttggcctgacttatactgtgttcagcttgcaaaggacagctgtaaaggagcagcatgaagccaaaatcaataatagtgatgtttttagctcagctgtcatctccctacccccaaacctcaccaaaattttatgtctcagacagtttgtcaaggacaaatgtttggtccatgtcccaccagggcaggttttctgtcagccaggagattctagctgtgtgtgtgtgtgtgtgtgtgtgtgtgtgtgtgtatgtgtgtgtgtgtgtgtgtgtgtgtgcgcgtgcacgcgcacgcgcatggattaggtgttaggacacccaagtctaaagatttaattgtacaaatcttactgacaaatgttttactgatttgaatgtgccagattatttaaaaactggaacaatataacagatgttttttaagttctgtgaatatgaaaatattttaaaaaggtgagtatgtttttagttctttgacaggggcttatatgtctctgaactgatattaattatctatgctttgctgttttgccagtgaagtcactgataagccaagactaggtccagcgataaaaattatttgggaatttagttcaggatttaaagagtggcatttcctctgacctttttttagagctgacactttgtggcaggccaagtgtaatattctattccttctaaatacccttctctttttctcatcttaaaatctttctctttcaaagctgatgcaacagtggtgtaaaaccacgttatttctagaattgctctgggccacctgatggtatacatatttcttacagtttacgaagtcctaccagattcttctctgaatatgaccacggggaattgtttggacattaacaagtgcattgtgtaagggaagtattttacttttcagcagtaatattagatgtttgtgaccaaagctgacgagtgattactggtttaacagccttatgtttcaacagatacagcataactataatgtttaaatatctgcagtgatggccaccaggactgaagtttctttctcctcttaccttgaacaagagaagcagaagggccactgtttacagggagttgatgagaccaccttccttagaaggcccttacttctctggttgatgaatgtcatactgattgcacccaagactgagttcttggtacacgtggctgggcaaattcttggaacaggtgtctgggctcatttccctgagtggcatggagagccttcttccatgatcaggcctgcaacttccctcctactcacttatgggcatcacgctccccctctggagcccgttcctgctatttctcctgcctgaaatgctctgtgcccctttccttccatctctgcctaaatgctgccttatcagagaagcccacacgccatgtaaagagcagtacccactcccttgtcctgttgcctatgtcccctaccctgccctggtttgctgtgtgggacttatcacctatcctattagatatctgtttatttatttatcatctctgccctaggtggaatgttaggtccacagagacaggatctctgtactcctcactgtcgtactccgggcacctgagtgtatggcaggcacttggttattgaatgaaggactgaatgaaggagtcataggggctctgtgtgtatttgtggaatgaaagaggggggaaggaaggacttgacacttagagcacctaagtatggaaggacttaggacattgtcccttggaaagtgggtggtgattgtcccggataaaggaaaacacccctccccacaaaggggttgccttgagaaagtgggtagttaggaagtcctggcttcacgctcaggggtagggtggctgtatgtctccttttccaggggatagggctcctgttgacacctatttctccagctaatgtttcaaagcaccctcttccattcttaaaagtttcccaatctgggtgataaatacatggtcacccacttaagggatttgattgcatcagggatggagttctgtatatgagaactacatgcagggagcactgagaggagtgactctgggagcacaggcattttgtacccttgcctggacggggccctgagggaacgggaggccggccttcagaggaccactgggcgtgtgcagttaacagtttggtttgtgtttttctccatgtttctctgtatacagaggtatataaatttaaatatgtacatacatatgaagtccacccctgttttatttttacagaaatggtattatgtcataccgtacttaccaaagtcttttttatttcgtatttcagaatatctttgctggtctgtacctattgatctccttcgttaccgttacttttaattgcagcataatattctatagatggatatatctgacttatgcagtcgtgcccctgttgatgtgctttcagactattttcatattctactgttaaaaatactttttttgtgacaaaagatatctgtatgcatgtatccgtatgctgagagtgggatttctgagtcaaagtgaatgtgcgtttttaaacagtcatcaccagatgctttccccaaaggaagtacagttcttcctgcctgcagcaatgttaggcgtgccctttcctcacatcttgcccagcagtggatgctcagatcttttaatgtttttctaatctatcaggtaaaaaatgagattatcttttcctttggctgtacatttttgagcctttatcatagagtcaagtgttgtaatgcattctgtaactccaagatatgtagcatttactaactgcagtcattcattaagtaaaacttagaccattaggaagatatactgtttaagtatttaaataactgaacacatcttcctgtgttttatcactttttttcatatctagggcatttcacatgtttccaggtttggttcctaggtatggctattaaagaactttcagatcaaggttgataattgggcatactgggctggggtgcagtggcttacacctgcaatcccagcactttgggaggccgaggcaagtggatcacttaaggtcatgagttcgagactagccttgccaacatggtaaaaccccgtctttactaaagataaagaaattagctggctatggtggcatgtgcctgtaatcccagctattcgggaggccgaggcacgagaatcacttgaacccgggaggcagaggttacagtgagctgagatcgcgacactgcagtccagcctcggcgacagagtgagactctgtctcaaaaacaaacaataaataaatacataattgggcatactgtaatattctcagagatctatatgtaaaatttgtatagtcatagttttatggtgggttataattgtctctagtagattctgtgagtctaaaacaataggaagactgtgctccattagcttgtcatgcaatttttaactttgacaatagactttttttgaaaaaaaaaatattttattttttgcgacaagatctcactcggtcactcaggctggagtgcagtggcatgatcacagctcaccacagcctcaaactcctggagtcaggtcatcctcccacctcagtctcccaagtagctgtgaccaccggtaagtgccaccacacctggctaatgtttttggattttgtagagacagggtttcaccatgttgcccaggctggtcttgaactcctggactcaagcaatatacctacctcagcctcccaaagtgctgagactacaggcatgagccactacgcctggctgacaataggctttatttactcatttattgagatacaattgacggaagctataaatgctaaatatttcaaatgtgaagggatgaaatgtgatggaggggcaggcaaaggagcagtggtgccaggtgtggattctgtgtagtgtgtgaatggcgtctctgtcccttaagcccaaggcaacaatgtgaatagccacttgcgtacagcagcgtgccatattcaacttggcaggtttccatccccaagggccttagtgtgttgtaaacactttattgattgatgttcaatacattgcagcacaatataagaatatattgtcatcatatagtgatgaggggaattgtgttgtggtgcctcatgtttgtaagggatgacatttcgggtagacgtaggaaaaccgtttcacatgctacaattgttgtatatttcctctgtccaattgcacatgggccagagacttatgtgtatgggaaatgtttctttgctgctttaccaggatgtcggtcattttgctcggatagggaaaactggaaaaagaaaaagaaaaagatgtgcccagatacttactggttttcggcttcctggtgaaagtactttatgaacatagtgaaatgtgtcattctttctaatccttaaatctgcataggccatgcccataaggggctaagtgtgggctatggggtgggagtgttgcttttccttcccccacccttgttcatgcctgtcttagcatgtgactcttgatagtgaacttgcccagatgcttcaaggtcaccatttcccatattctctggcagctgaagagctgtttggatcttggaatatggagtgggatgtttgatattgtcaagagaaatgtgggtgaacagtgcgtaggtcctccttgagcccctgggaaaggcttgacaccacaatttagaaacccttaactttcttaaggttaacatctgaagaaaagaagtaatttgttctgaggattttttttcccttttgtgatgtagttcatattttaatatgaatctcggaactgcctgaataataataataataataatggataaacttaatgagcccattttatcaactgttatgcattatctcatttaatcctttggtaactttgagaaggtactgatgttatcctttttgttgttgaagaaattaaatagcttgccaagatcaagcatgactagagagtagcccacactttataggacttggctgaaagcactttttcttaatgagcaaatgtgtaattgttggtttacagggaagtggagcctgattaatgtcggggctgttacacgggccatcaagttctctcctcatgatgatgtttttagcatcagttcgttgatgtgtatctctgctcagtactctttcacttcctgtgttttggaattaaagaggtgttagattccttaaaaaaaaaaacaaaaaacccttatttttgtttggaaatggttcccaaatgcactgctggtgtaattaccaaatgctgacttctagatagatagctatagtcactgcataagccacgttgctcactcaattctcaattgcatttcttttaataacaattccgaagttctaacattatttttttcatttctgtatcaaaaatgtggtcttctcatacctatggctggagataagtatgtttatggtttaattgggtggatataaggagaggggcccctggaagtccccagaggtctctcctggatgcttctcatgcactgacagtgctgtgatgagagtttgtgagtataacagaggcaaacactcatgagggctgataattataactaagtctggcacataggagcactatatcagtgctagatgtatgtttattcattttacctctacaaccctgtggggtaggtatgattatgattttcattttccagaagaagcagctgagattatatgttggtctcaagactgcacagctagtaagttgcagagctgggattccagttcagttggtcagattctttaaccagttcttaacctgcaggctagattttagccttatcctggttcacatgtatttaaatattctggccggaggataccccactaagtataaaatagctttgaaataaagctatttcaagggaatgtctaagaaggtatctgaagcatctaaatgaagaaactagcattagaaaacatactaactggcaattttatttagaatcatgtggctgtgcattccatttcttaaagatagtaaattttcttaagaaaaagaataaagaagaaagcctctagcatcttaagtttcactcatttctgctccctgacttttattaggttacacctgatttattttagctttctcagggtatgggacaattgtttataggattggtatggtgtctacttagtctgcatttgataggagaaagtatttaaactgctctttttgttagagatgacaaataaaaagacccattgtgttgtaaccatagggttgatgaaatttatgacctctttgagttagttttaaaatgtagcttaaaaattagacattatttatttgtaagaaatcacaaacatttgaggttcacaaataatttgctgaaggggcttggaggaagtcgtttatgattttttattttaaatggggctcagatgctgcctctttcctctctgtcttgggcattgggggggtgcaagttatgctggccagagggccctgagactgaaacctactctggatacttttttagtgttcatgtggtttagtatcctgcagtggttttggggtgagtgcaaatttaagagtaaaaagccagtttataagagagaagcttgttccttgtttgctttttacctgctgctgtgtaatgtttagcccctatttgaggtcatgtccatgaggcttagtgtctctgagtaatcaatgaggaagaacagtctcatgtcaggcttgccatgcacatttaatgacgactgcccatgaaatccctggcactggattggcttgccattttttttttttttttttttgagatggggtcttgctctgtcgcctagactagagtacagtggtgcaatcatgccttactgcagcctcgaactcctgggctcaagccatccatcctccctcctcagcctctcgagtagctaggactaccagtgtgtgccaccgtgcctggctaattaaaaaaaatgtttttatagagacagggccttgctttgttgcccaggctggtatcaaactcctggctggaagggatcctcccacctcagcctccgaaagcactgggattataggcgtgagccactgtgcccagcttggatcaccattcttaactgtaaccatcctttcctttctttcttcatcttcagtgacaagtaaagtatcttattggatgtgggagattggcataggaagttagagaatgacttcccaaagtcactcttttctgtgggaagagacctagaaatcctggtgtgagaagtaatttgaggggatcaagaacttcttgattaaaggatggatttgttttcttttgttgcataataaattgctacaaatttagcaaattaaaacaacactcacttattagctctcagttctgcaaggctgaagtgagcgggcttgctatgctcagggtatcaggaagcccagatcaaggtgtctcctgactcagcctttacctggaggctctggggaagaatgcacccccaggctcattcaggttgttgggggaatccagttgcttgtagttgtcagtctgaggttcctgttttctccctgatatcagcagggggttgctcgcagcttttcaaggctatctgcctgccttttcctgtggctccctccctcttcagggcctgcagtggtttatccagtggaagctctctgacttttccctggacaccagtctaagaaagcgctccactgagaacagcctcagtgattaggtcagactcagaaattagaatctcctattctgttttttcagttatggtagcctggtgtggtggtacatgcctgtagtcctagctattcgggagactgaggcaggaggattccttgagcccaggggttaaaggttgcagggagctatacaccactgcactctagcctgggtgacagagggagacctcatttaaaaaaaaataaataaataaaataaatgaatgaataaaataaataacatggtaagaacacgtaacatgggatcataagatctactctttgagcatatttttgagtgtaccatatgttattgttgattatggtacaatatagtacagcagatctctagaacttatcttggagtactgaaactttatacctgctgattaggaactccccatttccctctccccgagccctggcaaccgtaattctattctatgcctccatgagtttgaatgttttagatgctttgtataaatagaatcatacgctatttgtccttttgtgttggcttatttcacttaacaaaatgtccccaaggttcatccatgttatcgcacattgcagaatttccttctctttaaaggtgaataataatacattgtatgtatatgacacagtttctttatccattaatctgtccatggacattttggtcttttctacatcctggttgttgttaatagtcctgaaataaatttgggagtactaatagctcttcaggatcctgatttcaatttcttttttgggtaaatacacctaagtgggattgctggatcatatgatgtttctgtttttaatttttttgaggaatctctatactgttttccataatagcaaaaccaatttacattcccaacaactgtgtacaagggtttcagtgatactctcccactcttaaggccaactgtgccatctaacaacatggcaaaatcatgttatgatcattattatgcttatgatgataggcacacgattataaacgtaatcacaggagtggcacatcatcatagtcacgagttctacaggatgtgggatctggggtgggtaagtgcatttttaaaattccacccaccaccagggtcatctcagaatgcctccaagtgcccctgcccctgtctgaaccctgctggaacaagcccaagcttgtactgttatttgctggcctgatgaacatcctatttcagtagtgatggctaattttatttcatattaagggatttgtggaaagaaattttaactaaagtatgatcattgtatcttgatgccccgaagggtgtgagagattcttaaagatgatagtaaacgtattagaaaaggagcaattactgttctagctttgtagaactatttatatccagactcttaatgtgtattataggtgagacaaagacataatatggattagttcattgcttattttattgtgagaaggagtctatggaactgggtcactggaatttttacaaatataattgagattatggatcataagttagaaggttgattgtatgaatgggcaaatgtagcattaccatgttgatagttaccaagtcctagggccacacagcaaaagcaaaaccattagaagtagttttcctaaggctattggttttttttttgtttgtttgtttttaagtttacctcctaaggactcctcagagccactaggcaaggtcaggctgtaattcatctctagaaagagcacctgatggttaaaatggagtcaatatccattactttatcatagagatgatctcacaaaagggcacctgcatcatttagggtgctttggttgcaagcaataaaattggactgcagttcacttaaagcagaaaaggaatttattataaggacatgaggaagctcacagactctagtggcaggccagaaaactgggctcagaataaagattgagagagatagagggtagttttagggagcaggatctactatctaactactgccctgtcttttcagggcatgttgtaaaaaatgaaatagaatcatgtctctgtccttgcaccatcccagtcaagacccagagtcctttggagaaaggtccatgggacaaggatctcccaggtctgcacctgatggagggataaatccatcaaaatgactcgggatgctattactaaccaaagagagaatgaatagatgctgggggcaaaactctaaagcaaaaacctgatgtttactgtagaatctcttgttacttaaaatgctttctcaaaaactactcaaaaaatgcattgagtggtaatttaaaaaacacttttgccttaaacaatagtcttttattactacacaaccactgccttaaatcatagaaaccccaaagcactcctcccagttaagttagaatatttcaggcatattcttatttgcataatatcaatgaaatcctttgactagtgtataagaagggtccatttagcatatcatgatgaaaacggattgccaaaaaaaaaaaactgcaagcaaatacagaggagccaaaaatcattgtctgttatcctggagtcatgttcactgattatttatttgtaaggtgaatataaactacaaaaataatcctcattctatttgttgcatgataatggcttttaaaatgaacatttgtgtctaacatgaaaaaaacctctgtatctaacagtttatgggtaagtgatcatgttctaatagcattgtatcaaaagctgcttttctttataaatccttatatttaatccctccaaccagccaacaagccacaagcttcccagggaattaatttaagattgaagataaaaaagaggccaaagttaatgacatcagagagaaagctcctgaaagaagtaatagtttcaaaaagattttgactgttttataagacaaatataagctgtcgtagaaagaattgttataaaataaggttattgcttctggcttattcaaaatgattttttctagtttataacctcaactaatcttgtaataacattttaaagtaaaattttaatgtgtaccttgggaatgacactgaccagttttactattagattgcaaaaaatgttttaaatattgataatgtaattttgtcaagagcagatcatcacttttgatagcacagaattctatacttaaaatatgagatttctaaattcacagcaaaaaggattttgttgtgaatgagataaaatttaagatttaattgtggtctggcaaggaaataatagcataaaaccaccagggaaattcaaatatgataattttggtgaatgttctcaattttaaataaaaattttttaatgtaatgactttacctatggtgggattgaagcaatacattatttacacatttaatcttattttgatttactctaatttatttgatatcagcagcctgttagatgataatttaaaaatccgctgctaccatagttgctttaggaaaccttcctgatgataattttattcactagaataatttaagtttccatttaaaatgcgtatttaaacattataatgtgttggcagcagaagatgtttatatcaggtagaatgatgatttccttaatggacagcaataccgtacctcatattttatggtaaaggagatggattaaaattactttttactacatgtaccttctatgtttgcatggagcataaacaaggagctataagattttttttttttttttttaagacggagtctcactgtgtcaccagactggagtgcagtggtgcaatctcggctcactgcaacctccgcctcccgggttcaagtgattgtcctgcttcagcctcccgaatagccaggactacaggcacacgccaccatgcccagctaatttttgtatttttagtagagacagggtttcaccatgttggccaggatggtctcgatctcttgactttgtgatccgcccgtctcagcttcccaaagtgctggattacaggcatgagccactgtgcctggtcaaaatttttttaaaaattaaaaacattctctagtcgtgccttcatggaggcatactgagcatatggcatcatattttgtcacactctcacgtatctgctagtgtaagctacttcccagcccggtagcacttttgaaagacttacattgggctttttgtggcggaaatggggagcaggatttgttctttgtctttctgaacctgttttagcactgcacaccctctcctgatagtgcctgtggcttctctaagggagctttattcctcagagaagaaacctctgctagaagaaaggaaagagaataatggagaaggaaagattctgtgggggaaatacacaagatggtccttccagaaaagctgctcagacatctgaagcttttgtctatgagtattgttggccaattgttggaggactgaggcttctacctttcttcctgcgaaggtcgaggacaggttaggtgttgggtaaaactaaaccccagatgatggccttcaggagtattccaaggtcagcatgtgatggggagagaagagttgtggaagaagactttatgcccaagactttgggaagagagtagtccaggccctttccagggatttgctgtaaggtgacacctgttccccttctggcatctctcatcccgtgcgtttgacttttgttggaacatccagcacggttggttgtggccaacttgtcaggaataaatttattcctgtatttgattttgtcagccagggaagatttatgagacagagctgctgtctggatatcccttagaaggagacagtgctcctggtggcttgggtggcttcttgcctctctagtgctggaagaaaccctcagccctggtgactgtgagggaggtttcagcaactaaatgcaaaatagcatactgatctagctttaagaatttcaggagttactcatttagtttttattttgtgcctgtagtccaaacaggatctcagctaggaatatggcatgtcctgttcttaaggatctgattataatatggaaggaaagaggataggtatgtaggtaattcaagtataaatgccacataaatgagatataaagtaactgggattcatggaagaaagaactgcatcctggttgacgagattttaaaaaagtttgtatcaatcaatcaaaaactttgtgtcaatgcagagaagataagttaaagaagaaggagcagctgtagaagtccctgagttctaggcagtgtcatctcagactgttcgggattgggctcaaagggctggaaaggtctcaggcacatcaggtgcacgcacccttggagccacagtagcaatgccctccctcggcccaccccatgtctctttgaggtggcttttggattttctcctcaccaaggaaagatgttgatctcctcatacttaggaaatactccacaaatgcttttaaaattccaatgacatctacgctagggttacagttaagccctatggcctcctgctcattttttaatcaacttgatctcaggcctgaaagtaaccagaatgttcatgtgtactgttcttccatgaggtaattaattgaatgagcaggatgaatgggaacttgaaattaacaatgagctattgaaaaaataagcaacaagtaataattgctccattaatggactttccttgtctgttgacatgactgcctttattcttatttactgcactcgttaagatggtaataagtattatcttttaattttttaaaaataatattcttaattcatattggtggtttacactcagtgtttttactgaataatgtgccttcctacaaagagcttaacatgaaggtgataaatcattatcctttatcactcattgctctatttacattatcttttacattcacgtgccttaggcatttatactgtataaagagactactgtatggacactttgtttttttaaaaagtatcatcagaaatcaaaggagggatccatttgccaaatgggcaccataaagaccttttaataacagctacagaaatcaatctcattcagcagcaaatcctgaattgtgatagatgatctgtatatcatcaaagctacagaaagctagacttctctgttaccattcctgtctagaagagcacatgtaaatacacatagattcacaatggccctcttgctagtcacaggtggtcaccagtgtgcagtggaagctgcatttctgtaaggtaatttgttagttgcttggaatggttttcttaaaagaaattgtgttttaaactgtagttaggttctgaggtcagctctcaaggtacatagttaaccattgtgtattcttccattgttctactttatatgttatttacattattatacatatcacattattttatactttcttttatttgttggaatggcttactgggctgagagtaccttataaacagggacagtgtgtcttaaaaagtgctcaggcctattcttggcaaatatgatttgttaggtatttttaaagtgaatgaaagttgacatttaataggttctagagaactatatgtctgataagtgttttcaagagagaagtttattcagaatttcaagtctgaaagccaggaaatattcctggcatatataaattgaagaatgtctgcaagtgatatagttcagtactttaaaattatggttgttacctaaagttcattaactcttattgccttgataaagctcttcagggaaagcctaacatttcttcagctacatagttatcagaaataaagagttagtactgagcttcagggcaggccttcttcaagtgtatacttcttttctgattcaaagataaattaagttatgattatatgtatattgagttctttgggtttttttggaattttaatggaatgtgaaacatgccattacaatagatttcaaaagcttagtcctataacacagaaaaatatttacctttttttcactatggaggtgagggtatttctgagatgccacatctcgactaagtaatttttaaaagagaattattcagtaaatgttttgattttatttttttttatttttaagaccttgcattattctaaccaacttctttatagggaaatatatgtaaatcagagtgcttttgcgtttggaaatattggaagcaaaaattccaaaatgttttatgttgaacatatgggaacagcatggaaatttgtgagcagtgctttaaataaaaacctgaatcatattatatgtctatattttgagatttaaatctctgttaaactagccccattctgactgccaggcatttgaggagacaccatgtcttaattttctcttatctcaagtgacactcacagagcctggtacataatagagctaccgatgtttgtgggaggagtggagtatgaaaactgactttggcatgttgaaaaccaaattcggtatttcggtgccttttctttctgggatattatatctcatatagtcctaactgcatattaaaatcagtgatggtacctttgatcaagcctgaggatattaaataactttaagaagtcagagcgtgaggctaggcaccatagttcacacctgtaatcccagcactttggtactttgggaggttgaggcgggaggttctcttgagtccaggagttcaagactggcctgggcaacatagtgagaccctgtttctgaaacagaaaaaacaaaaaacaacaaaaacaaaaaaacaattggtcatggtggcacatgctcgtagtccaagctactcaggcggctgaggtgggaggatggctagatcccaggaggttaaggaggtgggaggatggctagatcccaggaggttaaggaggtgggaggatggctagatcccaggaggttaaggaggtgggaggatggctagatcccaggaggttaaggaggtggaggatggctagatcccaggaggttaaggaggtggaggatggctagatcccaggaggttaaggaggtggaggatggctagatcccaggaggttaaggaggtggaggatggctagatcccaggaggttaaggaggtggaggatggctagatcccaggaggttaaggaggtggaggatggctagatcccaggaggttaaggaggtggaggatggctagatcccaggaggttaaggaggtggaggatggctagatcccaggaggttaaggaggtggaggatggctagatcccaggaggttaaggaggtggaggatggctagatcccaggaggttaaggaggtggaggatggctagatcccaggaggttaaggaggtggaggatggctagatcccaggaggttaaggaggtggaggatggctagatcccaggaggttaaggctatagtgagccaagtcacagcactgctctcccgcctgggtgacagtatgaaacctttcttaaaaaactgggtattagagtgtggatagcagaacattttaatgggattaaaaaatgtattcctttaatggtattattaaggggccaccaacatttttattttgaatcattatgtgaaacagttggataattagaaatttttcagtgatttgtgaagccagccatgcttattcttgagttccttggatgactgctactatagtcacaaagtcctatcttcctctgttttcactggtttaaatcaaatcattgtttttctaatgataacagcaacatgccatacctcgtgtccaccacaatgtatggattacctgatgattggagagaaatgcagtgactctggaaatggcattattgtgatgtatatatgcatgagagatttgggtgagagatggtacatttatccttccttaattaacttgccaatgagaaagagagagttcaagaacaaaaccttggaagttatggaagaatctgaaaatgatgtcctggaattagtttgcttatattttgggagtaatttttcaggggcactgaatttcacatgagcaccttaccaaatgcttacgtgttgtgtagcactaatgtaaacactgtaaatggtcactctctgaagatcagttatgatgactgtggctagcaggccgagttggactgcagaccagcctgccttgacattgcttattttattcttaagtgagggagactgatctacatgaatgtgtttttatacaaagattaacgggtgacattggaggggtactacttgatgaacactccacatgcaggatcttattcttcttaccatccttatgaaggtaagagctgttcttatccactgttacatagggctcatttgatgtaacttgtccacagtctcacagtcagtatgtggcagaataggattggaaaccagaccattcgatcccaaagacctaccttcctaccgtttaataataccctcctgttccagaaatatgcaaaagccaatgacaagacataaacaggaacatatggtaaattggtaaccagtaacatatgcctaatatttgaaaacttttaaggtaattcactccttctgccaaaaagatgtattgactacctaccatgtgaaatgctgtgtggcgtgtatacaagtcccacttaggttcttggttcagggactgagttgggtgtaatagaagcaatctgtaatatcaatgaagaactctcctacaaagtgggagattgctgctattaaaggactgaagaagagagtaaatacacttaaggaaaatctgggaagacatcatggaggaagctggatttgcactgggcttgggaaggccaggaagttacctgagatgcagacacagggtggggttggggcactggggtgaaggaaggtggcacagctatgaacaggagtaggggaaggaagagataggactggcgttttcaaaaatgggaacagtagtgtgaatgaatcgtaatggagcaattctgtggtgccgtatctgagcaagccttgatacctgactactactcagtaggccgtggggtgtcacagaaatccttggagtcatgttgctttctgccatgccagtgaagtgatcaagtgtgacacaagcaatcacagaagcctggtcatctgcattctggcagtgtggtcttctccaggcctaatgacatctctgtttctgttacgtttcccttgtattgtcaacttctcttaaacttgaggactcaccagccctagaatggaggaggggagtgtgttagtcttagtgaattccatgtgtctcatgtttctaagtcactttccatttcatgaaacattgtgagaaattactggtgtataatgatgactccgcctcatacagagaatgcttttgaacatactgcctttgaatttgattaggtgtagacagtcaatagtaggaaacgtaggaaactcccttcttccttccttccttttttttttttttcgacagagtctcgctctgttgcccaggctggactgcggtagtgcggtcttggctcactgcaacctctgccacccgggttcaagtgattctcctgcctcagcctcccaagtagttgggattacaggtacccaccaccatgcctggctaatttttgtatttttagtagagacagagtttcaccaggttgtccaggctggtcttgaacccctgaccttaggcgatccacacacctcggcctcccaaagttctgggattacaggcatgagccgccgtgccgctggaaacccttttccacagccgtataaaatatctatagaaggaccaagatataagaatgggtgaatgtattcatgaaacatttatagctcttttagagaatgtgaggtcaggatcaatatatttaaaacaatattttttaaattgaagttaaaaaaaagtaaaaagaaagaaacagaaacaaagctttattgaaggcttactgacgacttactacaggcttccttagctcctgtgctaagtctttcctaagcgcttttccatttaatcctgacagtcgccatgagaaggagggcttgttgttatccccattttgcagatgaggaaacagaggtttagagtgtgatttactgatactgtgtaactgctcagtcgcaaagtcagggttggaacacagcttggcctcactccccatgccgctgttttctaacgtctcctgtaagtggtgcttcggctcgtaatgccagtaaaatcacttatcaagcaaacctacaaaccggaaaggagtcccaggtcgtttatattctttctgacagaaaaatgtatgctttagatgtaagactggttttgataatactttgctccttttggttttgtctacatgaacacaatgcagcgtatggtttgggtttcttcgagtcactagagatgggctgcctcacaatcatttgtgttattgcatctcatgctgatcaatggaccacttattgcttacatgggtttgctggggatgttgggttccaccgtcttgcagttatttctgaaagttttaagtgcattcagccacacatgctattcagtaagtttacaacaatttgctcaatctttctgtgcatcattttataattttagagctttaaaaaatgctcttgtctgtttttgacatagagttgtttattttctatttacatggtattcttgtttagttttcatctacctcagaaggctttcatatagaattatctgctctgttggcttctgcagagttagcaggaagagtggcacttagtgccaggctgcatattaaggtagttcgagtggtatggcccacaactgatggccaccctcctgtcaaaatgtggtctccactttgtatcatccacaaagcagttggattctgattggaatactgacattgttctcataatcatttaaagataaatgggctaaaaatgttgcataaattctgtgttgtaaaatttattctttcgaaagttcgtttctcagtgccatagatgacactgacagcattattaatactttcaatattctagtgtcagaaatcatttgatgtcagtttaatccttttaatggttaatgtcagcattttagcatgaacgtttaagtgtccccaaagattgggttgattattcttcatcaagtaggctcattttaaagtcaagaaaatggctcacttgtactatcagctatgccttttcagggttttttcttctttaaatcaaatcattacaacttactatgctgacactgagttatagatctattttgacttactttatttcttaataagatcataggaaatctttttgcaaattaggcctttggaaaatgaaaacaatctcgtgtttctgtgattctaacaatgtgtttaaatcttagtgcatgacatctaaatttgaattttcgtagaaacaggtttccagagtgtattttcatgtttttatatatgatactctgttgtatttatatcacagataattatttgaatcagatttatcacttttctggcatattttgaaatagtcatacatagaaatgtggaaatacttcattagctgtagaggtgcaaatgtaccatataagaattatttgaaaacttatgtgcattctgagtatcagtacaggacttgggaacacaggccacatgtggagtttggtggtagactgctattgtttcaaggggcgaggatgagattttgttgtggacaacttcagttcatccaacaggtacactgaaccactcatgtcttccacggtgtcccgtctgttcttgcatgttcctctgccatacaactcacgaactatttgtgcacatttttttgttaacacatcaaacttgactacaacagaaccaaatgacatagtattctgtgttttcatagcttccagttcatgctgatcatcctattgctgggtttttgtttatgcatgtttttatgcagggcctgtcgatgggggtgtctttactgtgcgggctttatgtttgcagatgatccatagaaacacaaacaagaaattgtagcagcagtatttcattcctaaagctgaatgatgtcaggcataattactgaaactaacatctggagtggtttattaaagggaaacctgccaagattgttagcatataccaaacagcattatccatatgtgccattttatcactattgaatgtcggggtgtgttagtatgaagggaaatgaataaaatccagcaaaggatcactactaacacattatcttcccagaactgattttagtttagctcgatgaagcagtttgctggagattttcaaaattgtgcccatcacccatctggagggtttctgcatacctcggtacctggttatttggtcttgttagaattaaaatgtaccccttcaggaaagttctcttgaattctttttttatgttcctgaatcctagactataaacaaacaagcaaacaaacaaacaagatatcagatattaattgaggacccactgttcagtcttgttgaaaacttggcacacatgcttgaggagtttaatagggatcttgtccagtagggcgatgaaagaacactattgtgtgattgtcagatttcttgaagtagtactgaattactactgttcactcttttccttagaagacatctcaatggttgaatagagagtcttaaggcagcgaggtgatccttgtcaaactatgagagtttcaatccttatgagtaatatagctctaataattttgccattcagcttatttacagagtaatctagagaggctacaccaacctggcatggtaaatgttgtcttccttaggcacagatagaggatgtcatgccagtctacattctgtacatggagatggaggtggaattcatagatcttcaaaaatcatactaggacagtttttgatacaatggaaaagaaagtgttctccagaaaatgctcctaagttctcctttgtgccaattattgccaagtggtaaaaactgaaaggcaaatgacattgctgtcattttgttctgttgtagtcaagtttgatgtgttaacagaagaaatgtgtacaaatagttcgtgagttgtatggcagaggaacatgcaagaacagaggggacactgtggaagacatgagtggttcagtgtgtttactggatgaactgaagttgtctacaacaaaatctcatcctcaccccttaaaacaatagcagactactaccaaaccccacatgtggtctgttgttccctagccctgtactgatactccatttctaaattctgcaccaatacagtggctccacagctgctactgaatatctagcaatagacaccctgctcttaaatggctctggaggtgaagcttccattacttgtttttttcctgtaacagcttttcagagaaataccatttggctcaatttactcatcatcctaatcttagaatttccatgttttacgtagttcaatttagtaaacctctcaatttatatcattactttatcaatccagcatcatgataaaaggaagatgtatcacatgaataaaattttcttggatgatggaaacttacctcattaagtacaaaatatttcattttatgggataattgtctaaaatatattactgtatcaggcttctaagatcttagtgccatctttattttctgagtatatatctagaagtggaattcataagtgttagaatatgcatttgtttaaattcagtaacacaagcagttttccaatgtgattgtaaaaattttactccctcaacagtgtaagagtgttttggtttttgcacatactactaacacttggtctgtcattttcgttttctccattctggtggttatgtggtattgtcacattatggggctggttagcaattccctgatgactagtgaagcacctttcttatattattggccatttggatatctttgaaggatctattcaagtattttttgcatattttcattgaatagcctatcctttaaatcaggggtccccaacccctgggctggggaccagtaccagtccttggcctgtaaggaaccaggctgcacatcaggacgtgagtggcaggccagggagcattactgtctgagctccgcctcctgtcagatcagcggcagcattagattctcataggagcacgaactcttttgtgaactgcgcatatgagggatctaagttgtgcacttcttatgagactctaaccaatgcctgatgatctgaggtggaacagtttcatcccatggaaaaattgtcttccacgaaaccagtccctcatgctgaaaaggttggggactgctgctttaaatactcattagggtagtttctttatgttctggaaataagtcctttgtcagatatacttatcgaaaatatatttttctacttgctaggttgcattttcactctgttaatgatgttgtttgataaataaaagctattaatttatttttatttatttattttttgagatggagtcttactctgttgcccaggctgaagtagagtggcgcgatctcagcttactgcaacgtctgcctcccaggttcaagtgattctcctgcctcagcctcctgagtagttgggactacagccacgtgccaccacacctggctaatttttgtgttttctagtagagacggggcttcactatgttggccaggctggtctcaaactcctgactgcaggtgatctgcctgctgggattacaagtgtgagccactgcacctggccaaaagctattaattttaatagagtctaacttacaagtttttttttttttttaatagttaacattttctgtggcctgtttaagtttttttagcctatgccagggtcaccaatatactctgtgattttccgtgaacactttattgctttatttttcacatttacacttgcaatccatctggaattggtttttgtgaattgtatgaggtaggatcaagctgcctttcttccacattcaattgatccagcaccattaattgaaaagagcatcctttccctcattgcactacagggtcactgttgccatacatcactctattatgctgcctttgtaatggaaaactataatgaggacttctagaagtttgtatgtgtcacaagttttgtttcttaaaaatgtatgtgttagaatatgcaatcagagtcagttaatgtggaactccctgtcttgccatgccaacatgaaaataatagataaaatattttatagagataaatatgtatctgagattgaaaataaggaagaaaaaatctttagctgccaagaaagaagttaagactctcagtgctgagagagactgaatccacctaggtgataaggtgactggacccagtaaaccctttgtgtgctggggggttttatgccttgtagaacccagtgtgagcaagatttgggtaccctacatacattcagtagccaggaaagggtgattggattgccagactctgcctgctggcaaaaggatgagctgtagaagctgaagtcctaggtagtagatataaagaagacaaattaggtggcaccttctagactgtgcaatgcatggatttggaattgaatttttcctctaattattctagggaaaccctgggctaagaaaccaatgtaaaacctgatgaggtagtctgtagtcacactgggtagaggtagaggcaaccacaaaattattcttaagaatgcctcccaggcgcctggaagatgaaactttctggtgaatatgagctcatggtaaaaatttaggtcggatgcagtggctcatgcctgtaatctcagcactttgggaggctgagggaggaggattactttagctcaggagttcaagactagcctaggcaatatggcgaaacccatgtctacaaaaaatacaaaaattatctggacatggtagtgtatacctgtactcccagctaagtgtgagaattgcttgagcccaggagacggaggttgcagtgagctgagatcgcaccactgcactccagcctggcaacagagccagagcctatctcaaaaaaaaaaaaaaaaaaaaagaaagaaaaagaaaacaagaaaaaaaaagccatgtgcggtggctcacatctgtaatcctagcactttgggaggcctaggcgggcggatcatgaggtcaagagttcgagaccaccctggacaacatggtgaaaccccgtttctactaaaaatacaaaatttagctgggcatggtggcatgtgcctgtagtcccagctactcgggaggctgaggcaggagaattgcttgaattcagaaggtggaggtagcagtgagctgagatcacaccactgcacgccaactgggagacagagccagaccgtatctcaaaaaaaaaaaaaaaaggctggatgtggtggctcacacctgtaatcccagcactttgggaggctgaggtgggtggatcacaaagtcaagagtttgagaccatcttggccaacgtggtgaaaccccatctctactaaaaataaaaaaaagtagctgggcgtggtggcgcgtgcgtgtagtcccagctactccagaggctgaggcaggagaattgcttgaacctgggaggtggaggttgcagtgagctgagattgcgccactgcactccagcctggtgacagagggagactcgtctcaaaaaatatatatataataataaagcatattgaggagagaaggagactattatgagctttcaaagataataagcaggtaagtatcaaaaaatgatggacttcctacagactattttttattattattatactttaagttctagggtacatgtgcagaacatgcaggtttgttacataggtatacacgtgccatggtggtttgctgcacccatcaacccgtcatctacattaggtattactcctaattttcccctactccccaaccccctgacaggccctggtgtgtgatgtccccctccctgtgtccatgtgttctcattgttcaactcccgtttatgagaacatgtggtgtttggttttctgttcttgtgttagtttgctgagaatgatggtttccagcttcatccatgtccctgcaaaggacaggaactcatccttttttatggctacatactgttccatggtgtatatgtgccacattttctttatcctgtctatcattgatgggcatttgggttggttccaagtctttgctattgtgaacagtaaacatatgtgtgcatgtgtctttatagtagaatgatttataattctttgggtatatactcaataatgggattgttgggtcaaatggtatttctgcctctaaatccttgaggaatcgccacactgtcttccacaatgattgaactaatttacactcccaccaacagtgtaaaagcattcctatttctccacatcctctccggcatctgttgcttcttgactttttaatgatagccattctaactggcatgagatggtatctcattgtggttttgatttgcatttctctaatgaccagtgatgatgagggtttttttcatgtttgttggcctcataaatgtcttcttttgataagtgtctgttcatatccttcacccactttttgatggagttgttagtgtttttcttgtaaatttgtttaagtactttgtttaagattctggatattagccctttgtcagatggatagattgcaaaaattttctcccattctggaggttgcctgttcactctgatgatagtttcttttgttgtggagaagctctttagtttaattagatcccatttgtcgattttggcatttgttgccattgcttttgttgttttagtcatgaagtctttgcccatgcctatgtcctgaatggtgttgcctaggtttgcttctagggtttttatggttttaggcctcacatttatgtctttaatccaccttgagttaattttttaataaggtgtaaggaaggggtccagttttagttttctgaatatgcgtagccatttattaaatagggaatcctttccccattgctgtttttgtcaggtttgtcaaagactgggttgttgtagttgtgtggtattatttctgaggcctctgttctgttccattggtctatatatctgttttggtaccagtaccatgctgttttggttactgtagccttgtagtatagtttgaagtcaggtagtgtgatgcctccagctttgttctttttgctcaggattgtcttggctcttttttggttccatatgaaatttgaagtattttttttctaattttgtgaagaaagtcagtggtagcttgatgcggatagcattgaatctgtaaattactttgggcagtatggccattttcatgatattgattcttcccatccatgatgagcatggaatgtttttccattttttgtgtcctctctcatttccttgagcagtggtttgtagttctccctgaagaggtccttcacatcccttgtaagttggattcttaggtatttaattctctttgtagcaattgtgaatgtgagttcactcatggtttgcctctctgttggtctattattggtgtatagaaatgcttgtgatttttgcgcattgattttgtatcttgagactttgctgaagttgcttatcagcttaaggagattttgggttgagatgatggggttttctaaatatacaatcatgtcctctgcaaacagagacaatttgacttcctctcttcctatttgaataccctttatttctttctcttgcctgattgccctggccagaacttccagtgatgtgttgaataggagtggtgagagagggcatccttgtcttgtgccagttttcaaagggaatgcttccagcttttgcccattcagtatgatattggctgtgggtttgtcataaataactgttactattttgagatactttccatcaatacctagtttattaagagtttttagcatgaaggggtgttgaattttatcaaaggctttttctgcatcttttgatataatcatgtggttgttgtcattggctctgtatatgtgatggattatgtttatggatttacgtatgttgaaccagccttgcatcctagggatgaagtcgactttatcgtggtgaataaggtttttgatatgctgctggatttgcttcgtcagtattttattgaggattttcgcatcgacgttcatcaggcatattggcctgatattttcctttttgctgtgtctctgccaggttttggtatcaggatgatgctggccttaaaaaatgagttagggaggatttcctctttttcttttatttggaatagttccagaaggaatggtaccagctcctctttgtacttttggtagaattcaactgtgaatccatctggtcctgggctatttttggttggtaggctattaattattgcctcaatttcagaacttgttattggtctattcagggattcgacttcttcctggtttagtcttgggagggtgtgtgtgtctaggaatttatccatttattctagattttctagtttatttgcgtagaggtgtttataatattctctgatggtagtttgtatttctgtgggatcaggggtgatattcgctttatcattttttattgtgtctatttgattcttctttcttctttattagtctggctagtggtctctctaacattagatgaaagaagacatcgaaatttgaagtgcaaagagaaaataagtgttaacctagaattttgtatcaagctgaattgtcactggggattaaggatgagtatattttaaaacatgaacggaaatatggtatctttatatcaataggcaatgaacataattctaatttagagataaaaatttaaataataattgtttacttatttaaatctgtgaaactgagaaagattgaaaaatatagtagacaatcttgttgacaagaatcttgggacatagaacaacttcacacttagctgggagatttacattattcaatttttagagaaaaagtgacaaaggccttaaaattatgtgaggcctttgaacctgtagtttcactatgtgatatattctgaggaaataatatttaagcatttagctaccaagtgagtttaagagcttgaatttgaaaataaagtaaatgtgaaacatagggggatgggtgaaataaattgttaaatccatttaatagaattactgtacattcactagaaacaaattttttaacatgtcatttgataagaaagaacatgttcaatgaaataaatatatcaaacgagaaataaatacaaattgtgaatagcatgacctacttttacaatagcaaataagtatttatatctaaaatatttgaaaatatctatttatctatctatctatctatctatctatctatctatctatctatctatctgtctatctagctagctagctagctatctttctgtctctctctctctatcttcctatctgcctctctctttctttctctttcaaagttttaatggtggttgtacttaggtgttaatattgtatagttttaaaatattcttcattgcctatgttttattatttttctaaagttggattataatgttatataagaagagaagaaacctcatgttggagaaactcaaaccagtgtaattgttattatgtagtattgaatatacacattgactttacagtattgttgatagacagaacctgtctgctgtgttggttcatagtttttttgttgattttaaggattaagatgaatttctttctttctctctctttctttcattctttcttctttactttctttctttttctcttttcttttgagatgaggtcttgatatgtttctcaatctggcctcaaactcttggactcaagtagtcctcctgcctcagcctcctgaatagctggaactacaagtgctttctctaagatgaagttatttctgtgttttcaagtccactagatagttttcatgtttttcttacagtttctttaataacccaaatgatacaagagcactatagtgatttatatatatatatataaaaggtaacataccatatataaatttatatatttatatataatatatatactataatagaaaacatactatatatgtgtgtgtatatacatatatatagagagagtatgatttttgttaccttttaaaatagttctttttgattctctattcttaaaagcctttttatatttttttccagtattgttttgggtccagaccatttgagagtgacatatagaagtcatttgttacacgcatgagagtgttagaagtgacaagaaagaggcaataaagagggttttctggatggggtcagtttttaattccttattgagattttacagtagctcaaaagagatgcctgttgcaggccagttatgatggttcacatctgtagtcttaaaactttgggagccaagatgggaggatcacttgagcctgagagtttgacaccagcctggacagcatagggagaccctacttctacaaaaaaataaaaaaaattagccaagagtggtggtggtgcacctctgtaatcacagctaattgggaggctaaggtagaaggattgcttgggcctgggaggtcaaagcttcagtgagctgtgatcatgccactgcactccagcctggatgacagaacaagaccttgtctcaaaaaaaaaaaaaaaaaaaaaaaaaaaaacaacaaaatgtgcctgtttccattagaagataatttataagggattggaaaccaagattctggtatggagggatggactatcccagcggaacacaatgaaaagtataccttgttcttgccaataagaaagaaagttgcttctacctgtgttatgagattacacttaaatatactataaatattgagaattttgagagtattagcagtgagttaggatttttaaaaaactatggaaagaaaacatcaattattaatcctttgacgttttaaccttcctaggagagaaattttttcttttgagggtagccttgtaaacatacttccagattgggggataggggtgagttggggtgtggacatgaaacaaatacaaacattgacatttaaggcagtcatttttagaatattgttatttagtaactcttgatgtctggatttcttatagagataatgaaggaggtagtttttaaaacctgcctcatgtataagagaatgtttaggaatctctttataggaaaatataaagcattattaattacttgagcttttaaccttttaactttgtattatagaagtcaaaatcatgaagggagaaaagtgtttcattaatcactacaggatatttttcaaaatgagttaatggaagtttactctgggtctttaaacaaaatataaattgacataccgtgccaggtatctaaaaatactctgtttagggtcagaagcatgatggctcatacttataataacagcactttgggaggctgaggcagggggatcacttaaggctggaagtttgtgagcaacttgtgcaacatagtgagaacccttctctaaaataataataataataataaaattagctgcgtgtagtggtgcatgcctgtcattccagctactcaggaggttgaggtggggggattgcttgagcccaggaattcgaggctacggtgggctatgatcatgcaactgtactctaggctgggttacagagtgaggccctatctctaaataataaataatgaatacataaatatctactgtctcatactttataagatatgttcatattctttgtgttaactggagtttagggagagaagcagatagagtgggattaatacttgatggggaagccccaaactagttctggctctaacagtaacttggtatgtggcttagaaaaacactcagcctccttgagttcagttttttctcaatttttgggagagggtttaatttattagtgggtgatcttcaaagtccctgccactacaatatttcatttctgtgtgcagacacagtgatcccaaaagttgacattctgtctattgactgtttctaatattctgtatccagaattactttagcactagaatattgcagaatatgctactcaaaagtgtttttgattatttttacctagctgctttattaggctctttcattggcttttagaaagcattcagtaaggtttttaaatgaagtgaatatatagattttagaaatataagttaaacagaggttcaagtatatatatttttggtaccatgtccagcttttacaatatcatattgagagccttaactgtaaccaaataacgttttccagtctgtgtttaactatacatcaacccagtggatggttcataaagagtataattgacagctagtaaactcctagcaaaaatgaatcagcttttaacttcatattaaattatccttttctaaaaagactgaaaactataatcaagctctttctgtgtaatttgctatagattactactttaagagaataacatcctttgttaaaaaggctttttatactactggcttgtggtgtcccctcctcccactgaattaaagccttcaacctgctgttgtattccatgagcttttcacctgaacatttttacaatgagagcataatgagtgttgaaactggtatagattatttaaaataggcttagattagctctctattgctgttcttgacctccagggagaggaaaaaaaacatgcttcttagtacagaagtggaatttttatcaaatactttaaagcttaaattatactggtagaggctagactccacagttcattttttttatttctttagtccacttatcagatgagcaaatatgaatactgtgacggttatgatgtacctacaatagaaacaatagaaaatagcataataatcaatattttacatagaataattaggagcttaaaattgcttatttaatgatttatcaaaaatagtactaaactattatagagtgttgaaaaatgtgttcaggtttgctcacttcatggaatttatggaattatggttcagatgtttattataattctttttatagatgctgaaaagttcaacaccaattcctcactttaaaaagcacactcctgctgctgcttctacttttatatttcacactactccctaaatctattctggctctaggtaggtttaaagcctttcatcagcacgtggaacattctctaagataggccatatgatagaccacaaaacaagtctcaataaatttaagaaaattgaaatcatatcaattatcttctcagaccacagtggaataaaactggaaattaacttcaaaaggaaccctcaaaactatacaaataaatggagattaaataataactgaatgatctttgggttaataacgaactcaaggtggaaattaaaaaattatttgaattcaacaataatagtgacacaacttatcaaaacctctgggatacagcaaaagcggtgctaagaggaaagttcatagcattaaatgtctacatcaaaaagtctgaaagagcacaaatagataacctaatgtcacacctcaaagaactagagaaacaagaacaaactaaacccaaacccaacagaaggaaagaaacagcaaagaccagagcagaactaaataaaattgaaaccaaaaaaatacaaaagataaatgaaacaaaaagctggttatttgaaaagataaccaaaattgatatatcattagcgagattaaccaagaaaagaagatgatgcaaataagctcaattagaaaggaaacaggaaatatgacaaccgatatcacagaaatgcaaaagatcattcaaggctactatgaatacctttatgtgcacaaactataaaatctagaggaggtggataaattcctggaaatatacaaccctcctagaataaaccaggaagaaatagaaactctgaatagaccaataacaagcagtgagagtaaatcagtaataaaaaaattaccaagaaaaaatgtctaagaccatgtggattcacagctgaattctatcagacattcaaagaaaaattggtatcagtcctactgaaactattccaaagataaagagggaatcctccctaagtcattctatgaaaccagtatcaccctaataccaaaatcaggaaagaacataacaaaaagagaaacctacagaccaatatccctgatgaacacagatgcaaaaattctcaacaaaataacagctatccaaatccaacagcgtatcaaaaagataatacatcatgatcaagtgggtttcataccagggatgcagggatggcttaacatatacaagtcaataaatgtgatacatcacataaacagaattaaaaacaaaaatcatatgatcatcttgatagatgtagaaaaagcatttgacaaaatctggcatccctttatgataaaaccctgcataaaactggtatagaagggatgtaactcaaagtaataaaagccatctatgtaaaacccacagccaacatcatattgaatgggggaaaagttgaaagcattctccctgagaactggcacaagacaagatgcccactttcgccactcctattcaacacagtaatggaagtcctagccagagcagttaaacaagagaaaaaaataaaaagcatcccaattggaaaagaggaagccaaactgccgctgtttgctgatgaaatgattgtatacctagaaaaccctaaagattcatccaaaaactccttgatttgataaacaaattcagtaaaatttctggatacaaaaatcagtgtacacaaatcaatggcactgctatatagcaacaatgatcaagctgagaataacatcaagaactcaatcccttttacagcagctaccaataaagtaaaataaaataaaatacataggactaaacaaaggagatgaaatatctctacaaggaaaactgcaaaacactgctggaagatattataagtgacacaaacaaatggaaacacccatgctcatggatgggtagaaccaatattgtgaaaatgaccatactgccaaaagcaagctacagagtcaactcagttctcatcaaaatactgatgtgggttgggggggaatctctcaagatggccaaatagtaacagctccagtctgcagctcccagtgagatcaatgcagaaggcgggtgatttctgcatttccaactgaggtacccggctcatctcattgggactggttagacagtgggtgcagcccctggagggcaagcagaaacagggtggggcattgcctcacccgggaagctcaaggggtcggggaactccctcccctagccaagggaagccatgagggactgtgccgtgagggacggtgcactctggcccagatactacgcttttctcatcgtcttcacaacccacagaccaggatattcccttgggtgcctacaccaccagagccctgggtttcaagcacaaaactgggcagccatttgggcagacaccgagctagctgcaggaattttttttcatgccacagtggtgcttggaatgccagagagacagaaccattcactcccctggaaaaggggctgaagccagggagccaagtggtctagttcagtggatcccacctccacagagcccagcaagctaagatccactggcttgaaattcttgctgccaggagagcagtctgaagttgacatgggacactggacttggtggggggagtggcatctgccattactgaggtttgagtaagcggttttcccctcacagtgtgtaacaaagcctgggggaagttccaatggggcggaggcctccacagctctgcaaagccactgtagccagattgcctccctaaattcctcctctctgggcagggcatctctgaaaaaaaggcagcagacccagtcagggtcttataggtaaaacccccatctccctgggactcagcaccagggggaaggggtggctgtgggcatagctttaggagacttaaacgttccttcctgatggaactgaagagagcagcaaatctcctagcacagcattcaagctccactaagggtcagactgcctccataagtgtaagggagctccgctaagggtcagactgcctcctgacccctgtatctcctgactgggagacacctcccagcaggggccaacagacacctcatacaggagagctctggctggcatctgacaggtgcccctctgggacaaagcttccagaggaagaaacaggcagctatctttactgttccgtagcctctgctggtacccaggcaaaacagggtctggagcggatctccagcaaactccagcagacctgcagcagaggggcctgattgttagaaagaaaactaacaaaaagagaggaaaagcatcaacatcaaggaaaaggacatccactcagaaaccccatctgaaggtcaccaacatgaaagaacaaaggtagataaatccatgaagatggggagaaaccagagcaaaaaggctgaaaattgcaaaaactggaatgccgaatgcctcttcttattcaaaggatcacaactccttactggcaagggaacaaaactggatggagaatgagtttgatgaattcacagaagtaggcttcaaaaggtgggtaataacaatctcctgcgaactaaaggatcatgttctaacccaatgcaaggaagctaagaatcttgaaaaaaggttagaggaattgctaagtggaataaccagtttagagaagaacataaatgacctgatggaactgaaaaacacagcacgagaacttcgtgaagcatacacaagtatcaatagccaaatcaatcaagcggaagaacgggtatcagagattgaagatcaacttaatgaaataaagcatgaagagaagattagagaaaaaagaatgaaaaggaacaaaccaagtttccaagcaatatgggactgtgtgaaaagaccaaacctatgtttgattggtgtacctgaaagtgacaaggagaatggaaccaagttggaaaacacacttaaggatattatccaggagaaattccccaacctagcaagacaggccaacattcaaattcaggaaatacagagaacaccacaaagatacaccttgagaagagcaaccccaagacacataattttcagattcaccaagattgaaatgaaggataaaatgttaagggaagccagagagaaaggttgcattacccacaaagggaagcccatcagactaacagtggatctctctgcagaaaccctacaatccagaagagggtgggggccaatattcaacattcttaagaaaagaattttcaacctagaatttcatatctagccaaactaagcttcataattcaaggataaataaaatcctttacagacaagcaaatgctgagagatttttgttaccaccagacctgccttacgagagctcctgaacgaagtactaaacatggaaaggaaaaaccagcaccagccactgcaaatcataccaaattgtaaagaccatcaacactatgaagaaactgcatcaactaacgggcaaaataacacagctagcatcataatgccaggatcaaattcacacataacaatattaaccttaaatgtaaacaggttaaatgccccaattaaaagacacaggctgacaaattggataaagagtcaagacccatcagtgtgctgtattcaggagacccatcttatgtgcaaaaacacgcataggctcaaaataaagggatagaggaatattttccaagcaaatggaaagcaaaaaaaaaaaaaaaaggaggggtcgcaatcctggtttctgataaaacagactttaaaccaacaaagatcaaaagacacgaagggcattacataatggtaaaggtatcaatgcaacaagaagagctaactatcctaaatgtatatgcacccaatacaggagcacccagattcataaaggaagttcttggagaccttcaaagagacttagactcccacatagtaatagtgggagactttaacaccccactgtcaatattagattggtgagatggaaaattagcaaggatattcaggacttgaacttagctctgcaccaagtggacctaatagacatctacagaactgtccccccaaatcaacagaatacacattcttctcagcaccacgttgcacttactctaaaattgatcacataattggaagtaaaacactcctcagcaaatgcaaaagaacggaaatcataacagtctctcagaccacagtgcaatcaaattagaactcaggattaagaaactcactgaaagtcgcacaactacatggaaactgaacaatctcctcctgagtgactactgggtacataatgaaattaaggcagaaataaataagttcattgaaacccaggagaacaaagacacaatgtaccagaatatctgggacacagctaaagcagtgtttagagggaaatttatagcactaaatgcccacaagagaaagcaggaaagatctaaaattggcatcctaacatcacaattaaaagaactagagaagcaacagcaaataaattcaaaagctagcagaagacaagaaataactacaatcagagtagaactgaaggagacagagacacgaaaaaccctcgaaaaaaataaatgaatccaggatatggttttttggacagatcaacaaaatagatagaccactagccagactaacaaagcagaaaagagagaagaatcaaaagacacaataaaaatgataaagggggtatcaccactgatcccacagaaatacaaactaccatcagagaatactgtaaacacctctacgcaaataaactagaaaatctagaagaaatggataaattcctggacacatacaccctcccaagactaaaccaggaagaagtcaaatccctgaatagaccaataacaagttctgaaattgaggcagtaattaattgcctaccaaccaaaaaaagcctaggaccagacggactcacagccgaattctacgagaggtacaaagaccattccttccgaaactattccaaacaatagaaaaagagggaatcctccctaactcattttatgaggccaacatcatcctgataccaaaatctggcagagacacaaccaaaaaagaaaatttcaggccagtatgcctgatgaacatcgatgcgaaaatcctcaataaaataatgacaaaccaaatccagcaacacatcaaaaagctcaaccaccacaatcaagtcagcttcatccatgggttgcaaggctggttcaacatacacgaatcaataaacgtaatccattacataaacaaaaccaatgacaaaaccacatgattatgtcaatagatccagaaaaggcttttgacaaaattcaacacctcttcatgctaaaaactcttaataaactaggtattgatggaaagtatctcaaaataataagagctatttataacaaacccacagccaatatcatactgaatgggcaaaagctggaagcattccctttgaaaactggcacaggacaagaatgccctctctcaccacttctattcaacataatattggaagtgctggccagggcaatcaggcaagagaaagaaataaagggtattcaaataggaagagaagaagtcaaattgtctctgtttgcatatgacatgattgtatatttagaaaaccccatcatctcaacccgaaatctccttaagctgataagcaacttcagcaaagtctcaggatacaaaatcaatgtgcaaaaatcacaagcatttctatacaccaataatagaccaacagagaggcaaaccatgagtgaatttacattcacaattgctacaaagaaaataaaatacctaagactctaacttaacaagggatgtgaaggacctcttcaaggagaactacaaaccactgctcaaggaaatgagagagaagacaaacaaatggaaaaacattccatgttcatggataagaagaagaaccaatatcatgaaaatggccatactgcccaaagtaatttatagattcactgctatccccatcaagctactattgactttcttcagagaattagaaaaaactactttaaatttcacatggaaccaaaaatagtccatatagtcaagacaatcttaagcaaaaagaacaaagctggagggatcacgctacctgacttcaaactatactacaagtctacagtaaccaaaacagcatggttctggtaccaaaacagatatatagaccaatggaacagaacagaggcctcagaaatcactccacacgtctgcaaccatctggactctgacaaacccaagaaaaagaagcaatggggaaaagattccctatttaataaatggtgttgggaaaactggctagccatatgtagaaaaccttttacaaaaattaactcaagatggattaaagacttaaacctaagacctaaaaccataaaaaccctagaggaaaacctaggcagtaccattcaggacagaggcatgggcagagacttcatgagtaaaacaccaaaagcaatggcaacaaaagccaccattgacaaatgggatctaattaaactaaagagcttctgcacaacaaaagaaactatcagagtgaacatgcaacctccagaatgcgagaaaatttttgcaatctatccatctgacaaagggctaatatctagaatctgcaaagtacttaaacttatttataagaacaaaacagccccatcaaaaagtgggaaaaagatttgaacagacacttctcaatagaagatattgatgcaaccaataaacatgaaaaaagctcatcatcagtggtcattagagaaatgcaaatcaaaaccacaatgagataccatctcataccagttagaatggcaatcattaaaaagtcaggaaataacagatgctggagagaatgtggagacataggaatgcttttacactgttgatggagtgtaaattagttcccccattgtggaagacagtgtggcaattcctagaaactagaaaaccatttgacccagcaatcccatcactgggtatatacccaaaggattataaatcattctactataaagacacatgcacacatatgtttattgcagcactgttcacaatagcaaagacttggaaccaacccaaatgcccatcagtgatagactggatagggatgggagcaaagaaattctaggcagaaaagggatggggtttctggtgaaaaccccactctcaagttgaaaaacctgaaactgtgaggacttacatccctattttcctgcttgaatgttgccttttcctaaaacacccatggccccaccccaccccatcctctgcccgtaaaaaccccagactcagctggtagatgggactacggctggatgttggagagaagcagcttgacttcagagggacagcttgatggtgtaacttcgaagaagaatcagatcagagacggctggacttgagggaaagattacctacctgccccatcccctttttgtctccccttcctgcggagagccactttgatcagcagtaaaatcgcccacagttaccatgcttcagttcattcatgtgatctcatttttcttggacactggacaaaagctcgggatccattagtgtagatacaaaaggcagtcacactagttcattgccttcactggcagagggcagctgcctcatgcgaaaaggcaaagggcccactgagctgttaacacttaagtcatctgtggacagcagcgttaaaagagcactgaagcctctggggcttcaggagtggcaggcaatcctgcctggatgctgctgtggggcttcatggagtttgcccctgcctgtgctaaagcatctagctggttccagcacccactcacctgtgtgctccctcctgcaaggagtggaacacagcaagtcttgagtgagtggagtttgatcccgctgtcactgaagtggctagccctttccagtgcttgttgactccagttcccgcacctgtttgcttgtgctccctcccttgaggagttgagagtggcgggctaagtaaacaaggcacccctgttgagagtctcatgaaggggtcagggaaatatcctgcttcaataccatcatcattcttcacagaagttagaaaaaaaaaatttaaattcatatggaaccaaaaaaaaagcctgaatagcccaagcaatactaagcaaaaagaacaaatctggaggcatcacattaccatgcttcaaattatactacaagtctctagttaccaaaacggcatggtactggtataaaaatagacacatagaacaatgaaacataatagagaactcagaaataaagccaaatacagccaactgagcttagacaaagcatataaatacataaagtgggggaaggacaccctattcaataaatggtgctgggataactggtaagccacatgtagaagaatgaaagtggatcctcatctttcaccttatttaaaaatcaactcaacatgtatcaaagacttaaatctaagacctgaaaccataagcattctggaaaataacaacagaaaaactcttctagacgttggcttcagccaagaatttgtgactaacaactcaaaagcaaatgcaacaaaaacaaaaataaacaaatgggacctaattaaactaaaaagcttcggcacagcaagagaaataattagcagagtaaacagacaacccacagaatgggagaaaatatttgcaaactgtgcatctgacaaaggactaatatccagaatctacaaggaactccaacaaatcagccagaaagaaataattccatcaaaaactgggcaaaggacaagaatagatgattcttaaaagaagatatacaaacaacgaacaaacatatgaaaaaatgctcaacctcactacttatcagagaaatgcaaattaaaaccataatgagatataagaatggccataatttaaaaaattaaaaaataatagatgttggtatggttgtgatgaaaagggaattcttttatgctgcttgtgggaatgtaaactagtacaaccactatggaaaatagtatggagattctctaaagaactaaaagtagatctaccatttgatccggcaatcccactactgggtatttacctaatggaaaagaagtcattatatgaaaagacacttgcacatgcatgtttatagcagcataatttgcgattgtaaaaatacagaaccaatataaatgcccatcagccaatgagtggataaagaaaatgtgctatgtatacactgggaatacaactcagccataaaatggaatgaaataatggcctttgcagcaatttggagttggcagccattattctaagtgaagtaactcaggaatggaaaatcaaatactgtatattctaacttgtaagtaggagctatcaggatgcaaaggcatgagagtgatataatggactttggggacgtggagggatggctgggagggtgtgggtgataaaagatgacatattgggtacagtgtacactgctcaggtgacaagtgcaccaaaatctcagaaatcaccgctgaagaacttacccatgtaactaaacaccacctgttcccaaaaaactattaaatttagaatacaaaaaaaataaaaaataaaaaacacacttaataaaatagtaattgttaaacaattcattaggtgtagataaaacatttagactacagataaggtcagcataatacttagtggttaaataagagaggcattcctattaagtttccaaacaaggcaaggatcccactgtgttcattgctgtttaatattacattggagataatagccaatgaaatcaaacaaggaaaaatagaggcttaagaattacacataagaaggtgaaactacctctttacagatgatactagaaaatccaaacaatcaatgagaaaacaaacacagtaaaataattcaaataagatagcagaatataaaattaacatacaaaagtcaaaagccaggtgtagtggtgtgtatctgtagtcccaaactactcgttagactgaggtaggaggatctcttgatcgcaagagtttgagtctacctgggtgagatagcaagaccccgtctcttaaaaaattaaggaaacccttaaacttctcctggagggcccacaagtagacttgaacaaatggatagttataatttgttctttgataggacaactcattatcataaaaatatcagctatcttcaaattaataaatttaattcaatactaataaaagtgacaaagttttactttgagcttgatgatttgattctaatatccacatataaaataaacgtacaaaaataggaagacctgacagtagaagagtaatggggaaattgctttttccaatatgcacactctagagcctctgtaatgaaatagtgggtgctggcatacgaattggtcatcagagaaaaaaaatcaggacatagacccaagaacacatggaaattcactgtaataaaagtggcttctcaaatcagtgggaaatgatagacttaaaaaaattaatagactatgtttgattgtggtaaaatccatactacataaaatttgccatctgaactattttttaaggtatacagttcactagtgttttgtcatattgttgtgcaaccattctccagaactcttttcaccttgctaacctgattctgtacccattaactaactcccagcacctccccatcccccagccaccggaaactatcattctactttgtgcctctcattttgactactctaggtatcccatataaggagaatcatacaatatttatctttttgtgactggcttatttcacttagggtaatgtccttaaggttcatgcatgtggcatgtcagaatttccttcctttgtaaggatgaataatgttccattgtatgtgtatgtaccacattttgtctgtccatttatttatcagtagactcttgggttgcttctactttttggctgtgatgaatgattctgcaatgaacatgggtatacagatttctcaggaccatgctttgaattctttttgatatatactcaaatggaatgcaggatcatagggtaattctattttaaactttttgagggacttccatactctttaccacagagactataatattttacattctcaccaatagtgtgaaagggttccggtttctccacatcatcatcaacacttattattttctttttttttttttgatattagctattccagtgggcatgaggtgatatctgattgggttttgatttgcgtttccctaatgattaatgatgtttggcatctttttatattctttttggccatttgtatatcttctttggaggaatgtctattcaagtcctttggctattttataattggattttttgttattgttgatttttaggacttcttcatatgttctgtatattaactctttattagatacatgatttgtaagtattttctctcattctatgggttgccttttcactttgttgattgtgacttttgatacaaataatttttatattttgatgtaatccattttatctatttttattgttgttaccagtgattttagtgtcatagccaagaaatcaatgccaaatccaatgtcatgatgagtgatacagtttcacctctttcatttgggtctttgatacattttgagttaatttttgattatgatataaggcaagagtgaaaattcattatttttgcacgtggatatccagtttattcagtaccgtttgttgaaaagactgttcttttaccactgaatgtttttgacacacatgtcagaaattactcaatcatatatgccagggtttacttctgggctctctattctgtttcattactctgtctgtgtttatgccagtactacattgttttagtttgattttattttttaagaagtttcaagtttacagaaataatcaaatgaaatgtatagagttcctatatattccttctccccaccagttttcctttgttcttaaaatcttgaatttgtgtagtgtatttgttgtaattgcataggcaatattgagagattactgttaatgaaggttcatagtttacattaggattcactgtttgtattgtatatgctatggggtttgacaagtatgtaaggacatgtgtctagcattacagtatcatacataaaacaagttttactgctctaaaaatcttctgtgctctgcttattcacccttttgtcccactaatctctggcaaccactaatctgctttctgtctccatagttttggcttttccagaatgtcatattgttggaatcatacagtgtatagtcttttcagattggcttctttcactgagcaataagcatttaaggttcctctgtgttttttggtggcttgatggcccatttctttttatttgaaaagttagacttttaataagttgtgttggaacacctagataatcatttggtaaatatgaagtaggagacatactgtacaccgtacaccatcataaaatccagatgggtcagacatctaattgtagaaaaaaagaaaagaaaaatcaagaaaaaaagtgaagccagataaatactaaaataaaatgtgggtaaattcacttataaattggatataaagaaagcctttctataactcaaaaccaagatgaaataaaagaaaagattgacaggtttgccagtggcaacataaaaactttcaagaaaaagtttttatgtatgaagaaaactaccataagcaaaaccaaaagacaaatcataaactgggaataaatgtttacaacacatcatatataaagggataatctacctaatattaaaggattcttaaaaatcagagaacacaggagaaacttaagagacaaagggataaaacagggacagagagctcatgtaaatcggtacgcaaatggcttttagacctatgagaaggtgttcaagttcacttataataggagaaatgcaaattagaatggcactatgtaactaaactcaggtctgagccacttgaaaaccaaaaactcaagagacaagttttggtgaatggaaagttagtttttttttccaagaagccagcaactccaggaagtcagtgaactagcgtttgaagaccgcctttctaagttgtgaatctagatcaggagtttttaagggaaataggggaaatgatgatcagagcattcttgtgaacatgcatagtatcaggtggctgttaatcattgctttttcttggtgaaagtcttgtggcctcctacaggctattaacaggctggtcagcccattcccagcgctgctggtattttcttttatctttcttgaacatcctgttttcctgaggctgtattagatgaataatctacaaactcatgcaaaataataattacattcaagcaagcaagctttttctaacatggagtcagtagataccattaacctaatagatcagaaaacatttaaaatcttggtgaattctcttggtaaagacaagggcaaaaagagcccttaagtacctggctggtgtgagtgcccgagggtcccactccatggagagagatttggcagtgtctaagaatgagacctccactgactgtcagtgcccacccctgccctctgtgctctgcatctttccatgttccagggtgaattttcgtgctagaaccgtgtaagtttcctctgcccaccagcttgtaggctggaattcacattctctgggagaagctctcaaccagtggctctcctgttgctgttattcctcaggaggcatgattttgaggcatgttccttgcgccacttccagcgtttcccttcgggattctgagaccctgtcccctgggggcgcgggctgggagagcaccctttttgtctgccttttcctcctgtgttacctcctcgccttcctatactccctgcatttccctcataagcaacttgcactcttttccttgttacaagttctgcttctgaagcttccttacaaatatctttcagtgattgaaattgaaattagtgttctgtgcctccaggccctgctcccaacaccctctaaaagtgacctgctctgaattcctaatgatttaccatttctggaaacttaactcacatatcttctatgtactccctagtaatttcctttttttttttaatgtgaggtgtaaactcctggaggagaaaaagtgtgattctcaagggtcaggtgtcgtgtcttgcatatagttgtcacttagtacatttgttgaatggaaagtagtaacacttttctaattttttctcaaaattcttgtatacactgatgtgatatttataaagcttctttcttcttatgtgttttctttttcatctgttacacaaagacaatcatgatcgtttctgttgttgaaaaagtgtgactttaaccattttttcctcacttctcatttaaaaataaaaaatttacagcaacatggacctagtaaaacctgatttaacctagaccaaacctacaagaaaatatggctcttgacaagtagtaactgtcttaaaaagaaggcggattcatttaaaccattagcacacctgtaggttgctggtacccggcattatccctacaacattggttttctgtaagatcgattacttgaccttgcctgaaaagattttttcagaatctagctgtgaacctgttattattgttttaaccccaatatgggtacataaaatggatacaattcccagtggtcagaggacatacactggaatacatttagcaggaaggctgtagcagagcgattagcagagattaagaaagtagtattaaagatttggtggctgttcctcgtatattcatatattcaaaataaactttaaaatgtgtagggcagtgggactctgactcataatgttagttttaaactaattactcttatagtagtgctgttccctttattgaaaaataagtgttgtattacaatgttcaggctctttgtctttatacacataccagttacataaacgggtagtattttctaattgtatttgaccctaggactcaacagatgcaaatggtttatttgcattccatctatggcagctagttcagaaacttattcaactttctcctgaattggcagagacaaagggtcttcagtagtgacacagttcattctggttattcaccacatctaaatgatggacatctaaatgatggactgtcatatttatcctgtccctaaatctcattttctcattcttctaagtgttgatatttgggtctccctactgaaattgtacagagtatcatttttggggggtccttttgtaaggcaacttttttgagatataatccacacattgtacagttcactgacttaacagatgagcattcccagttctccatatttttgccagtgcttgttattgtccatattttttgttctagccaccccaatgggtatgaggtggtgatagggacaggaggcagggaaattctgggcagaaaaggacgggtccctggtgaagtccctatcctcaagccaaagagcctggaactgcagcccaaagtgagaacttatgctcctgttttctgctccaatgttgccttttccaaaaccacccatggccctgcccccaacccccatcctgtgcctataaaaaccccagagctctgccagcagaggggagaagcagctggacatcggagactatggttggatgtcggaaagaagcagcttaacctcggagggacagtttgatgatgttgctttggagaggattctggccaggacggctggactccaagggaacattaccttcctgccctgtccctttttcatctccccttcgcgctgagagccactttcaccaggaataaaatcccttgcatttactgtcttcagttcgttcgtgtgacctcattccttctggacgccagagaagaacttgggtgccacaagtgtgggtgcaaacggttgtcacactgaccgtccactgagctgttaacacttaagccatccacagacagcaaagctaaaagggcactgttgcacttcctctggggcttcggatcacgggcactgtaccctaaaccctgctgcagggccagtacagagttcgctcttgctcctccccaaaagcgctcgccccagctcctgcacctgttcacatgcactccccctcctgtgaggtttggagcagtcagtgagtagaattcgcccctgccagcaccagcacgagtgcactccatttcccgcctgtgaaggggtcagggaaataatctgcttctgtggtacttgtggatttgagttacatttctctaacgactaatgatgagcatctttttttgttcatggtggtcatttacatatcttctttcaaaaacgttttcagatcttttcagatcctttgctcatttttaattgggtcatttcttgttgagttttaagatttctttatagattctggttaaaagtcgcttatcagataatatgatttacaaatacattctcctatcctgtgcgttgttaataatatcattttatatttaattttttaagctctcatagaaggattactaatcttttacttgcacacttctggtacccagaagttcttcagtagaggtttatgaataaatgagtggtgtatctttacctcccttctcaactactaaccaaactaaatatgcttagttcctcagttgagcctcatattttgccatctctcaatctctcaagagtgagaatgaccattctttggaagtctgttgatgtaccattgtgccttattgcagaatggtgttccaaactggactgtaatgtgacttccctattttgggtacattgagggtatcagttcctttgaacttgatactgcttttctatttattcaacttaagatttcatgactttttaatgcaactctgttattattttgcaaatcagtgaactattgttatattccgtggaataatagatcaaagtcagagaaagtgcgtaagtgaaaaatagaggatatcagccttgacagcagttcatagaaaaagacctgggctttttagttaactaattttatataattcagtggtaagacaaacttcaatagttttgttgttctttgaagtttcttggtggttttatttttaatgaagttcttcctgtcaattagagctgtgaaataatggaacgggtgacttgaaaagtaatgacttccctgtcaccaacattatttaagtagaggctgggtgactaacagggatattgtaagaaggggctcttgaatggagggtccatgactgagtaacccatgagaccagcttctttcacctctaattttgtgatctaaggatcacctctgccaagatccttaggagaaaaggtcagttttttgtgtacacatgcattatattttcagtttattttctcatcaagcagatgcctttaaccttgaaaggctgctttatttcttcattgaattattttggcttataaggaaaatatgtctgtagtactaatcattaatgattttaagtgtatatactcagataaatttttgcttagttgtgcattcccacttttttttgtcatgaagtttcacagctgtatttagtaaaatcttttgagagacagccaagtaactgatttttttgtggcaagccaatggcatgtcaaatttggatttatgttggaaagctgttttgcagacataaaagttgaaataaacagccaaattatcatttctcccaaatttggatgtgggaaagtgaatatgtgtttggcttttatttctggaataacttgagaatggataaataggttttcctgtgtgctgtattaaacgtgtgcaattttgcagcaagtccaaatgtgagaaatttaatcccaaagaattatgttaagtgtttgaaaaacatctattacttgggatcatctcctgtgtgccaggcactaggccaggtgctttacaaatgttatctcatgtaatccccaaaatagaactgtggttttataatcatttctgttacaggcactaaaatcaagggcatcacagtttaaggtaatttgctcaaggtcacagaatcagtaagtatgaattacaaatttgggattcggacccaaatcttcttgtctctggtctctggcctattctttgaaggcttccccaagttcttcaagttttacttatttttgtgctgtaataggaaattataagtaaggttcagatatttgttatttaataatgtgacttctgattcatacttaacagtatttcagtatgtttaattctggttttgtataatgatttaaaatccaaaatagcagtgatgcaggattttgactccttagttcagctaaatctgggttcttatctcatgaccagaaagaattaagcacatggacacattgaagggtgaggagggtggaatttattaacctctaaaggaaagctctcagcaaagaaaagggtcctgcaagaaggtttccacctcacaaattgaataccagggccaccatacaggagctgaagaggctacgctcctccctgcataaggcgcaaattcctgatggctccgcccagttccctcagggcacatgtgggcatgcccaggcaagccataggtagtattggaaaagacaacattccattggttaaaaggcattattcagaaagaatcaattaggaaagggcaggcaaactggggcagatgttctccctttgggtcttgggtttcatctgagaccagcagtccggtcttcagccttcaggctgttttaggcttgaaggtgaggtttcaccagggacccttccctatctgcctaggcatttgtctgcctcctgcctctatcagcagcatttctctattataattgttaggaacagaaataattaatctgtgtcctagactatttgtaaactctacctcaatgtaaatgtagttttataattaaaatgaaggatcatcaagaatctagctattacttttttttgaaaattaattttcctccaaccttttttttttttttttgagatgcagtttctctctattgtcaaggctagagtacaggcccactgcagtcttgaattcctggcctcaagcaatcctcctgcctcagcctcctgagtagctgggcccacagttgtgcaccaccacactgggctaatttttaaattttttgtagagacaggatctagctttgttacccaggctggtctcaaactcgtgggctcaaatgtcctcctgcctcagcctctcaaaatgctgggattatagatgtgagcccacactggccccctccaactttttatgggaggtgttcctgaatggaatggcttggcctttgttgtacatcaaggtaataaataaatggtcctcacttatggcttaactttattttccccaaggatttggcacaggtgttgtgtgaccctgattcagggtttgtggaaccccctctgggtagtgaaatagatgatcttctcaagatagattatacaatcatgccttaggctggtctttgagtgttatattatctcttcctggctcttttaattttctgctacagacagaacttccattgtatttaaaatagcatttattttataataaggctgaaaaaaaaacagtacaaaagacttagaagaatatagtcaaggtagagttgatgtcaaatggaaatggtaacattcatttaagtagagcaattaaaaatggccttggggctcttagttttacttgccatattgtcagttctggagccactggtaggtattttgtccttatcatttcaaagcacacagttgaatttattacttcagttattatcctcagttacttctattttttaggatacttttaacttgaaggattaaaaaaaactaatcatatagaaccatctaaagccaacataaatttaaatcttagtctcatttttatcttaatgataaaataatgaattaaagcttttatacattccgtgttgaagttgtctctagtgtattcatgattgaaaaatatactctacatgtactttcaggcttatatgaaatacttttcaagtatcaaatatttatggaaaaaaaatctgcgttggctctgaatctgttacacctagagcctcactgtaacactgtccttgggttctgtaatgattaacatttggcacttaagtaataaaaccagttttacaagggccaaaatggacccttgtaaatgaaagtggcctctaaacatactaaaatgcatgataactttaacaaatctttaattctagattctttagagggtgtcaccataggatgattgatgctgaaaatgagctatgtcatgttcactttttctctgttacgtactggatgcttatttatttagaaatttggtgcataaattgttgtctgacactgtttgaatatttaatggccagtcatttctatgttacccctaaggatgtcttcctttacttttagagttcctatggttcctcctcaagttatgaattagtgttttcatgaggtagcagagaagtgtccatattaccttaaagcacacataattagaaacataaatgcactgaatacacttagcactcaacaaacacctgtattgttacctaaaggccaaatgattattcttggattatccacagtgtagctggtctgtatcactcttcattcgaatttagaataggtaattaaaagtcatttatctgtgattgtattgctcagaaacatgaagtatgaaatttctataccagtgcctcatagtaaattctttccctaaagacaagtaattatggatccagaaacatttttccttcactgaggagaggggtgattaaaaagctcacttcgaagtccaaaatactgcagatttgttgagacagttttgtttccctgacatgttgattgcacttcacatcacacacaataccgagggacttattctgtaaggtttctggccttcccctttatcataattgcagagtgtcacattgatctgatggagatggatttagaacagttgttgattggaagctcttgataaagacagggagttcaaacacagactctgcctggaaattcagcgtgaacatccctcatctatcataatttaaccgatgagaaagatcaagttaacctgccatccatcatatctatttaactgtactccagagtgaattaaattgtatttaacaacttttatcttacagggtttgcacactgaaagagaacagcacttcttcatcaagttgttgctctctgtttatcaatttaagattttgaaacttgttctaaaacattcaatatccagtaaattcctttcaaagactttatggtccttaattttcccccaagttttgttcttactggtaataatcaatatcagtttagtactatagcaatggagaagtattcttaggatgcaatggtataaaatagtatcttatccttgaaaatagacgtgctcaattgaaataagcttggttggtattgcaagtattaatttggagtactttcagacattttaagaggtatcgttttagggccatagaatagtagagttaggagggcacctgaagatctaatttaatcctttagtttgcagctaaggaaactgggctctaagggtacatgactgtcataacaaggccatctaagttatctgcaatagtgctgggataaacatgcaggatttctgactcctggaatagcttttctttgatcctaccatgtatctttatgtacagattctatgtggattctctgaaactcatgtcttatcagtatcttttaggattaagggagaggggaaagataaccatggcacgaaataatataacagacccttaaaacttgataccatcaattttgagttacaagaggaaataaatggggaaagtaagggaaaggagatcactctctgttcttgcttttctccaacctactaacattagagaactgataaaaaatttattcatagactttgctgatcaaattgttatgtgttgccatcttgaataatttgtacatctgcagaagcaagaaaaaattaagttttctttttggagagcaagaaaattcaataagaaaacattttctaacgtcttgatagaaattattggtataaaaacttaggtctttagttaggatttgatccagcccaagatggaaaacacaaaataagaatggtgtaagcaagtagaatttatttttcctttaaaggaaaaggagtacacaggttccttctttgccttctctgtcttcctaatgtggcaatgaaggttcaacataccttccccagccctggccatcacatcctcagctagcctgaaggggtgagtgatgaacagtagggcgaggggaagggccagtatgagctggcttcgaaggtggtgtcttaagcagccacatgatacttctacttccatttcattttcattgatcagaacttagttatgagaatacctattgcttcaaggaagactggaatattcagtctgtattctgggtagccaggagtccagctaaaatcaggattgtgttactttatttgatcttaataaattataatatttgattttttatttttaaaaatattactttttttagagacagggtcttgctctgttgttgctcaggctggagtgcaatgacatgatcatagctcactgcagcctttgccttctggtctcaagtgatcctcccaccttggtctcatgagtagctggaactacaggtatgcacccccatgcctggctaatttttgaaattgttgtaggaacggagtctcactattgcccaggctggtctcgaactcctggtctcaagtggtcctcccaccttggcttccaaaaacgctgagatttcaggtgtgagccactgtgcctggcctcacaatatggactcttgagccccataactgaaccgcagaataagaatccctgtgtttatttggaggttcttttccagcaagcttttccagggctccctatgcagccagcttcacatgtttaggaatcattgcactacaatataggctagacatactgatgcaggatttttgctccttagttcagctaaatctgggtttttgtctcatgaccaggaaaaattaggcatgtagacacattgaagggtgaggagggtacaatttatttattttacttattttgtattttaagttccgggatacatgtaccgaatgtgcaggtttgttacataggtgtacatgcgccatggtggtttgctgcacctatcaacccatcatctaggttttaagccccacatgcattaggtatttgtcctaatgctcccttttcccttgccccccaccctccaacaggccctggtgtgtgttgttctcctccttggtttccatgtgttctcattgttcagctcccacttataaatgagaacatgtggtgtttggttttctgatcctgttagtttgctgagaatgatggcttccagcttcatccatgtccctgcaaaggacatgatctcattcttttttatggctgcatagtattccatggtgtatatgtgccacattttctttattcagtctatcaatgataggcatttgggctggctccaagtctttgctattgtaaatagtgctgcagtaaacatacgtgtgcatgtgtctttatagtagaatgatttataatcctttgagaatatgcccagtaatgtgattgctgggtcaaatggtatttctggttctagatccttgaggaatcagagcacagaatgtattaagcaaaaggaatgctctcagcaaacagagggtccctgtaagcaggtttccacctcacaaactgaataccagagccaccatgcaggagttgaagaggccaggctcctcccctgcataaggcacaaattcctggtggctccaccccattcccccagtgcatgtgggcctccagtccactgtgggcatgcccaggcaagccccctgggcaggttctcttttctgcacaaaacatctggtgtaaacccttgtggggcaggttggagattctccgggtacccttccctaatcctaggggatttggctgtctgctgcctctatgactaccttacctaccatagagatgaaggttcctcacactaaacatttcacacttatgaaggggtcagaactctcagtatattccaaacctacatccaaaagtaaagctggcacacatcagctttgcattaaatatcttgaagccatttctgagctcactaggacaatgggcccagaggacaaatgagtaatcttcatttcgagtaccacaaaggacgacagagatcaagcaccccaaatctgtatgtgtcaggggcagtggagtgtggaggaggatctacaggaaaagaaggaacatgatggtacattatttctgttgaaagcaaatgagggcacagtgcaaatgccaggcaggcacctgtaatctgtgacatttcagcttttaaatttgattttggcttatctaataaatatgggatctgtttatattattgtgatttcatgtctacttaagagtttaatgttataattaagtccttactagttttgtgagtactaaatcgaagaattgctatcatgtaattctttgaacagataaacatttttgggagagggaaggcaaatctggattctggtagggttgatatttaatatttatcagttatggtttcagaagaagtgaaactgactacagatctattacctatgttaattaaaagaagggagcaaatggcatggaattttactactccttgaaaaagttctactagcattaatgttctagggggtattgctaaattcagttaaaattagtccatggtagcctcgttggcataatagggaaaaagtgaattctccaaagaatgaagctttcaaattcattaggacaaaaaattacctgtcttcctctgggtatttatttttgctacagcttgagctcctctcttagtttcagtgccacttgatagtatggacagataaaactccacggtgggggtcacacacacacacgttaaccaaaaataaaattctaagccctgcaaccaactgaatggatcccccttatggccgaggggattccaaagaaacctgaaaaactagttcaggtcatgaaaggaagtggggaccaggcatgcctcattgtaccttctctcttttggagtttagatacaactgaccagcattaacattaaaacagagatctggctgggcatgatggctcatgcctgtaatctcaacactttgagaggctgaggcaggcagatcacttgaggtcaggagtttgacactggcctggccaacatagtgacaccccatctatactgaaaatacaaaaattagttgagcatggtggtgggcggcgcctgtaatcccagctactcgggagactgaggcaggagaacagcttgaacctggaaggtagaagaagttgcagtgagccgagattgtgccactgcattccagcctggccaacagagggagactctgtctcaaaagcaagcaagcaaacaaacaaacattaaaacagagatcttaagactgatagaacatagtctttgtaccaaattccagcctgactctagtataacatcacatgacagataaagaaggaaatagaaatattttaccctaaaatatgtctctaaatatacctaaaaaatatacctaaaaaatttgccatattttgaaatggctcttttcatctataaagaatgtctattaacataactagatctttccccttgcagtccttcccagtcctaaagagattaactaatagtctggcacctttcaaggtcttaaaagaggcatttaccatctattctttctgaagcctgctactgggagtcctcatctaatctacctaacaagaactttggcttccacaacttcccttatcttaaagtcaagcattttttttttttttcctgttgacttcaacttcaggtaaagctgaactcttttaaccaattgccaatcaggaaatctttgaatccttctttgacctgaaagcaccgcctccccccaccccaccctggccaaaatatgtagtattgattgatgccctttgtctccataaaatatgtaaaaccaagctataacctaactacctcaggcatatgttctcaggacctccgaaggctgtgtcacaggtcatggtactcacatttgattcagaataaatctctctgaatattttatagagtttggctttttttggtcaacactcacatgacttcagggctgagagacaagtgaccttagtcactaagtggctgggcataagaagggtcacaactgcttagctccaggtaggaatataggtctagttttggcagatcttctgagttttcataaatgccaaactctggaatttattttatttatttttattttaattttttttgagatggagtcttgctctgtcacccaggctggagtgcagtggcatgatctcagctcactgcaacctccgccttctgggctcaagcaattctcctgcctcagcctcccaagtagctgggattgtagcaggactagctgcggacaaaacctctcagacaccgagttgtagaaggaagggctttattcagctgggagcatcaggaagctactgccttaaaatccgagctccccgaatgcttaattactgtcccttttaagggctcacaacactaaagatttcacatgaaagggtcgtgattgatttgagcaagcaaggggtacgtgacaggggctgcatgctctggtggtcagagaaaaacagaacagggcagggagtttcacaatgttcttctatacaatgtctggaatctatgaataacatcactttctaaattatgagttgatttttaactactgggtttaggccaggcagggccaggcctggtttcgggcctggcgctgggctgcctgtctttggtcttatttccttgttgttttttcttaaaacaggtactgagtataaaacaatataaaataatatgagaggtctttctcttccttcaggattacaggcttgtgtcaccgtgcccagctaatttttatatttttagtagagatggggttttacatgtttgccaggctggtctcgaactcctgatcttgggtgatccacctgccttggcctcccaaagtgctgggattataggcgtgagccaccacgcccagccccaactctggaattttattttattttattttttatttttttggagacagagtcacactctgtcatccaggctggagtgcagtggcacagtcttggcccactgcaacctccgcctcccaagtagctggtattacaggtgcccgccaccacgcccatctaattttttgtgtttttagtggtgacggggttttaccatgttggctgggctggtcttgaactcctgaccccgtgatccacctgcctcggcctcccaaagtgctgggattacaggcatgagccacagtgcccggccaactctggaatttttaaacggaaacttttttgtctttaaatgttgccagtgaatttgaaacccgtatgtaatcttccgtctacctgtttgtttttcctctgctccatgtaataaggtgtagtttgttcccatagattagacagactccagggcttgtattcaaccagtgtgcatctggctactaaagtgttaaaatacctgtggactggctggtaagtagccactgcctagtgctagtggtcctggggaatgttgtgtgttcagtgctggggcctgtgccagcccctggtctcctggcctgtctatggcagtttcctgtactagccctgtcttctgtacctttggaccaatgtgggcccaagtcacgatgagaatctggcattctcagcataggggcaatgagacacgctgaaaaccaaaacctggattctgataggctctgctccttctccccaggctgtggctgttggctgctcattggcatatcccagtgttgtctttgtgtggccagttcagggtactgtagctttccctttgattaatgaatataacattcattaaatattttggatttcactctgccatctttaatgcacgcttctcaaagatgctttatcaatatgttttgcccttagagtgatctttttccatagacatagagttttatcattcattcctttgtattgataaggctgcctttcttttgattatattaggttggtgcaaaagtgattgcagttttggaccatgatttttaaatcattataactaggctcaaatacatctttattaatcaaaataggaaccattgcaatcaacacatttttgccaacgagaagtaagtttgtttattcctgtagcataaaaatccatgcttcgggattcagtgaactcttggaaagcattttctgcattctgctggttgtggaagcgttttccctgcagaaagttgtttagatgcttgaagaagtggaggccagttggcgagaggtcaggtgaatatgttggatgagacaaaatttcatagcccagtttattcaacttttggtttttttttttgagacggagtctcgctctgttgcccaggctggagtgcagtggcacgatctcagctcactgcaagctccgcctcccgggttcatgccattctcctgcctcagcctcccgagtagctgggactataggcgcccgccaccacacccggctatttttttttttttgtatttttagtagagacggggtttcaccgtgttagccaggatggtctcgatctcctgacctcgagatccacccgcctcggcctcccaaagtgctgggattacaggtgtgagccactgcgcccggccagttcgttcaacttttgaagcattggttgtgtgacatgcagtcaggtgttattgtggataagaattgggccctttctgttggccaatgccggctgcaggtgttgcagtttttggtgtatctcatcgatttgctgagcatactcagatgtaatggttttgccagtattcagaaagctgtaatggatcagactggcagcacaccgccagacagtgaccatgatttttttttggtgcaagtttggctttgggaagtgctttggagcttcttcttggtctagccactgagctggtcattgctgattgtcatataaaaatccacttttctcgtcgcacatcacaatctgatcgagaagtggttcgttgttgcacagaataagagaagatggcactcaaaaatgacagttttttttttctaattttcgctcacctcatgaggcatccatttactgagctttttcccctttccaatttgtttcaaatgccaaaccacagtaaagtggtcgacgttgagttctttgacaacttctcatgtagttgtaagaggatcagctttgatgattgctttcagttggttgttgtcaacttctgatggccagccactatgctgaacttgaataagaaaattgctcaaatttgctttctgtctaacatcatttccataataaacagcaagtagtaagtcattagcatgacaacataaagcgagaaatgtgcattaaaatgatgtataacataaccacatttgtttaaaaatgtattccaatatcaaacagaaaatttcagcaatgcaaaaactgcgattacttttgcaccaaccattttccttttgctttcccattcttcaactttaggataaatggggagtggatacagcaggcaccttgggagtcattggattttcctagtttgtctagtttgtctcttatccgttgtattgccatgttctgctcattaccgtcttatgggcctgctccttggggcttagacagtctccttgcctttgcttctgcggctcttgctgcttagaaaacacttctggttctatcacctatgctggtggggttgcatcatctttgattttctacagctataggtaatgtcttttccttgaacatttaaggaaagtggctccatctgtgtgtctcttagagtatttaccactttgtatttcctgtcctgtattgacgtgaaaaaatgtcttttgtctctacttaaactccaaggctgcaatgtccattacagtctctgttagccacattgtgctgtttaaatttaaactcataaaaattaagtaaaaaatatagttcctcagtggcattagctgcatgtggctggtggggactgtatggaacagtactgaacatttctatcctcagaggaagttctgctgaactgggctgctcccatggcttgagggcattggttggtcctgccaaccccaccctacccctcagctccaagcttgaagcaggcctgtgaccctcctgaattgtagtaggttctattgcagaagaatcagtatagagtagtgggattgacctaaaaggaggaaactgaagcaaaattaacataagtaaagagtttattggggccaagtttgaggattgcaacctgggggcataaatgcaagttgccccgaatatacactctgtatagcagcagttacaagtggatttatttcattttattttatttttagagatgggatctcgctctgtcacaggctggattgcaacggtctgattataggtcactgcagcctgaaactcctgggctgaaatgatcctcctgcttcagcctctccagtagctgggactccaagcatgtgccgccgctcctggctaatttttaaaaatttatgtagagatagaatcttgctatattgcccaggccagtctcaaactcctggcctcaagtgatcctcctgtcttggcctcccaaaatgttggaattacagttgtgagctgtggagccaggccacagtggatttttaaaggcagaaaaaggagacagagtgggcagatgcaaagttgtttgtcaggaattctcattggtttacagaaataacattgattagtgatatggctatacatggttaagctatacggtatgggttatagtgtccagtgtggcattattagattaatttatagctacttttggcaacaggaagctgctttgagagacgaatacatagctgaagcagggagtagggcatgattgagttctcattttaatgcttctctgggcctcacagtttgtaagggctcacattcctcagatgaaagtgctttctttcccccgtggtgtgtgtgtagtgtaaattcttggagcttagctgcttggctctgtgtactggagcaagtactaagttttctgagcctacatttttataatgggtaaacagtcataatgtgtataaataactctttattctgagttcaaaatgagaaaccttctgaaaaatttttagcatagtggtggccatacagtaggtgttccgtgaacatgttctttcatgtgttgtgcacaggtgggcattgctcctgagaatgcaaggtggtaggcggccacctgggtctgtagccggaaggtgacatgcgttttcattgaggccagaggagagtggccttctactctgaaacatttgtcttttcggctgagcaatggcccaaatgacttgcagtttaatccacagacaggatcatttttaaaacatgggcatcaaggaatttatcttcccaagcctggtttttcttgatgatttctaatgaaactttgtatttgttggtcactgatattttcagttaacgaaaacacatcggtattggactttgttttttttatggcttctgtgaagcactgaaggctgtcatttttgacaaaactattgtaactcttaataagttgtctaagctttaaggctgggcaaataaatcttaaggaattttcatcttggtaaggtgcctgtccctctgatgagattagcttcatatttcagggtgttctgttctggaggaaaccaagaatttcttcagtataagtgaaaccttagcactggcttcacctcagcagatgcaggggaaatcagcctctttgtcctgtaattgctttcatcaaattgaagatcccatgggaggaagttttcctgcagggaaattcctgtttatgggaatggctgtgcatccatttgtcaagagctattgttattctgatgtgacaccttccattcctcccagtcctgtaaaaaatatgacatctattagaacctaattacttatgccattaacatgttgttccccactgaaatttcctggagtttgaaggaagacaagatgtgggtgtatgatagatatatttagatatttaaacattggaattacgtgggaaaaggtggtatatggtagcacagtgtaagaaattctatgtagaatttttatcttcctatttttaaggcattatatacagttaaagtcaaattattttaagttacagtgactaaaaaatatgttgacagtttctaataactttaaaaagtagtccaacacagaattttggatgaatggatgccaaaaaatgggctttcagttcattttcttttatggtgactaggctcctgggattttcttcgatctgattgtgcaaaatagttgatgcactggatttttcctatccattcacaagtatcctcccacccattcctccagtcattcagccagccatctggtaatcatttttatttatagtgccaggaaattgggtggataaaaagatgtatatttcagaagtgcagttttatctttttaaggaactcctatctgggcacagtggttcactcttgtaatcccagcgctttggcaggctgaggtgggaggatcacttgagctcaggaattcgagaccagcttggacaacatggaagagaccccagtctctacaaaaagtgaaaaataaataagtatataactcctttggtttgaaggagattctgtaattctgcatagcagatcagagttctggctctgaacacagactccagagcgtacttgaatcctaccagccagaagtatgagaaatagccaaagacagcttgtggtaagcctcaatttagaaaattgtcaatcatttctcttgaaagtaaaaatttaatttaaaaattggaaattaaattggattgatttgcatagattatttacccattagttaggtgctacatgtgctttatctgatttaattttcataacaatgctgtgaaagaagcaatcatattcctgtctgacggatgagaaagaggggccaaacatgcatggctgccacctaaccattaaaggagtctggtcttgggctgaatccattaaagtcccatgcttaagctttaagttgttctcaatagaaaggaaaaagtccagtcatccagttctaccacttgctactgcctgtatggccgctgattgtcacttagcttttctttgcctaatttttatcagctaccacaatgggaattaatgcctttcttatcaaatttaatacactgttgtgaggatgtcgtggaataatgtgtgtgaaaatgcttgctacagtgtatcatgttacatacatgaaagttaatattcttatacttattccactgcatttttaaatggagtctttcacaacagtctgagaaattcttctattctagctaatgtcagtgagttgtcaatttgttcctaagtgtttattgggcaattattgtgaaatactgaagtggtggaagtagagacaattacatgacaaattttgaataatatgatattaaaataaaaagagaaagagctgctaaaacctggtattttaataaattagacatatggaactcctgctttatttaagaagtagacatagggctttattagtgcaggattaagcatgtagttggctaatgtcagtgaatttttcttgaatattcgggacataaaacagaaaaggagtttatacgtagtgtaattatttcttacatatgttttggtcagtaagccggtttatagagaaacctatgcttgttccttaaactgtagattaagaatataggagttattaaaattaataatacttttgtttacataaaagtaggactgcattatttagtagctgttattcagagcttagtgtgctcttttctaagaggcttcatgagtatcccgaaataactgcaaaattcatcaaatggaaatgattaccatgaaatcaggcttctgacttagatttttccacaattagtgggaaagcatcacacgtggatttatgttatttggacagactggggaaagcctaaaccagactatacattttcaagaattactcagtagagcttcttagagaggtctagtgaaaactaagtaaaatcaggtttgaaaaaattagaccacatatctctacagatttgaggctcaaaaaggccacggtgtgaagaaaactggattctgttacaaaagaatgattagtgtgtttgttttcctgcaagtcataaaggcaagctagtttctcagaatgaatattgagtgctgaggtttttgtcctagggccttgaaaggtggtggaatctaggaaactgaaatggcaggtggaaaaaaaggttcaattattctgtaaagaggcatgtcttcatgaagaatagagtgggagtaaggtagagtaattatcaactatatttgagaaggtcttatataaaagtaaaatactgcaacctacccagcactctcagtgcattttatgaggttctgtttttcctctcatagaatttaagatctatatgattggcttattatgtttattgtttaggttgtctcacttattaaaatatattcctagtgcctagactagtacctggcacatggtaggtaataaatacatatgtattgagtgaataaatgaaccagaggctaggttctttgtggcccttggtctatttgtctgaaaaatgagaactgtattggacacccccaatatttttcccagagccactatgaggataattgtgttcatcgacttttatcttatttttgactgagctggggctgtattgtttgcagttcaaatatattttctcataagaaaaaaacaaaagctaagtgtatttaaattcttaactctagttgagagaccatccaggggatcagagtctgaagtcagaatactagccctgaaccccagcatgccattttctgagtctttctatcacttatgttatagaaaggatgaaatcaaaggaataataatagtggtcaagaaaatcacctctaacttttattgaactgggttcaaatccttagccttttgttagctgatgaccttgggtaagttacccaaattctctaaacattccatcttctctgctgtataattttaataagtggtacttcttagagttgttgcaagggttaaataagataatggaaataagagtgtatcagttcatcagtcaatggcaatacgtctaaccctttaagccaacccttttgctaagaacaatcagaaaacaggaccatatatctggccagctatttgaagtcatgagaggacttctaaagaggagttccatgatccagaaggtccagtgcagtgattcctgcatttggggccacttttttcctcaagactgagtgtctcagcctctcagcctgaactttggtgtaacttgacagtagacatcaaagagcagagctctcagaagactcacaggctctgggagaggcaactaaattgaagtttagggcctgccaaggaagaggtaaatacctcaggcttttggatcccaaaggccacatcttaggtgttagggtgaataggaagtagaccagcttgactcatcacaattactgattagatcaatgtgggatggattgccagtgcccctagcatatgtacttggcagaagacaatcaccattagccaggcatagaagagatggtaaatcagtgaccagaaaccaagagaaaatacagataatagaaacagatataagggcatctagaaaaaggaattgagagacatttgctttaaagtaaccatgattaatatggtaaaggaattgaagacaaggctgagaattttgatatcagttactggaaattataagattgtaaaatagctaaaattttaaaatgatttaaaccgaggattaggcacatatgaaaagtagtgaaaatacagaataaaatatccaaactgagtcaaagagagacaaagatggaaaatacagaaacaaacctatgagacaaatggacatggtgaatataacctaatatggaaatggagtcccagaaaaagaggagagaatagggggataaaggcaatgtctgaagagatgatccttgaaaatttccaaaattgataaaagacattaagcagaaatttgggaaaattacaaatgtttacaagacaaacacaaagaacactatatttaggcacatcatcatcaaatagctgaaaaccaaagacaaagagaaaatgctagaacagccagaaaaaaaagacatgtaatcttcaaagaagcaacaataagattttcagttgatttctcaacagaaacaatggaatccagaagacaatgacatgatctttttgaagtcctgggagaattctgccaatgtagaattctatatctaatgacgatatccttcaaaaacatgaatataattcagatattttcagatatgtaaatttttgtcaacctagtaaattcttttttttttctttttttcttgagaagaagtctcgctctgtcgcccaagccggagtgtagtggtgcgatcttggctcactgcaacctctgcctcccaggttcaagcaattctcctgcctcagcctcccaagtagctgggactacaagcgtgcaacaccatgcctggctaatttttgtatttttagtagagatagggtttcactatgttggccaggctggtcttgaactcctagtctcatgtgatcttcctgccttgacctcctaaagtgctgggattacaggtgtgagccactgcacctggccccatcatagtcttgacagtaggacagtaagacgcttcctttccacatttctttttaccagccacgtggtggctggatggcgattggttctgtggccagcttgctctctgaagggtggatggaggaaggtgacccagcttcaagtgtacgtgtaccttccagggagagggcagaggtaaagcaggtctctgctactccagggtttctcccggtgtgaactcccagggctgtttctcactctcagtgaaagctttttcctccttttcccagggtgtttcccttctgctttctgttgtttgtggccatgatttttggtcatctttggaatctcagtctcaaagcttttctctggcttttttgatcctagaacaagcataggatctttttaagtttcacttttgttttttaaatgtaacagtatgggacatgtaaggagtcagaacaccactcccagacatacgcattactgcaaagcatggcagtgtccaggatactgaagtaggaatcaggtgcactctagagatgcaccacatggcttgtttgtctgtccacactggaacagagagatgaagaggcagaaaaggagagggagcctccatgagctcctgtttcatatgccagccatcctaggtggtggtgtattagtgtgctagggtggccggaagactgggcgggttccacagcagaaattgattgtctcacagttcgggagactagaagtccaagatcaaggtattggcagacttggttcctttggagggctgtgagggagaatctgtttcatgcctctgtcctggctcctggtggttttctggctctcttttctgttccttggctttgtaggtgcatcactcctgcctctgcctttttactcatatggcattcttgttctccctgtgtgtgaatctttgtgtctaaactccaccttgtattagaatacaagttactttggattaagggtccaccctacttgattatgtcctcatctcaacgaattatgtctgcaatgaccctatttttaaataagacctgattctgaggtcccgaggggttaggagtacaacataagaatctggggggatgaaatgaggacagaatttgacccataacatttggcatttcaaggggaccatttttatataaggaatgtatgaaaagtttaaaagcctgtatttgaggattatctctgtggaggtgacacctttgagatttcaggaaaatgtttgagaggctgcactaccctcttccccaacatactgccttcttctacaggaagggattgtatgattttatttgggtacgtggccccccaccacaaggactatatttcctagtccctcttgcagtaggtgtggccaggtgtgggctgtagaccagaactgtccaggagaactttctgtgatgatggaattgtctggtacagtagccactagtcatacaaggctactgaacacttgaaatgtggctagagtctttaaggaaagaatgtttaattttagttagctttagtcactttgagtttaaagagttacatgtggctagtagccctgtgttgaacggtacagctgtagacagtggggtaaatgtggaagtgcttgcacagcacctgccaagctccttgtgaggagggagtgcccccttcttcctccccttcctctgtccttctgcgtgggatgtggatgtgctggctggagccccctcctgacagtgacgatgaggactgtaccacaggtactgtggaactgtgggtggaagggttggggttctttaaggacactgtggagcagagctgccaaatcagctccgggctacttacacacatgaaatatattttggtgagaaatattctgataccttatttaacccactgacatttgagttttcctgccctctttgtctaattggatcatagttaatataggaggcaaaagccaagtataaatcccagcatcattagtgatgatgatagaaatcttttatctccccccaaatcctccttgccacttttaaacaatctgaaaaacaggaagcagagttgttgacttaggaacccacagccttccattcccattattggaggaagcccttaaggaactcccccaccccagtgggattaaccaccaatgttgactacatgtcctgaaaacttttcttctgtaaaaagtttagaccaatttgtccatgttaaactctagtataatttcagaattcctccattgatatttcttgattacaatttaaatggtctgtttctcatgatgagacaactgcatttgaggagcagtttcacttacctgtgacatgttcttaagtcttcgagctgctctcatgcttgcctttggagttacttgcccagaaaaacaccctgaatagtctcatgaagaaccaaggggcactgcaggaacaggcctgggaggtagcccactcagtcactgctgaaagggaatggaggaggggacagagttgttcttctcacccaactgcatttcggcacccttttagctggcagaattaccacccactatttttgctggcagcactactgcaagttgtgagttaaaaaaaaaaacaacaaaaaaaactcacatttttttttggtcaagctgttttgacaggggttttgtctttaaatagtaatcactcattaattgcctttctccctgcaatccagaaccttcctggtttccttgtatactttggaataggcagagatgtgagccactaacgtttttattttaagtgagattatgggtgtgtttttaaaagtattccttggggccctgtgggaagtgcatgtcctgacctctgtaggactggggccctctggaagggtaattagagtctggccccatttgctcctgtctgagccgatcagtgtgaggaggtggtgtatggtttgtgcttatcaggtcacaggcataaagatgaggcttgctgctagactcactccagtgatggatggatctactgccttgtggtttataaagtgtagatatatattctcaattccatgttagggatcttgaaaaaccaaaaatctttgcagaaatctctggagttaagcaattgtgtttttaagtggagttatctgcctcccaaggccagacctgtcttcgctttgacaagcatttaaaaaattcagttaagcaagtgggataaaagcctgtgtttgcaaatggcttaagaggcctgctgtctaccattataatgacacataacgttggttaacttggttttttgactccctaagcaaaggtcttattcatttttggttttaagatctggtattctacttgataagggtttccataaaaatccacaaatacataatatctaggttttgctaggaaaataggaattacaggatagtgttgtgactaaaggatatttttctctgttatcgctttaataactataaaaggaaataccatggtttaagtttagttttgataagctaaatttaagtttatatcctcttttcgcttttacattctgttgtttcatttgttttaaaaaaaagaacactcaagtgatttctaagcctcttagtaaaacaagctcgttaaagactgttttataacatctttcacattcctctgaagtactttgtagaattaaccctttaccctaactttggaaaccacctgtgtgctcactggctatgcctggtctagttttctttttgttctggtgaatattgtgcagctgcggatagaataacattcctcgtatcagtctttactcagctgttcagaatgactttttactggctattagagccaatagaagttttctgttttatatttaagaccctccaacgctccaaaatctgacattcttacctctctcatgccatgcccctaccttatcctccccacctgttggtcactttcagcacaggttcttttccccacaaatctggaaaaaatacgtgctatctcatgaccacaggttacttcatttggcttctttgctttcgtatgagtacacacccacctagaattgcctccttcacagcctctgtctccaacaaaactgaactcccaatgcggctatgcatttcaacatccagagttgagcatcaaaggccaaaaatgatcaaatggaagcaagtcccccttggggtaggaacaaggatgctgcctgtggcagaacagagctctctatgcaccaaatggctccaggtgaaccccccccctccattccacatagcccccctccccgcagaaggacagacactgtgcttttcacttaccccagtgagatgcacacatatttgctttctgtatgtgccatggtaatgaggaaggctgggaagcactgactgggaagcatcagcctcgaagataagcccttgcctaatgttcaaggtcaatgtcactttgttcccagcttacctttctgccctgatctgctgaccccaggaatgcctgtgcttcttggctcagactacttctgccacaactttgaggtgaaactgacatttctgcctgtctgccggatgtgtctccagtcgctttccactggaccctcccctgactcactgtgctgttgtaaatagcctaaaatgttagaatctcattcaacgtttttgtatccctccacccacatatttaacttgcttggatcttcaattcccattgatactcctcttaatacattgccactgccataatctgcctttattgaccatgccattccaggtaagtgatttcatgtcctggggtcttgagtctctcatctgaaaacaaagggagtcaggagtcatgttctttacgtattatttggaattagacctgtgtctggaaagtcaagtttttcatgtccaagttgtgtgatttggggtagaaaacatattccctccaaaccccagtttcttcatgtgtacagtatatacagttctttactgatggtgttgctacatcctgatagagaattaaatgagacccatcttttcggtgtgacctgcacactaccaggcacctaatatacatctggtatacactaactactgcaaaagccttcaacctagtcagttcactctctagggcatgattcttcctctgtgaaaattttccacataccttcctctctagctaatagaaaatgctttctcaatttttgtcgtttcttttacagttagtaaataatgacaagtgtgttgagtgctaccaatgtgaagtgcaagtttgacgggacatagggagaccttatttggttagggtgggctgggctgccaccccaaccaaattaggttgcccatgcagagttgttggctgaatgacttttctgctgtctggcatttaccaagcgtaatgacacctttttgatttttctttttcctcctgtttcccctccaactcacacatacagaattaattaaatgttttttggtttcaactctttatctcatcttgtatggattagccaaatttcctgcctaagttattaaaccaagttgaattctgctatatgtgtgtttgtgtcttcgggatctgatcatctttgaggtatgattctgaatgtcatttgagcttattctttatgacattctagaaaagtatgtatgctaggcctcgaatatattctttttttaaaaaaatttctataatttcaaaaggtaggaaacatgacagtaatggttagttttagattttatttatttttattttttaagacggagtctcttgctcttgtcgcccaggctggagtgcgatggcgtgatctcggctcactgcaacctctgctttccgggttcaagtgattctccttcctcagcctcccgagtagctgggattacaggtgcatgccaccatgcctggctaatttttttaatttttttattttttgtattttttgttagagatggggtttcaccatgttgtccaggctggtcttgaactcctgacctcaggtgatccgcctacctcggcctcctaagtgctgggattacaggcatgagtcaccgtgcctggccaattttagattttattaatgttagacatagactcgtgtgtcatagaaaacaatactcagagaaaactacgtacctagatgttttttggccttttagttaggcacttggcaatgaatgtgttttctaagtttattagttactttgatagatattcctggtctaaaatctatttctttttattttttgtaagtattctttctgtctaacccctctttaaaataaaaagttatttaggagtttaatgatttggggggaggggcagattctggtaatgtgatgaacgagatggggaggagcagtcttgcaaacctttggtttagtagagaaccaaaaccagtttggaaggggatacaggtctctttctagccatatgtatttgactgaacatgtttgtttggaaaaactagtagttttgtaaatcatccattgagagccagcaagttatctctacatttgtgaaagaaaaaaattgaggtggatatgggtttcctttttctatgtgtgtccgtattgttttgattgtatagaggtagatatttttcttcattttgactgaaagtaaagtcagaattatatgtatatctatacatatatatgtatagatatatttattttctacattttaagaggaagcagcgtgttttaagagtgaaagaaaataagctttgaaagcagacacatcttgatttgagtgctagttactatcattagcttgcttatataatcttgagaaatcttttctttctcgaagccttagtttgcccatcagctaaatgagcacagtacatcctatatggtagggttgttgagtatgagtgttaagtgaggtaagttaagtcaacacaacgtagtaagagatcagtaagtatcaaattccattctcactcactatatgtaatataaataggtttaaatcaacagagtgagtttatctgtaactgcagactttctttgccataacacctttaaaaagttttaaatgcttaaatttactgttctttcaactgccagtttagtgttagttcatatcattttgttttggccgtatttgctaatgttattggtggagtcataccattttctgttggcttcatttataattctattttttttttggctgtctacacattatttcattttgggacctgctacactgttggatttttggctttactcaccttttccccccttctccacttttgacccatctcctcctatttcattttggcaccagtaaagtaatggttcatgtgtatgctggaagcctaccccatacatctctatgggtgcagtattcctttttattgtgttttatttttcaaaatgacaagcttatatttccagtatgtgaaaatgctttagaacttcttgttgaatatagattagttgacattttaagtcttagcccatgttgtatggttgtgttttggttttctatttcttctttactcttttcatcatataccttgtagtttttgtcatcagtgaatgatttttgagaatcctaatgtgcacagcattctgctggatcttgtactaagcagtttaaagagaccctgtgcaattacccgacatttcctgtgtgcttcttataggcagaatttcatagaatacaaattatcctcttctaggtacttgaatctaaaacaaatatggacacacagagcaagaaaatagctgaacagtgagtatgtgaagagtaaaccaacagacaccaggattattcaccataggccagccttctagctcccaagatgttccctccctgccagtcttcattgtctctcagtattgagatgtcagcctcctttccatattacctggaataattgccaagcagtcatgccacttgaaaatgaggtaacaagtcctttgattgaactggcagtcccactccctgtcatagcatccttgtatcagtgttgtttattcatttcatggtctgttctctcaagaaataagcatcaggagtggacagtgatgtttggggggatcccaaggcacatgggaggcagatcttacctctttctgaggaggccacagagagctggatagtccctctgtctgctccctggtagctggaatgtggatctgtgactccatgcagccaactggaagcttaatgcagggaatgtgaactttgaactagttagagattattcactgtgaggcttttgcaaagggcacaggctggatgagtggccgtgagcgtccgtgttcctgagcagactgtgctgtggcccaatcctgtgcgtgtctcctcttcaggctcctgccggagcatgcttctctaatcttaccatttatcactgacccttcggtgaaactctcttctgtttaaatttaccagggtacactttgtaatacttgggaccaagaatttgaagatagtaatcagacaaatcaaacaactagtagtagtggagagacacgtagccctacaggaaggggtagaattatcattaaaaacacagacaaaccagagactgcctgaaaaaaaaaaaaagatgaactggaaagattcaaagtaggctctattggaggtgagtatggaaaacaagcttagctttttattttgaagtttccttccaggagttggatactgtgatctcttcaatcagcatgtttatatagtgaggaggaagaccagaaatgagaagaggaataagaaaatggcagcacagccttttggggtatggataagggtggtcttcctgctacagcagaggagaggggcatgtgtggcccatgtggaagagcaactgagttggtggctgactgaatttgggtccgaagcaaaaataggatatgaggataggtataagaattttattttgtgctatgtgtgtcatttggcttttaaactgtctagaaataaaatgagatgaaaacaatctgccctcatttcttggttgcttttcttaaatatcattggcccaaagcatagccaagccttttatttagaaaatcctaccttcaaaaagtgataggttacactaattatatttgtgctgttctacagattttctattttgcactggtcctttacctgctgctcgctgtgcgggcagctaaggtgagagtttgaagactatggacttttaagctgagaggctgctgtggtcatacagttttcaacacaaaacttgttctccctctagtgttccacttgcacaggggtaagttgcacaactttgttccattttgaattctttgcaagatttgtcttcatttcctctgttgtatcagattcctatatttccttgtactgtttggccaaactccattgttttcatcttactgagtggaacagtagatactgttccagctttgatattaatttcctctctagtacagcaattccgagtctggagtacattagcatttcaattttgaagagagattttgatctctgagcacccttgccttgtgtctgttttcttgatggttccttgtggttgctttcagtgttaggttaggtttctccagttaggtttctgatgcagattgaaaagcaaacaagcagttaattctgtgcatccctcattcttctgtaaacatgcctagtgcagtgtattgcctctccaagtgctcttgcttaattaacatgctttagtttgtaaaggattgatttgtttggcagaattatccatagttgattctgggagcaaattttctcggatatcaatttgaggaaataaatctcacttctccatgccttttgttaattaatttgtttctgttaccatcaaatctttacttaataagtctgtaaaggatctccagtggtgttgagatgtcagtgctgtttggctataaaattcaaggatgacatctaatgtgtgccttttagtagagatgcaatttacttatgtagtagatttgtgaggagcatccatggaatagtcatcccactatgattgtatataacaattgtatgtacaatatacaatatatatatacaataaggaaaatgtgcctcttaggggttgggaaaccagtggtcaaattccacctctggcatcatctgctctgggactgcaggcaagccacatcattcggatggcttcccttgtgttgtaaaggggggacaacgtttttgccctccttttttgccaggctgctgtgcatggccctgtggaatcatcaatgtggcagtgtaatagtctccttcctgcccagtgtggaccccagcttggcctgtgctgctcccatccacctttgtagcctgatcttcagccatgttttaaatattctttgcgctgcagcaaacttttattccacacacacaccatggccttctcataacgggccacctgtcctctgttaaggctcttttggaatgctctgtatgtgcctctcagaacttctcccagcttcccagctacaccttaaatgccttctcccctgtgaattcttccttgttcttcctaatctgaagtaggccttttagtaatctctgataccatgtcatcttctggtcacaatgttgaattatagtaggtcacacatgtgttctgtattcctgactaaattaaactcaagggtcaggattctgtgttgggcatctcttactgtgctaagagtgccctcggatgaatcaggagtttttggatgttgactggattgcttttgatgaatcagccttagtttttcatatttgcacaatacttttgagtgttctctaaggtcagcttcacctatggagaatgacataattctgtgttccactgtagaaatgtaagttgggtatccttcagtcttgctaccatagtcaaggagtgacccctgggcagccagcagcaggtgggcgtttctgcagtaagcctctggggctcatctgttcttgggaagccaagtaaaaacacacacaccatgtggggtgataaggggcacaatctcgtacgtaggagaattgggatgaagtgaaaaatgaataacccaggaatagagaagggtgctagtacattctgtggcagtgggtcttaatggatgagtgagcaggagcttattgggatggtaggtgagaagtgtctccaggtaatgtccagaagggggtctgagcttaatgtgcatggttgcaggcgagtgggtatggggtatcccaagcccagggtgaagagtgggtggggatgcaggggatgctggtggtgatgccctttagtcatggggagataaaagagcttgggcttctcagggaaaattaagtgcatgccatagcaaaatggccataacagaggtgcttacctgcccatcaaccagtggcataatcacgggggacacatcctaaaattcagagccccaacctcactcccaacaattctgattccgtaaatctagaacgggactcaatattcatgtgttagtaatttatcccagtgattctgatgcaggtggccagtgaagcacactttgagtaagtgttgaattacctctaagaaaggaattataaaatttgcacagatacgcatttgtcctagggaggaggatcctgggtagctctgttcagatactcaaagggatccataagctcttcaaagtttcagaaccactgagctaagacaaaagcttgtaatccagaatgagaatagcagcaccattgcaggaatattggagatcagtaacctttaaagaaacattttgtgtgatagaaattgttggtgttttcaggagccctactggaaacacattagggaagtgaaggcttaccacccaatttgtaaatcaggatttaggtttgtgttaatatctcagtgtttaaaggacatacagtgtttagtggctctagcaattaacaatttgtctgtaataggatttttttggaaacacttcaagtccacatctttctctgacctaattaaaccttctggtttcccctgggttttactttttaattctgaagttagaaatatattaaagttcagtagaatgaaggtctttattactaattatcagtaaagatatcacattttgctctcctgtggttaaggtcttatctgtatttctgtgataaacatctctctgaagtttatagagcatatggagaaaaatgagattgatacaacttggtttttactcactcccaaccccagaatttttgaatcagtgaagtgtactgctgaaaagtgatgtacacgccctcatttctcccctgaacccagggtaaaatgaacatactgtttatactggcaaattcagtacagcaaatgggatgaagtaactgtcggagggagtctgtgatcagggatgtgtttcctggtgatggctgagacagagctatcagctggtaactgtagcttgtccttcagcaaggggttgcagctactaagcacacatttgatcattggtttaaaccttacagaaattgagctggtctgtgaagcctcctctaggcaaatttctagctccatgaagggttactatttcttaagtccagtcaatattccatcgatgcacaagtgtttattctctattcacaacacacacagtactaggtattgttaaaggtaagtgtccaatatggccaagggccaacaataagggtatttaaagaatatctcaaagagagatccaagccacagataatcaaatataaaattacccactcagactattaaaaccaaatatatggtgacactttgtttaacttatcccagcaaccacaagttcttacaagtcagccatatgaaaaataaaaaagcttcctgagaaacagaactccctactctcttggtatattaaacatatcccaatgaatagtttctggacgcagataaggctcatcccaggcatattatgaagtcattgaatttgatactgtcttctttttttaaacttattttccacccacttttcatatgtctaatattcttatgtaatctgcatcaaaataagaaatatctaatatctagttatccttacttgtggattgtttatgtggccctgtgcacaataggtctaaataaatatttttttggagtagctgtggttagaggactggctatgtgaagccattttcatattatgttcttttgagttttaaatttcaagcctctttgttacagatggaaaaatgtagacttactcaaataattgtagacgttagtaagcagaggctgagaagaggtttgggttaaggagagttgtacggaaactataatattaggtgttcttcagtgatcttttcagcaaatatgatgtcattttggattgactgggataggaacagtcacctaaaatgggtcccagcccatgtaggattgacaatcctagatgccttgtcctgtaacctcaagtttcttactttttcacaatagatagggagtctggccagctctagcactgatcttcatatcagtagggtttcttctgccttctcttctgctgccgcttctctttttgctttagcattgagcttagccatccttcttgcttgtatatttaacattattttatttagtttttctattatagccactttccccaacagtccacctgatctaaccttaattatgttgctgataaagaattattgtctttaagggaagcaaagaaaaaaataatagcatgtgcaatcttagagtgggaatattaccttagagataatctaggcctggaagagtctagtattgttaaatattaattttttttgtggcctagtctttctgttgcccacagtacaccaacttttaagtaaatgaaagttgaatatatctggttgaagcagggttttagaagggcctgcgctgggttcgccctcgtgggctgagagagcctgaggattctgaggatcacagggtgaaaaactcagtgatccaagtcatcatgcttttttttatagacaggactgagacccagaaaggaaaggaaacccacagttaactatttactaggtagctagataggtaagtgcgtcccaggtagctagataggtaagtaggtcgatagatacatagcataatgtatgtgtttatagaaacacacacatatatgcagaatcacttaattcttataacattctagaaggtagatggttttatagatgaatagatgaggaaagcttgtaagttgatagggttggactcacctatgctccttctggtggcaaatctacattctttccaccctagctccattctgctgcttggttgccttgtccaaagccacacacaggcaaggacaggactgaaacccagaccatctgcctcttggtccagggttgttctctcagcagatctgttctcttcagtcagtggtaaaataatacatgctaaaaagtaaatggaatattgagtaaacactcagttagaaaaagagagaaagacgtcccagctgtgttgaccttgagaagggttaatgtttttagttccctatattttagcaactaattggtcatggaaaaggatgggaaggaaagctgattcatcacagttttttgtgctaagtattgctcagagcttggagaattgcatggaatctagcttccttatttaaaaaattaataaggaaaaatttttcattaaagcatgctttctttatggcctgagtattgaaacttgagattgaatatgtattaactacttgtatgtttcataaatttgaaatacacataatatgtaattattgacattcttctcatgtttgaaacaaaagcggcagacacactgactgaggagctgaaccagagttccagtatgatgcacataaagtccgtgtgctttttgttgacttatgctgaggtctgccagataacagccttattacgcacattcttagaataacaggccattgatatcttagtagattcttacatttaggtactgactctctggttttcttttttttatctggctcatgtaggaaaaggagaccttcaggatgagtttttgttcttcctgttggctcttacagcatttttcatatttatccttttaactcctctgtgttccacaagttgtcttccttgaggacaaggacttctttttcatcctgtccgttctcttatcccttccccttttcctccctagtgcctgacatcatgcctggcacacaagtccttaggaggagtgatggtgacagggaaggagggagatgccatgagtcagataaaaaaggcaaaactctagaatcaggagtttcttcttcctttgatgtagccagagtgttcagtgaatggagtccattagatgttttttcttcagcgctcctttctaataaagatagagcagtaaacagtttttattcttacctttgttacaaaaaactttacaacattctgttaaatctagcaagtatttaatgagtggcaaacacctttccaggactggggagacagagatgaacagaacattgtccttgttcaaggaccgcccagtgcaatagagaagacaagcatgtccaaagttacattgccctgcagtatgataaggacatcaagaaaacctgtatatttggcagtgatggttaccacatgggaaggagtgattgattttatctgtgaaaagccctcagcaacaggtacctgggagaggtgttgtccgagctgggatttgaaaagtgtgcaagagttttccaagcagatgctgggggaggggtgggacaagtgctgaacaggtgcagggaccgcatgagcataggggtagcatatgggcaggaggatcattgggggtgaatctacagatagtcgggaattactagagtgtaaaactaaagggaagtggtggcaaggaatgaagataaagaggtagacgggggttgaatcagaaaaacaacagatgtcacatgattaaaatttgagtactatccgatggacaataaagggctgatgaatagttttaagtagggagagagcattttcagctgtgtattttataaaaattcagcttgttgggagtgtgtgggatatactggagagagcagaatccaggtttgagggaatgggtcaaatcaaacgggaacatgagctgaaactcaaattgtggcatggtaggaataggagactgaaagaaaaatttaagcagttgtttaggagataaggtgtcaggcagagagaggcagtcactcagccaatataggcaagataaagaaagaaatgtctgtgactttgttatcctgtttcagatagcatgtgccaaacatagttgtgactttctttgatgttcatcaccttgtaacagtgactacactttcacatacacctctaagttcaatcttccctatttccctgggagttaggtgatagatattacaaaggactcatacattctatagggcccacattctcagggacttgctcatgttcaaaattgcaccccaaaatccttaaggaaccttttgggtgggagaccagcataatgtttctcagtaagtccaataaagtcatcccctgcacccccttgtcattggattgctgtttatgcatttgagcataggattagattggtgatttggattttggacacactttaattaaaatgctgatctttaagcatgaaaattatttggaccccagtgaaatgtcacactaagcaaagcctggagatggaaggagcagaggctaactaggtggaggtggaggagcaccagttcatatttctaatttcttagtttcagcttgtttggagcgtaagattgttaggcttctggactaaatgtatgatttctctgtcatatgccccttccttttcaatgttgaaatcatgtaagttgagcatacctttgatatgaagactgcatatctccttttgatgcaaagagcaagacacatgtaactgatccaggactctctgtatctcagttctatgatcccaattaaatacactcatctgtacgagttccccatggttgtattagaagaagttctcctcatgataggaaattggaatgaatattttaccgacaggatatgtgaaactatatttactttttccttataatttgattctacccaatgaatataatgtgtagaaaaaatgttcattgagggaagtacatttagttgagtttaggttaatcaatgtctggtgaaaataaatagttggctgtctgttttaagctgaataaatagcatggtttggctgtactgcatattggtgagttcaggagtttatcagctgtcccagataatgattttatgctaataaaatcaagaggtggatttgtaaatcacactaaactggcagcagtgctactgggcataaaatgcaattcttttttttttttttaattaatttcctgggtatctctaaccagtaaccaggattgttttctacctaagatatctcttcttgttttgagtaactctacttaggagaaaaattatagatcagggttttcttagcatgaaatttaagcaaaaaattcaacactttgatccagccgtgctattctgttgtcctttatcatctgagaggtgtttatgactgaaaagcattatttagagcaataatctctgaatcactttcttcacaacctttttgaggaatacagtacaactcattgatgtatggaagaaaagatttgaacttcagcttacatgtattttctaataatacttaaaaaggtcagtatatgcatgcttgtaataatctgcatatgtagagcactacatgattataatttatacataaacacacataggatggttatacctttttaagaaaggatgtcttctgaaaaatgtttgagactactgatctctggagcactctttctgggtcaatgattagattattctgggacctttttttaaaaccacagattcatggggctgttcccagaatattctagttaaataggttgatccagaacagtgattaccaaacattagagtgcattggagccacctggagagttgttgaaactctggctgccgggcccaacccccagaggttctgactcagtaggtctgggatgaagcctgagaatttgcatttctgagttcctaggtgatggtggcttgtccagggacccacttggaaaatcactgctctagtttgggactcaggacaacagtgatttcagagatcaggtcataaatactgatttagtttgacgatcttctccctgagacatttctggcagctgtttcatcattttgttttcatttgttactcctgcttctacgatagaggcagacaactattttttacactctctctcgttttcactattgtggtatagaggataagagcaccagtattatattcagatagattcacatttatgcagggaattcatgcaagtggtttaattcaatccaatagtagctctatgaggtgtttatttgtatgtggaaaaattgagatagtcaagttcctaataatttggttgcatctgtacaatatttaggaatagaataatactactgcacattaaagaaaattttactatcaataagaaaaatacatctttgtttgtcgcaactcagccttttaaaaaattaggaatccatagattgatatgaaatgaagatggggtaactgtaataaatcatagaaacttcaagaacaaggcaacttatttcctttgtatcatataaaatatatccatcggcaaatagcacttcttataatagagcatagcattagccatttaaatgcctgtgtaatgtgtaaaaactgcttgctaaattaaattatgtagaagagcctttctataatgcttagtgtctgattcactaaacatcactggggcactcaaagtttaggaggcattatatgcttttattgtttgtcaggcaattaaatgtagaagtcactgtgatttaaaagaagaaagcagggcctctgctatgttggtatagtttttttttaatactcctaaaataattatgtctattaaatctcactttctgtttatcctttgcattgtgtagtttatagccatttattctacacagttttaaatttgagataaataggatcctctgagatttcatgtaatttaggaaaatagaacatataacattaattcttttggggggtactgtagcactattttttgatctgccttctctattgagagacccatttaatactttatgcatttgatgaaggctgacttaaatggggtcattctgtatttggaacaatgagaaaaattttccagaaaactcatcaaggagtattacagtctttttacaaaataactttaaatggactataattataacaggaagaatgtttgctagtgtatgtaagtcaatttaacctgttaaaggcagaacaattcaaaatatgtgtgtatcttacaagtttatgaaattaacatttgattgtcctccactggcttcttagaaacagcactttcgagagcttatttacaatgcaaatcactgaacagttcgtatataagcactgtaaattgttgtttacttactttctagagcttggtgaaaatgtgtgagtacagaccttgtttgaattgctagtcctgcactgaagctcctgtgtctttgggtgagattatttgacccttctaaactgccatttgtaaaaataagaatgtaccgatcaggatccaatcaggagagagaagcaacatagtaatttaattagggaacatttataactgtaacgggtattagaatacaagagatgggttagtacaagctaaggagagcattgaagaataaaggaatagtggatgtatggagctgacgttagcccaggggcagagacagagctccagggaggagactctttcattgctgagatccaggggaaggctgtggctcagtggatggcagaggagttactatggggctgcacctgcaggactcagaggtaatgtgccctctgattggccgtgaaagttattcatagggaatgttctgctggaggcacttgctacagaaccactggggcactgtgcaggggcaagctgctgctactggaggagccaggcaggggggcgaccctgcgttgtgccctgagggacctgccagggagctcagggaggccactccttcctcctgcaggatctctcctgtaccctctactgataaagcttataccttcttgcccactagtacagaaaacgtagttaaagcatctggatacatttttgaaatgaaaaagatttagagctaagaggtgtaataccttgataactagtacagggaatattgatgcttgcctttagaatttttttttaaattaaaattaggtaatacatgtttatatttgcatggcttttgttctgtaacatgttaattgaatcagacatgttgagtgagataaaagtcttactggttgtgaggagtcaatgacatcatgactatattttgccttaggcagaatctgactggcacatggtctgtgttcgcaaaatggtagctgttgataccagagaactttgtagcttacaggttccccttagactgtgtggcagtgctctcacacagtagtgttggttgataacttcaagctaaataaacagtcttaggtgatggctctcaccccaaaaccttaagaatacaagtagcaatcttgaaggatcttgaaatcaatttagtggatctagaacctccttttagaacagaatgataaatatttgtatatctcagtagagataaatttggtttttaaagtgtacagatgatttacgtgtactgggtcaagatgtcatgactatgagtcacaataaaaaaaacaatttttaatatactgctttaaatggtagactctatttcttgtcaatttgttttccgttgttttgtctccaggcctgaagcttcagtaggatgtagaatggtcacataaggtttcctttggggtgaaaatgggccattttctttatagcttatgacttaatgatttcatactactcttggatcaactgaatcatcctcagctgttccaaagaaataaaaaagataaatatcctccattatgcaagtgacaatattttattttcataaatcaagaatgacctttatcaacaactagccttgctgtctaataattgccaggaaaaaaaaagaaagagaattcaacttttgtaagtcaaaagccataatttgtggagacttcattaacatttaacttgcttatagtttccaaccatactagaaaaatgaacaagttcgttgattttgtcacattttgcagttggttcttcctgggatacaccaggacagggctggatggtttgtggaggaaggttaagattgtttttgttgttcagatgtttattatgcttcttttggaaatttccaggcaaaataattgcagccagattttgcatagaactttgggggattcattacctatccttttaaaaaggctttattgggtgtttatcatgcagcctgctctaaggagtaccaaggtgactaagacacagttataatcagtattgctttggagcagattttctactctgcctatgggcttttctgttctgaaactctgtgattttcaggagagaatattgggcccaactccattttctttgatttctaaaacatgtaggatctgcgcatggtggctcatgccttaatcctagtgctttgggaggctgaggtgagaggatcacttgaactcaggagttcagaatcagcaacatagggagatctcgtctctatcaaaggaaaaaaaaatttagctaggcaagatggcatgtgcctgtggtcccaggtactctggaggctgaggtgggaggactgcttgagcctgggagatcaaggctatagtgagctaggactgtgccactgcactcaagcctgagcagcagaatgagatcttgtcttgaaaaacacaaagaataaaaagcatgtgggtctgcacttgaataacattagcacacactacctgcagtttttagttggagtaaatgtgcaaacttatagtagcccacgaagtcattgttgagagcaagagtatccataaagatatatatatatatatttttttttttttttgagttggagtttcactcttgttgcccaggctggagggcaatggcatgatcttggctcactgcaacctccacctcccaggtgcaagtgattctcctgcctcagcctcccgagtagctgggattacaggcatgtgccaccacacctggctaattttgtatttttagtagagatggggtttctccatgttggtcaggctagtcttgaattcccgatctcaggtgatctgcccgccccagcctcccagagtgctgggattacaggtgtgagccacagtgcctggcccataaagataattttaaagcatatttcagttttaatctagaatgcactgggctcccaccaaatcaagcttgttgacttggagtgtggtcacatactgtcataagatgttattgaatgggccctaaacctcattgctctgttctgagggatgctgttgagaactctgttcattaacttccaacaattgcttcttcccagggttctgggaaggaagatagttctctctgaatttagggtgagggtagttgtgtatcttcttggtctccagtttgggagatactatcctgtagtgttaagaatatgggccccttatgactggatgcctggattcaagtatctgcttcacgactctccagctttgagaccttggacaggctgtgtaactttgtatgccttggtttctgtatctgtaaaatgaggatcatagtatctacctcatagagttggtgtgaggattaaacaagtcctgggtaaatgttagtctctattatcagatttatatattattttatagatactgtaaatttatgatcagtcatattttcttctttgcactggctaccccaaaactcaaagtgaaatctgtggataaattccggtacatgaacttagtgactttttaaaaaattttttggtggtgggtgggtggagtcctagccacatttctagtgtccttttctttgctctactttccttgccttttaacttatacttttaacagttttatcgatttaatttttatgttattgtgttgaattgcatgtcttggaacagtataggaatcatcactgtcatcaattacctgggtatttgccatccattgacgcttctttttgcatagtaactcattcttatctagaacctgtgtgttgtattcaaagttgctaaggaaaagcctttcccaaggtatgatggagacatgcaggtacacgtgtgtgtgtgagagacagcgagagagaaaaagagagagaatgagtgatgccaacaccaccccacccagcttgtatcaactttcctccatcttgtatatgacttgggtttagtcgtgatttagtcgtgattcccccctgtgaaacatgaataatttactttgatttaacagagaaatatagtacaaccatggactgctgggagccagtccaggtgtgacagttctggagaaaagttagggagtctgttgctgaccatactgctgtagatgatggcaaaatttgtctgtattattcagaaaatcaagaagactgtatttttagaaatgcgtccttttactgtgtttcaggggactttgcctccttaacatatatttttcattgtcccccatagcatttatttgaagaacctcactaactgcctgttcttggcacttccatgtttaatagaggaacctacaggatgttacctatgtgaatgctcacaactcttcatcttctcatgaagtgcaagttttcaattatatattccaactagttgcaatgaaatgcactcctgagagtgctttgttctatgaggtatatctggcaagaagaatttaagaactgataataattgatgctggctgaacatgcctgactcttgttacactgactttatatttgctgtctgatttaactgtcagaaataccatgtgaggtacatgttatctctgttttttacataaagaatctagacttgggagactaagtgatttgtctaaaatcaccaagctaacagtggaagaattggggatatgcgtgtgtttgactcagaacctatacattttgctattacctaaagctgtcctgaaaactgaaagcttagttgttctttctttacttggttattttaattctgatgtcatttactttaactcatcttattttagctcaataaaccatctttgttattttgggggggtcccacatctgttgaatgaaggctaggggtggatctgaaaattggtgtgcagggaaatgtatcttcactgggaaatatgaaattcatagttgatcccattttccagtagttcaataatcattcataagtcccgaaagaaccatatcatactttatttgtttcatttcaagtgataagaacagctttgtgtaatgggaaaattataacctggcaccagtgttgtattagtcttctgggtttgctctcagccacacgtgcatgcttttgctttatatgtggttctattttagtgcaatagtggttttgtaaaccgggtctgtagccagccttaagttgttttgtggatgcttatcactatttctcactgttttaagatcgcactgtaggactttcatctgagtgctatctgtttccactgggggaccttctctgtcaaaattgaggatttcattctttttgaatgttattagtgctgttgccatttgagcttattgctagaatactgaagctgttttctacatcaaaattagggtttgcaaccgagagacaatacttctcgtaaatgtttgcagtcttctaacatttcgtaccccaaactggaaagttgttagtattacgcatttgaaacaaatccattttgtttctggagttgttaaaactcagtaagagggcaatataaatgacccgttgttgtcaagtgaaatattgaattaagtctgtatcttttgagttgttttgttctcaatggagtgtttagttgaaacaagtaattgttaaaagtgttagagaagacagtgtccagggacactaatttcaccatcagatctggagctaacaactaagacaaatctagaaagctgggacagacagtctgaggctccttgatgctatcctgtttaacattgtttatcagagccttggaggcagatgtagaaagcatgctcatcagatttgcagacaacacaaaactaggtaagatggctattaccacaattgaatgacaatgtcagagttgtagaatggagtgatgcacaaaagcatgagatgggatttaggaaggataaatggagagtcctggatttaattcagaaaaccatctactttcttacaaagtggagagatgactcagtggcagtggtgtacaaaagccgtatgggatttcaggctcgcagaagctgagaatggaccagcaccctgtctgcactgttgagaagagaatgtggttaagggcagtagcccgttgaattctaaacagctgccaggatggttgaagggcctgtaaaccttttagtagcaggaattacagggagcaaagcatactttgcctgttgcctggagaagtgaagacttagaacatgacagctcttttcaaataatcagctttcctgtgcaaaagctaagatcttttttcttttcttttcttttcttttcttttcttttcttttctttctctccttccttcctctcttccttccttcctcccttcgttctttcttttctttctttctttctctttctttctttctttctttctttctttctttctttctttctttctttctttctttctttcttttctttctttctcccttccccttccccttccccttccttccttccttccttccttccttccttccttccttccttccttccttccttccttcttttttttctattttttcacaggctagagcaaagataaatgggtatacatttcaagaagcagagtttggccctttttaaggggggatgttctacatagtcaggatgctttacaaaattctgagtgcctcatctattcagaggctggctggctggctgggaagttgtacagttgacctaagcatttggatagaagttggaccaggtgacctctaacatctgtttttgctctgaggttggacaatggctgttttacttatcttcttgccaacaggacacacattgtggacataatgtaaaaatattcttaaattcatgttttcttgaatgagaacacttaattgtcatcagtggcaaacaattataattttttgaattaatatgattaatagcattatatggatagtagaattttcataataattaataagatcaatttaattaatcactttccccatgtgaaacatggagaaaagatcttatactataaaaagtaacaggaggcattcaagaggatatgagatgggacaaaatcatcaacgtgctgaatgctattgatgctgaaacagctgaattactatgtatattttgcattttctattattctttgttttttttttaagtagtttcatttctagtaccagaattcagcagatgtttaccacatgcttagtctcgaatttatttttccctttaaaacttgtgtggactgtaagtgaatttatcatctcttttgattttgagacctcatatctccaaagtattaaagtaaaacctgtttctttgttagatttagaataattctttggaaaatattttgcaagctgtaccatggtttgtactgcattttgtcctctattattgtgccaggattgaggtgaaagcatttcttttttcattttttggacaaattataaatgtttcttctttattgaaaacatgttgaacatttaagtcagttctcttaaaatttttaatgcaagagcaatttttcaaattcctatacatctggaaactatgaattttaaatttgcttaggtcttactttcttttttttcttttctttgttttttttttttttttttgtttgtttgttttttgagacagattttcgccctgtcgcccaggctggagtgcaatggcatgatctcggctcactgcaacctccgcctcttgggttcaagcgattctctcagcctcctgagtagctgggattacaggtgcctgccatcatgcccagctaatttttgtatttttgtagagatagggtttcaccatgttggccaggctggcctcgaactcctgacctcaggcgatctggccgcctcagcctcccaaagtgctggtattacaggcatgagccaccatgcccggccagatcttaccttcagctggcttctaccaacattagattgcttttggagagctgcgtaatacagtgatgtgggtgaggcatggttaatactcagcagcactcagcaagggatcactaagtgttggatgcacagctcctgagtggaaagacctaatcagatttagtttggcatcaaacttggcatcaagtctaaggcttcctgcaatcatcatagcttattctagaggtctggttggtatttacattactttttattcttttacattttaggtggctgcctctttgatgagccgtatagcacatgtggatatagtcaatctgaaggtgatgacttcaattgggagcaagtgaacaccttgactaaaccgacttctgatccatggatgccatcaggtttgcttttagttttaagttttgttttaaagaggaacacaagagtctcaatcatactatgtgttcactggatattggttaaatgagtgacggtgttggtctttggatgtggcagtcaaagttggattagctagtgagagtggtgcaattaacaggataggttataaaagttttatctctctccccttaaagtctaaattatacttcttttatttgcaagtacatcttagctagattagtgggcattacccagttgatcttttcccaagcagcaaatatgagaaaaagattgagatctcttctggtaaatgtgtctaagtgttagaactccagttggggaatccaaataacagtctccataggaggccttggtgggggacttttcttagcctcaggggctcccttggcacctgggagatctaggagaatgcccagtgatcttgaaagttttctgaagacaaaatggcaatgcaaaaatgtgggtattttttccactgaagaaatgtttagtgaatttctgatgagtgaaagatgtgttccactgaacaccaaaaagaattttacttcttgttgggagggaaaagtaggaagatggtgactagtgagctctaatcagcttggagcttgattattgcaatggaccctttttcaggctatgacattggacatccctttaggactttaggtctgcagatttggtgataagtttgctccactcaggattcaaactgtgaaacatgttgttctgatttggatttcagatacaacacaatttttacactttttaatgaatgcagagtttttcattaatgctccaaagcgtaggaataattacacttagtaagtaatcttgtaaaggtagcttttaaacgtgaagtagagtttaatgttgtcactaaggtttaacagtatgatgctcactgtgttcctgccctctccttcctacatttaactacttataacttcaaagaagggagcattgagctctttatcactgtggcttcactggacctcaaaacctttttagctgttggttatttccttgcagctgcagctcacaccctccttttctgtgtctcttgttttctttgtatgtgtgtgtgctgttgaatatgactgtttaaatcaggtttagttgcttttccaaattccagttcctgcttctgttcttgtcagcgataaagagaggggaagaggagaacacagctgtgctcctcctgtggggccgtcgtttcccaaacaggtgtcttcccctgatggccttttggtctttcctgccctctcaagaggatccagcctgtgtccagagaggctgggctagctgaggctgtgagagtggggagggtccttagatttagtcctggtagattgccccagaagagtgcacttactcttgctttgtctattaactcctcatttgataaaaaatttgaaatatttcacattaggtagttgacttcattatttttgttcttaaattgaaacttgacttgaaaaaatcagcttttaaaaataagcccaagtatttcagaatcttttctagcctctcctgactctgtttctggcacaagataactcacctcccttgataaatgaggccaaataaataatttcttgtcaccatcttgtccttttctttttttcaatggcccaccttagactaagttgtcaactttaaaatattaaaatcataggtttctagcacaggccgttaaaaaaatggtagtaaagttcaaagcccaggtgtatcctggcacagccagttaggtaattgaaagaacaaaggtgaatgaagaggaagtgatgctgcacatatatggcctttgaaggctcttctgacttgagaagaatgacatggaggcatttatatgttttcttatgatttattcttctattgattaatagaatacttgataattaatattaggcctttgtagcataagatctgtgagtgttacatcttgtaacgcttttgtcaagtctgacttatttctgatagttacagaaggtgtgttttggaccctcacccccaaacagattgcaactcattgtttggacctgagagtggtttaggtgtcagcatttgagtgaggaaagggaaggactggcagttcccccacctctctggctgtgcttatgtgcatgggtgcagctcagatttctgaaaactattgttgctccatcagattaaatatttttgccataatatagaactgaaaatacagtttttctttttctttctttttttttttactactcattaaacaaactttagtcattagaaattgtttttgagccccaatgtatgctaaacatgatggtaattattgtaggagaggaaggattataagaaatgactttttctctttaggaacttatctacttggggaaaaaaagttacaaaaatacaattagtgaacaatctaaaatgatatataattaagtgtgctatagactggaagtgttctaaaagcagtttctcaatatcaacccaatattttataaaagaatgtggagctgtgcccagctgacccatcgaccaaagtgaggagttacattctcaaagcaccgttgttagaagtgaggaaacagcatcttataaacatgcatgtactatcctaaagtctagatttttaaactgagtttccaatatgtatatacagccataagttttaaatgcttcttagtttccagggttttcaccttctttttcttctcctcttccattaatgtgtgcaaatgatttattcctttcaaaaactgattccaaggctggttttcccatgctaaaacagaaatgactcttatgaatttctcagggcaaatgggtgggaaaatcagatagaaccatagctttctgagggcaaattttctaaacctttatgtaaaatactattggatttattctttcatgggtatgtgtatttgtcttatgtatataggttggttccgtaacactttagagaccaagagttggcaaactgccctgctggtcaaatccagctcgctgctagtttttgtgtggcttgtgagctaagagtggttgttacatgttttaatagttaaaaaaaaagcaaaaagaataataaaattttgtgatgtgaaattcaaaatgcagcgtttacaagttttactgacacacagccatgcccatttgtttaaatggtgtcagtggttggtttcaagctacagtgagagtttagtagtggcaacagagactggtccacaaagcgtaagatatttatgccctggccctttatggaaaaatgttgctgatgcccgtcttagaccattttggcatcagcatgtaattgttattttggacccatggtttatattgttgttgttttctatattcatataattattaatatacaaacatttcacattttctctcactttcagaagatgtgttttctaaacattgggctatcaaaatcagtaagaaaaagaaaaaacatgattagagatttcctctatcattgccttaaatttgctatctcttgaaaagcatcgtgatgtgattttctttattttttagtacctaaatctttgtcacagtcctgtaattctaataagtgaataattcatcaagggctgggtgcggtggctcatgcctgtcatgctagcactttgggaggctgaggtgagaggattgcttgagttcagcagttcgagaccaccctggacaacgtgggaagaccccatctttataaatgaagaataataattcatcaagatgaatttaaaagttatgacagtgagagactaacatttcattctaatttttagctttttactttttctgtgtctttttaaaagttagtgctccagtgtatagatttgtttccccatatccttatgtgtgaggttatttttaaccacattttaaaaaattaaaatgcagtttggagttttgtgcaagctggcttgataactactctggagcagtgacgttagctctggaaatacatatttagggggaataaatactaaatgccgtttaaatttttgtatttcaagtgaacattcatgtcatagtagattaaacttttgctgctagctctgagtcatcacggttttcttggtggtgaaaccatgccaaacctaatttctctgttatcagtgagtgagtgattcgtttcatatcagttgatcttctctagtagcaatggggaaatttctttcttttttctttttatttttttgaggcagagtttcgctctttcacccaggctggagtgaagtggcacgatttcagatcactgcaacctctgcagcctcccactaccttcccgccctggttcaagcgattctcctgcctcagcctcccgagtagctgggactacaggcacccaccaccacacccagctagtttttgtatttttagtagagacgaggtttcacggtgttggccaggctggtctcgacctcttgacctcaggtgatccacgtgcctcagcctaccaaagttctaggattacaggcatgagccactgcacccagcccacagtggggaaatttcttgaactttatcataaggattactatttgaacacaaaaatcttgatatagtaacctggtattttttgttagcactgttacatcctatcactttatatactgcagcacattctataattatcacatagattaagaagcattaagaagggttttatgatataaaaacacctacctggtttgataatgtggtattttgtgtacttgtacctcagtgttccagttctatataattgatacttagtagattctatgtgcttaaaaatgtaaccctgtcttataaaaaaattatcaaattcatctacaatattaaaaatgtgaaggtaacttataatcatagctataaccgtagctatttgatactcatgacatgtatttatagtctatgttgtccccttaagttttcttacctctagaaaggctgtaattaagtgaaagtggatatcagtgttgggaaaacataattctcttagtatttttccaggtagtatagcatgggactacataaagctcatttagctttccatgtcttagttatatctgtggggaattgggaatgatgctgctgctaattttcatggaaatgtgactaagaattgaatcacgtctgtgggtgcccgtatgaaagacagagaggaaagtgtcaggatggagcagcgtgtgcactctgtgtgatgacccagaaaatagaaaaatgactacatatatttgtttagagtcaatttcacatttgggaaggaagatggattgacagacaaagtaattgaagttttctctttggatgcacttatcaggcacattttccttgtgctaaggaagacttccctatttattcacacttcaggacttattcaggtcttagagagtaacaaagagaagatgacggtgggcttgaagacttttcccctctaaaatttcagcatgtctccagtgagaaatgtttttggcacagaatattcagacagttctctaattatcctattcattctttcaaatcagtcaacattcaacaaatgtttattaaacacctgctatgtgctatgcattgttttagatgcctgagatttttcaccgagtgaaacaaataaagatcctcttctcagcctaccttaaattcttcgtctgataagatcgttcctggatgggcttacgattatatgctagaaaaccacattttcccacatttattaatgactttctagtggcgagtatttaagaggtaatccaaaatatagttcatcagacccagcacattaaagcatcaaatctagctttccatatagctttcttctctaaaaaaagtaagataaaaagtctaaatcttaggcaagtggcagcacagtattttcagatcagtctgccttagaaaacaaagtaatcttgtacatataaatgacactaagcagtcaacaacatttgcttttttgttctgtatcatttggttctcgtgatgggcctggtagattgggtggcattatcctcattttacaacataggaaactgaagttcagaaaaggaatactttacccaggcatccatggcacaacgacagccttcacttttgttctttggagtacccttatgtattctcttcacgtgagaacatgcatctggggaagaggctagtctttcatttcaggtgcatgcatttggatcttcttgaaatgaatgtgaaggctgttgaccatgggtctacatgccctgcccaggtcagctgctggctctatcaatgtgcagctgttgaccttggtcaagttctgaagctccctgttttagtcctattatctgtaaaatattagtaatagctgttcgtggaacgactactatgggcctggctataggtgctagagctgtagcaatggagtttctagcctcttgatgattaaatcccatggaggaggcaggcagtccacaggtaagggtagaaaatagactgtcatggtgggaagtgccaagagtgctgaagaggaatcaggataagggcttagagagcaatgggggttgcagacagggacagcttttctgaggatgcatctttcagtaaagacctaaatcctgtcaagaccaagaggccatggaggctgagtgatccagcgtagggaagagcaggagtgtgctctgctggagctaggggtgggagtcagaccacataggaccctgaaagccatgggaagacgtttaaaacctacctcaaagagttattgaccaggtgagacccaataacacacaccaggagcttagcctctaacccggcccagtgcaatgttcaacagatttatttcctttattagtattattaaataatttagaggcaatttggtatgaattcatctcttagcttaattttgactcagctaaatgggcagcttttgctaaattcttattttctcttctgaatgacgccaggtaagaaatagaagatataaatcttcatctaatttttgattggattaaaaagccccaagctgaaataagtctattaaaatacaataattaaaaaaagtctttaatcagtatatttgtttcaaaaccctattaatatctcaaatgaaattttcagatatttagatgcagcagtgcctatttttttgagtcaagattttttaagttgtaaaaaattaatgttgaatctgcaaacaatcaaatacactgattttttttctccttcttttattttaggttcgggggtacatgtgtagatttgttaaatgggtaaattacgtgttgctgaggcttggtatacaaatgatcccatcacccaggtagtgagcatagtccccataggtggccttccagcccatacccctgtcccaccattccccccaagcagtccccattgtctatcattcgttcccatgtttgtgtccatctaacagtgttttttatctggatggtaggatttgaggttatggccccagcatttccatctgacacatttcctttataaccaagtctaactttatcataaaaattaacacttaaatgtttgggaggtgggcattgaatttgacatttttttttagttgattctgaataattccagtcactgaacccaagaaatgaaaattgagttactctccttccttgaatatctcattcagttgtccacactgaggctcccacctgagttctagctgtaatataatcactagtgagcattcgtcctccctaggtcttactcagaccaccttggtgaggcttagaatgagtttacagtcagcttttatatggtgaatgatgagacaaagcaaaataaattggactggagttgtagtctctcagcagtttcaaaattacaaaatttagaaaaataactttagatgattatgaaaaaacaaaccatttcatgtcagtgacctgtggggagcacttagtgaaacaccacaggctctgtgtagcctcttttccatgtgcgtggacaccatgtgccccttcagtggcccttactggttgtgtgggtaatgggtgtgtgagggagggttcttcccatgagggagatgctgggtgatggagccaaaggctgggattacgtttcatgttaattaggaaggaaggaaggaaagaaggaaggaaggatggattttagttcttgaattacacatctgatttggtgttttcctccttttaaaaaatgtagtagaatatacatagcgtcaaatttactatgtgaaccatttttaagtgtacagttcagtgcattataaatgcattcacattgtacaaccatcaccattgtccttctccagaacttctgtgtcttcccccaactgaaactctgtacctattaaactctaactcctccttcctcctcccccagccctggcaaccactgttccactttctgtctctatgaatttggccactctaggtagcttatgtaagtggagtcatacagtgctgtccttttgtgtctggcttatttcatgcagcataatgttttcaatgattcagtttttctatacaaaaactttcagagattaaagcagtcattctttaaaaaatattttgatttttaatatcacactgtttcaagggggccaatgtcagccactatattatgtatgaccacttatttcagtagtttatatttaacattcaacaaatgttttcctttaaatttgttccaaattcctgtcttggcagattggaagcttacaaaaagtaagaatagtggctagctgtgttttaaatatttgctaaaaagtatacaaattagcctgtgtttataaataatgtgttttaatagttttatttcctgcttaaatttcccataaaattgtacaagatgacatcataagagttatgtggagccaagtaatggaataaacaggctgatcatgacagatgttgtacatcttttagttagcatctggtagtggagtgggtgagaggtgggagaggtgaggactaagggtgatcagcaaggggatggttatgctacctttcctgaaaatatccaccgaggattcactcagctctcacagcctgtgtgttccacctgtcgggctccatagtgtgagggactcatgctgggcagggccaatttactgggacagagaaacccaccttggcaatatgagtcaagaaagggacaatgagttttgaggtgacactcatggacattcccttagtcccagagtcagaggggttagtgggtagagatggagctgatttttgaaaacattttctctaaagaccagaaagtccaacgcctgaggaagacttcccacttggattcagggcagcagaacagtgccctctctttttattattattttatttatttatttgtttttagagatggggtcttgctttgttgcctgtgttggagtgcagtggcgtgatcatagctcactgcagcatcaaacttgtgggctcaagggatcctcctgcttgggcctctggagtatctgggactataggtgcatgccaccatgcctggctaatttttaattttgtgtgtgtgtgtgtgtgtgtgtgtatgtgtgtgtgtgtgtagagacagggccttgctatcttgcccaggctggtcttgaactcctggactcaagcaatccttctgccttggcctcccaaagcactggaattacaggtggaagccactgtgcccagcccagtggcctctctttactggggtggatccatggagtcacaggggtttggagtgggccatcactgtgctaaccggcacagcccactggccagtggatggtgacgttagaagatccctcacattgacaccaagatggggaaggccttgaaagttctgtgtgacctagggcactgcttcactgtattctccttctgcctgtgggggatcattacagggtcccccataaaaaagtagctgtccagactttccatagtccaagaagtcaaagagccgaatacatttaaataaataattggtaggcctagattatccttttcactttaagaccaggaacaaatagaagttccttcccactgtgaaaggtgatcccaggaattgggtcattcttgtcatacctaactaaaacagagtcaagaggccggaggggaaaagcaccctggacacacaccattgctccaagtatgtcgctctctgccagcccagctgctgaagctgcctgctgtaacctgaaaccagttttatgtaatagttcctggaatacctgctgtgactcctaaaactccttttatcccaccaccttacccaccatcgtcactcaacaatcagagcttgcccagcttctccaaacttttctagtgccaatgaactatggcactagaaattatgtttcagctttttataaaactatgtttcagctttttataaaacctccaaccttctatattcttcagatctaccaagaccacccagtctgcatgtgtgcccaaattgcagctcttttctcctgaataaaacagtaaattcagagattagtctctacatttttattttgacattgacactgctttttgagcactgctgtgtgcaaggtgctgttccagtcaccagggattcagggagacatcagcctgcagtcttccaggccatgtagaagtggtgttgcaagtgaatgctctgggggaagctccatttgtctgctctgagcccaaggaggctgccacccagttggaggccatggggtgagggcaaggggaaggcttccaggaggtgggagcacccaagaggggcaagagaaggtgagtagtgatgctggaacaggtagaaacgccagacagaaggacatcctgtgtaaaggcagtgaggggtgggaagggagcacaggtgttcacaaggctgcctgggaaactgcatgtagttctagggactgccaagtacatggaatgggaagaggaagaggtccagacataggcgatgagctggtgaaggatatgaaggaagagggtgatttgagtgttgatttctggcaaagtgagaagaaaagaaaatatttaactgagtatgtgtagaggaaaattcaaaatttctgataagagtgtctccagaaaagatgtaataaggaaatttggttagtaaatgagtaccaaaaagcatatgaatatgttggagaataccctcgttcttaggagattcatgctgaagtgttaaaagatataagtgttaggatatctttgcagaaaaaagtgtgtgtgtatgttgagagagagagagagcgcgcatgtgtgcagatatggtaagatgttaacaaatgttgagtctaagggaagtgtgcgtttattacttaatttttctgtacttttgaagctaagcaaaatttgcagtataaatgtggggctacaagagacattaattgaggtacaccgacttcgtgtcatgccaacacagtttttctccattggtacattttaggcaaaatgctattccatcaaattgcattgaaagtgtttatttacaaaacccaggttgagccacgtctgcactttctgagcatatcgtgatgatcattggtcattactggagaggtttagtagagctgatggacttatgtaataccgatttggagccactaacttaaagtgtgtaattttaggactttcttaaataggacaaatgcttcacatggttttatgcctcagtgggtgtctcaaatataaagattcttatcctattggtagatattttggtggttaactttgttggaaaatgcataaggaattattacattttatttttggatacatgcttgcattcatttgtatcctatccataatatgggactgaatacagaaaaaatcatacagaatttcttggcagactccactagatgattgtgcagatcattattttaaataagtggactttaatgcatagttaactgatactttattctaggagattgtgatgaattatatcttaaagcaatatgtaaaagcttaagtggtcgaaagagaaataaatatagctatttaattaattgtctgccggacaattgtaatgcctctgtctggtgggtggacaaattgaaacaactgattatgcagcattagtaagtgtctaattggatatgtggggtagcatattaatatagtggcacttttagagagggtgtcactggaaatttgtttttcaaatgaccagtccttatttgtatgctttgagtcctctaatatgtggttgtttcttaattgtatatttccttgctttgtatctttccttgaaagaggtatcttttatatttattctgttacccatagaaaatgcataaaaaattgaaatccttggcataaaacttgaaggtgcagactaggtttgatccagtgcttttcaaagtaagtataaataaatgaggtttctggtagtcatcttgggaaattatgaaaaccatcatatgccttctcatgacacatcttttttctctgttgaagacgcatcctattacacaccttgtgaaaatggtgtcacctccctaattgtactctgtaaacaaaacatcccttagttcctgattgtcctggcttactgtggagtgacaggctgcaatttgccagtaggtcaaccactgaactgatgacaagtgacctttctaacactgcaatcaatgcttgttatttggaaaacaaaatgatacagtttgtattttttagcagatgggtcattgggtcaacccaccactgacatgtgaatttgttacttgggctggatgagtcagttcagacagaaatgttaatttatttgaattgatctgagtcttgctcttataaaaaggtgttggacatttgttgatggcacaaattattacaaataattggttttatacatcagtcaaacaaagacttttagagggcccacttgatacaatagcattatatactagctttgggaagcattcaccataatgtattttctccacacttgatatttctcaatggttttgagaaaacccaatttacataagtgatcttgcatgtgtcatatttaaatagtatctctccccatgttgcctgaaatgtgtttggtgttagaccccatgaagagtcaggaggatgattaagttctggaaaaaatgctgggaagagatgaactgtcataagagatagcccctgtggttgtcagcgttgttgaatgactgcttccagctttcacctgctagaaacatgggaacattgggcatctctgttgcatttgacttagatgttactgcacatgctttggctggtgagtgtgagtgaaagtgacatgtgctattttcaggcagaagctgctagaaccaggatgagagtcaaggtgttctctccccttcttcctgtcatggtgactgtggcagcattgagacgcttttagcccagatgcctgagtgaggaagatgtagaaatgccttcccttgcccctcacacattcacacacactcagatgactgcagtgggtgtgtgcctgaatgagaaataagctgtgttgtatatgccactgagattttggagttgttgaatggttctctaactctttggtcttaggactcctttatactctgtaaatgttttgaaaaatccgcagagcttttgttcaagtgggtaatatctacttctattttctgaattagaaattaaaactgagaaagtttgaaaacacaagagtccataaacatctcttccattgggcatgagagcagtggtgtagacctgtgagagttgagcgtgaactgagaataataaagtcaaataatgtcttcttatgatcatgaaaatagttttgaccttgtggcctccctgaaagggtctcagggatttcaggggtctctggcagatactttgaaaacgactgacctaggccatgctaagtgatgagcatacctcgataagttacagttacaggctcagagaagttgagaaggaaaagaaagaagggaaaaagattttggaagcattgcaaaagactatccctgagtgttagggttttctttttctttttgaataaagtcaatataaataattcattcctgtttttgagaagtagtccctctttatactaataaatgcctattttactaggctatcaaatgaaataatgcacataaaattatattgtatgaagccacataactgtaaatattaattctatgaaggttgagattatgaaatattttgctttggaaaaatatgaaagtatgagtagtattcatatacttagaattaggtgtaggctttctggatggtagagggttggagaaagtgaaatattaaaacatatatgagtgagcttatctaagttccatcagtagtgctgcttctgggagttttaacggtgaaattgtcatatatattgtaatgatgaaataattccaaccccttttatgaagtgtgtagtgacaaaatgatacaaaggtggctaaacatgttttgaaagacttgaaaattgtgcttaatggaaatttcatgtgcatggatagcaaatcccataggtgaatagtcacatgcctatcaatagcccaattctgtaaggcaacatatttatttcctaagaaatgagtcctaacagaatttgctaatatttgaaaggcatcatagacaaacattttctgagctttttgttaatatagccatgggaaaggttaccaagggaatctgatgatctttatagatttgtccagctgttatagatagttaatatttaagcttcaggaaggagacctaagtgggtgacctccctagctttttggttctccttttttttcagtaaatacttatgaagtatgtactgtggaatagctgttattgtatcctaccagataaagaatatcttgggctgggcacagtggctcacacctgtaatcccagcattttggaaagccaaggcaggaggattgcttgagcccagaagttcagtacctgtctgggcaacatagcaagacctgtctctacaaaaataaaaatacaaaattagtcaggcatgttggcacatgtctgtagttccagctgcttgggaggctgaggcaggaggattgcttgagccaaggaggttgaggctgcagcaagccgtgattgtgccactgcactccagcctgggtgatggagtgagaccctgtctttaaatgatgatgatgatgattattattaatattgtcttggaggatctatgtacaaggtttctgaggtcacagatttctgaggttagcaaagttgatcaatgctttacttgacagaaaaatcaagcattagaataatgcactgaatggaagaaaagaaaattaaattcatgaagtggcatagacttgctgaagattaatttcctctactaattggctacccattatggtggtttttgaagcctgggactcacttaagaaagggcttgttatctggagtccctagcaggctgaaaacgctaagatttgatagatgtaatcaagacagccagaagtcgctatctgcccatttgctctggctggcatctttaggaagctgaatacatatcattctcctttctcaagtatagttgtgcttgtgcagggaagggttgccttcgctgagagaccgcttatcttcataaaatgcctatattttgttcatatacggttaccctggcactgaaaagagaaatggttgtgtgttgtttcattgcaacctttaagtaataaaagtctgtagttgtgattagtatgagcattcacattttcttacccctgaaatgaggcagtagcttcttttctcatttaatttatctttaataagattgttgataagctttaagccatgccacactttaaaatttcagtaattccttaaatcccccagcagatggagacgtggaattctttgctccttcactggggcctctgctgttgccccaggtgactttgcttgacttctagttaagatgcagtgtcaggttttgcaaatgagctaatgaatatgctcttttgcatttcttttcctcctcttgttggcctgcttaagagttcttacttacttttgcatctcataaggtcattatcattactgaccttccccagtagatacgaacaatattttctttagagacatattctcagcaaagcacagaagagagaatcctctgagctccaggggagcacgtttaaatcccatgtgagcctttcacaggcagcatcctgcccatgttttgattcagagtaaatcccagaggtcagatgctttttcagccagcagggtaaagtttggtcacggttttctgggatcagcatagcggctagagagcctctcctctgtggcttgtggctctgcatacccactgacacaaagaggaagggattattaacagtcttattttgaaagggtcttctgattcaagtgattatttttctttcctccctgattcacttatatctattttacgagtattaaagaggagatctctctaagacttatctttgacaaatgcaataaaacctttcaaaagtattaattggtgtgaagccctttagaaagtcatgccatttgttgcatttcctgcctttattgctatttctactaatcacctgggaaaaattactggtttttaaattcttaagtccagttctttctaagctgataaactttctcccagtaaattaaaaagaaaaggaaggtaaccttccgaggtagctcatgggagtggttgctaactcttaataattgaaaatgaaagttggttttaaaaaaaaaaacacatatgcaaaataactcaccaaacatgaatcaataaaaaacaaattgtgataaaaggcatgctctttaaaggagctggtagtttgtcatgtttatttattttttattataaggctttcttcattatttgaagactcatcttacaaatgtgttcttttccaagctaaataatgaattacattcatgtaagacatttttacttaccttttatgccattataagagcaaatgacatggttatttcatatatgtctatcgacttactgagatctgagaataggacacatctgaattcagtaggccctgtggtctagatccctttttttttcagattaaagaactttccaaagaaaaggaaactctttgttttttgctaagaatttacataatagaaaaaacgtatgtcttggtgtaacactagatgctgtgacaaataaatctcacaatgtcagtaacactgtggacctttatttcccattcacattatagtctattgtggtcccagcttggaggtggttgggttgggagcttgttacacatagacatcctggttgaaaaggactctgcatcttcaacatgtattttccaagattctagatgtcaagtggacatccagatggcacaggaaaagtccctggaggatctgtgtggaggtttctgtgggctaagtctggaagtggagagaaaggcagctgggagtatggtttagttggatgcacagaagaagaagaaaaggacatttgatgagtagctggcaacttctgccccacttggccttagaggttattacttaataaaatggtcctggtaaattattacaggagaacattatttaaattgaatataatgattacttttttgttctataaaggagtgctatctttaaaaatccaattaattgactaaaataatgttttgagaattaactttatgatgttttgatataaaagtcaagaattaatccataacaactagatcttacacaagtagattttttcctaagctttatattattaaaccataccctaatattttcataaaatattctcttcccttaactctgataatttcccagatagagcaaagatatatgagcatatattgctacttaattcagtaaagcaaatatcattgaataaatgtcagcttttccagggaaaccactgcatataacctctctggataatatatttatcaaaaaatcaatactaaaagtaaacggatttttaatacatctgaaggagcttcttaataaaccaaaatgctaacccataatttaaagctgttggtaccagtaggtacttagagatgacatcataatttttgtagattattcttcatagtggtctgtatgctacatttaattcagtttttactttgtgctggggagatgtgatttattttagaggcatgtaaagactattctggcttctctttccacagaggaaaaccccagaaggtgcatgaagagcctgtggctcttctgatctcttcccttatgttttgctctattcagtgccgggtggttttgcctgttttctcctgtctatcatccctctgaaaacatctgcttaacttccccgggctcataccccttgttatttgggcctgcatttctcaaactcttgctatccattgattatatgactgacacataatacattttttaaaaggtcaatcacaaattttaaaataatttttgaaaaattgtattttaaattaacaaaagtgtttttttgtttgtttgtttttgctttttattttgagatagggtctcattctgtcgccagctggagtgcagtggtgcgatcacggcttactgcagccttcacctccccaggctttggggatcctaccacctcagcctcccaagcagctgggactacacaacacaacactacacctggctaatttttttgttttttgtagagatggggtctttctgtgttgcccatgttgttctcaaactcttgggctcaagtaattcaaccaccttggcctcccagatattaataaaagtagccttttactagtgaaataatttttttaaattttattaccaagttacctacatagatggcccttgagatttctttctgcagactctgcaaggaccaaatcaaggaatgtcccacaattaaaagctggacatttggatatttcaacttggagataataataaatatattcccagaacacagtttgatggcatttggcttgtacattttattgaagtgttagggtgtggtttctagttatgttctgtcatatgcccaataggaaggcagctgttagcgtagttgttaagagcaccctgacttcacctcctcactacgtgacctcattcaggttactgacttctctgagcctcggtttattcgtctgtaaaatggggaagtttatgactcacaccgtgatgttcttataagaagtaaatgagagaatgtgtacagagcttaggacaatgtctgatgcagaatccaattaatcattttcttttcttatgggtactacttttaatattgtatctcacaatgaggagcactttctcttatgttttctcttaaatttttttcacttaccttccttctaaatgacaatgttccactgtagcaaagcagttctccttctccatgcacagtgtacttgaaatgtggttatttggaaatttggctaaaagttggttattttccccattcttccttattcaacagtggctcaagatggggaggattattgatatggaagggaagtggtgggaagggaagggtgtggtcactggagagagcttcatgcccggcctgtgctcagggacctaggtgaggacaggcactcctgcctttgtgcccaaatgttgcatttcctaagaccatcctggcccaccacacccccatcttgtccctatgaaaaccccgagacctttgcaggcagacacacaagcagctggacatcgaggggaaaacattagtggaggaagacataaggggctggaggtcaagaggacatcgaggggaacatagcggcagaagagcacaccaccagacactggcacgccttcggcctacggaacgatgcggaggttagcctggggcagttggaggagagcctgggccactaagtggtccgactccaggggaaaatcatctcccttctggcttccccatctgctgagagctacttccactcaataaaacctcgcactcattctccaatctcacgtgtgatctgattcttccggtacactaaggaaagaactctgggatacagaaatccctctgtccttgtgatagggcagggggtctaattgagctgacttaacacaagccgcctatggatggctaaactaaaagagcacctgtaacacatgcccactggggcttcagctgtaaacattcacccctagacactgctctggggtcggagcccctcacactgcctgtctgtatgctcccctagagattggagcagtggggcactgaagaagtgaactactccccctgtcatataccctgggagggggacaagggaaccattcccgtttcattatgatgttgagttccacctgggtatgtcgtggtgtgagggtgaggacaagaggaccatagggcccaagtctcatcattagactttccacattatcttccaaaaaggatatactataagggatagagacttatgagtaagattaaaagtagaatatgttcatcatatcgccaaacctgctcaatcacactgctgacagtgtaccaagaattagtatttttagtgtactttttagattgtgagtagcgtaactatattacattataattgttattgtttgaagtgttaatatgttaaacatttaaagtaataccacttaaaaattaaatcttggcatctatttaatatgccagggacctcacaatagaattgaaatggactcttggacctcaagttgccctgtaccaactgttccctggggataaatcaggtatggagtggtagttgtggctgtcagctccctccacagatacctggccagtgctccagtagcaccaacctcagaggactgttcccagtctacatcctggcttacaaaagcgaagctcacatatatttaaaagatgctcttctctcgtcaaaagatcaaagttgtagagcactttttccttgtgatcaccagatgtactaagagctgattcacgggcttcactcaggcgtttggctgctggcaggtattgtggatcgtcgttgttctccatcgagtgcctctgattttctgttgccattgtattttggcattagactggtggccagtggtgtcatttgatgtaggaattctgtcagtaagctcttctatcttctctctgaccgtagcctggttcatcagcctttcagctgtttttaggagcgtctcagagtgggatctgttttttaaaactctgaggagatttttaaacctctaaggagaacaattttgaatggtgcctgtgtaactcagggttcttctctttctttcctgacaacattcttaggtttatagaagaaattaattgtgcttgttctggaaaaaaaaaaaaaaagctatattggagtacccagagaagccactttgagactttcgtaaactctttgttatgtctttgtttgtgagagtgttatgatggtcagtttacagaggagttgaggtagatgcattgcaggtcaagttacatctgacctttagctattcatcttctgccttcctattggtactttctctattttggcaaaatctatgaaaccatccctctttgaggtatttttgaatgaacacatactagtttacattgtatatttgtatcacacaaagttttgttcaccaagatattaccactatttttatcgcattttttctttctttctttctttttttttttttttttttagagagacagggtcttgttctgtcacccaggctgaaattcagtggcaagattatagctcactgaaccttgaattcctggcctcaagcaatcctcctgtttcagcctcccaagtagctaggactacaggcatgcaccactacagctaatttttaaattttttatagagacagagtttcactattttgcccaggttggtctcgaactcttgggctcaagtgatcctcctgccttggcctcccaaaatgctaggaataaaccacttttgaaacaggatttgtttttttgaatttggactcaaacaccacacagcaataacaaagatggtagatttaacagatgtgattagtaacaagcagatgatgtaaatacacattaacggatgttcactggtgattggctgaacctgcagagatcagtgcctgtggatggcaggtgccccttatgctcacacaagtcacaggccaggctgcagatcacagtacagatcccctaactttgaattttgaggaaaagaaacacacacatgcgtaacctataagagtaaacaaaaatcacttgcattaccatgcaaacttagaccacatggttcaaaaagtgtgggcaggagggcatgggtacactttttaccctgcctttgctggagccaattcattctgggagagcagcgtgagagctcacctcactccacagcaggtctgagcagggtacagcagtgtcacccaagggggtgtccctgataccgtgggccattcccagtggtaggggagcaggccaaatgccacagtcctctgaggctcaatggctcttcaagtccaccagacttagagcagtggagtccaagcagctctggatgctgttgtcaacctccagtcacatcactgggttcagattcacccccacacccgtatcgccataacacaatgctttacaatctgaggcctaatttagccagtcatctggtgaccatctcaagggacctttgtccagtggtgcactgagcctgagcatgccagcctaaaggggaattttcttgtcatttccctctggatgcgtgtatatagcacacatgtaacttttagggaccaaacaattattaccaaggtgactgtgaacatcatgacttttcttatatttcacatctgtgacacgtatgcagtggctgcatcaccattgggggtcaccagatagaggtcagtgcttcatgatgccacgtgtccatgacagactcagctccactcatgtacctgtcctttttcaccctgagcactggtttctaggttctctaaaatgaagatgaaacgcctacttgagtcgagtgtctagggctgggctttaatcagtgcacatggcctcatctcttgtgaccctgctctactgtcctgaagcacatgcaggtgcctggccttgcctgcctccctgctgtcactgctcatgacactggtctgtgaagcctcctgtcctgtcctgaggtccaccagacatttgctgtttgtcctttgtgctcctgttgctttgtgtggagattaacaaggtgctgcctttatttctctattgcatttgatgtgcccatatccaatgccagcctctcttctccttaagattagggtgttcctccactcagagtagcctcatctctgacccttcagtttgtttgtgtaacgttgcagtgatcttcaacattgcagttgaagatgacaatgttgaaaagagataattttgcagatcatctagatggcttaccagctagttagatgcatgtgaactcatgtgggcttttaggctgttgtctgaaaatactcaattgagcataatcctcacttcttctggccttcaaatgtgggaaagcagcacccaggagaatgtgctgtgatgacagcagcagcagaatccctggaacatcgagttcctagaagattgtctttttcatagcaagggcctggatgacacctgcagtgtttcaggcaatctagtgtgttctttagccacagtcttgagagctgctaatcttaaatttagggtctgcagctgctgctgccagcactggtggacattccttccagctgcagaatcccctctagccactgggatttaatttttaaccttgatatctgccttgacttcggatgtccctgtgctattttcattgaagcaggggaggactcttccattcaagttaggactctctaattagattaattaattaggtcttgtggtctgctggtgataggtaccctagggttagaggtctcccacttgagtgacagagatgagtgagcttgtgatatgctatctgtgcaagaaagagtaaataaaatacccacgagggttggtagttcaaaaatctcatggagattggtagcacaacaatgtgaacatacttaacatgattgaactgtacccttaaaaatggttaagatgggccgggcatggtggctcactcctgtaatcccagcactttgggaggccggggtgggcagatcacagggtcaggagttcgagaccaaccttgccaacatggtgaaaccctgtctctactaaaaatgcaaaaattagctgggcgtggtggcaggcgcctgtaattccagctactcaggaggctgaggcaggagaattgtttgaacctgggaggaggaggttgcagtgagtagagatcatgccattgcactctagcctgggcgacagggcaagaatccgtctcaaaaaaaaaaaaggttaagatggtaaattttgtgtgtattttatcacaattacaaacaaaacttcttaaaaaattacctcaacacctctcaatctctttcagttcagctctgatttttgttttttctttagaccatatttttgtgcatgatgtgaaataagggccaaattcattttccctcttcctttctccttctctctccttatgtcttcttaacactctttttgcttcctgctaacttccaatatggaaactcacattccccaacaccgtaatttaaaagacgattattctctgttctgtacctttgttaaataaatgtaaacacataaacatatacctatatgtatttatgtatctgggctcctcattctgttccattgcttaatttgtccatttttgcaccggtaattacacagacttgacaactatggttgtatgctgtgttttgatatctgctagaccaagtcccaccttgtcccttttcatgttaagagtatcttagatactgttttagtctgtttgtgttgctataacaaaatacccaagactgagtaatttataaataatagaaatttatttcccacagttctggaggctgggatatccaagaccaagttactgatggattttgtgtctggtgaaggctcactgcttccaagatagtgccttgctgctgcatcctcacatggcagaaggaggaagggcaaaagggcagatggagctctctgaagcttcttttataaggacatgaatcctctccatgaggacagagctttcagggcccaatcatctcccaagtgccccccttcttcatactatcaacttagaagttctaatatatgaattttggagagacatgcacattcaagtcatagccaatactactggcatttccatgtgaaccttaaagggaacttgtcaagtaaggctttggttatattaaatctatagatcagtttgggagaggttaatgtctgcaatatatcatgtcttttaatcagtggttttgatatccccatttatttagatcttcttttttcttgctaattgaggcatgaatatatataccttttaaagaatatatataatctacttacctgataattccttgaacacctttggttagatttattcttgttagttgatattttttgatgcaattataaatgttgtctttttaaaaaaaatgttgctgatacatagaaatgtattctacatttttatgttgaacatgtatcttcctgccttgttaacttcagttacaaattctttaaggttttctgtagattattctgtaatttttatatgcatatataacatccttattttgttcctgatcttaaaaggaaatatttccatgaaacatcattaatcattaaataatggtatttactaagatccctttatgctgtccttacctttaactggggtacaaggcatggcagtatctgtgaaagtgacaggatactaccctgccctaaatctagtaagtattgtgggatatttggatttgggcatcttacaaatatgaatctaggtgtatcctaagcaataaagttgtcccagctactgcaagcccacattaattgtacctattactagtatgaacattggaaacattaaatcccccccttcagttgatagcacttacgttaaatagccaggtgagcgccaaagcatacactaaatctattacagcgctgcccaatgtcatttttggtcatggtggaaatattaacagccatgcattgcttaaccacagggatatgttctgagaaatgactgaaaatatgtttatcagtcttttgtttataaattcatgtttttcctccaatgcaatggaaccttgtgcatgatactgggggcaatggtaagctcttactactctaaagggagtggctgagggcaaggtcagatgcatcagagaatatagtaaataagtttcaaagtgtatttgtagccatcacatgcaatacaaaataacagaaagcaagttgtcttattaatttaaggcacccagtttgacaggttggagtatcatgtaatggacaaatcaaataattgaataagaattttcaaagaagtaatccaaatcttagttatccaatttaaaggttacagttggtcatatagtcatgtgtcttttaatagcagggatacattctgagaaatgcattgttcaggcagttctatccttgtgcaaagatgataaagtgtacttacacaaacctagatagtagagcctataagacatgttggctgtatggtataccctattgctcctgggttacaaacctgtacagcatgttactgtactgaatactgtaggtaattgcaacacaatgataagtattaacgtatctaaacatatgatggcatagaagacttagaaaatatggcatgcaagataaaaacggcacagctgtatagggcacttacaatgaatggagcttgcaggattggaagttgctctggatgggtcagtgagtgagtggtgagtgaatgggaaggtctaggacattacttgacactactgtggattttataaacactgtgcacttaggctgcattaaatttatttaaaaatattttcttcaataataaattaaccttagcctactgtactgttattttataaatttataatttttaaaaaaactttgacttttgtaataacacttagcttaaaacacaaacatacagctgtataaaaatattttctttatatacttattctataagcctttttcaatttttaaaaatttattgatttttttctttactttttaaacatttttgttaaaaagtaagaccaaacatcttaccctaggcctagaattggtcactgatatatcactgtcttcaacctccacatcttgtcccactcactggaaggtcttcagaggcagtaacatgcatagagctgtcatctcctaggataacagtgccttcttctggacacctcccgatggacctacctgaggctgtttcactttttttttcatatgtagaaggagtacactctaaaataacaacaaaagtatagtatagcaaattcataaaccagtaacatagtcatttattacctttatcaagtattatgtactgtacatgatgcatgttctgtatttttacatgactcgcagcacggaaggctttttacactagcagcaacactaacacatgagcactgcgttgcactatgataggatgactgtagtgtcactaggcgataggaatttttcagctcccttaaagtcttatgggaccatccttgtacatgtagtccatcattggctgaaatgctgttgtgtggtgcatgattgtatatttgtgctgtccagtatggtagccactaggtgcatatgaccattgaacatgaaacctggctagcatcactgaggaactgaagttttaattaataaattttaaatttagataggcagatgtagctagtgcttactatattggagagtatagtggagaaagtacatttagaaatatcctatgtccttccttctcttagggatagcagcctttgggcagaagaactttctccttctcccctctcccttctctgaggttctcaccgaccttttccagtttgccgcagctgctaagcttcacttgccacttgtttcctgaggatcatcaccttgggcagtccactcagcctgtttcaccttctgactctgtttgctcagggtcccgctgctgcctcctgtgtccctaaagaaaggagtaaatgtgctctctctttccaaggggccactactgggtcagggaattgttttatttatttcacccagtaaatgatttcagagctttcaaagttaagggcagaggacggtaaagatgatgccacatcacctaggcaaggttgttggaactccagagggttggatggggtttgttcatggaggattaccactgagacatggggacagaggggagccctggtgacagaggacaccagatactcgttggcatcagcatttaagggaaatgtagtttatttctgccctgttttctgatactttaatatgacagcccactgccgttattacaaatgtgtagtatttaacgctgtattgcaatttggaaagactcctagataaatctgaacaagcgattatgtcactttggaatccgatttcctagtaaattgatttttttcctgcaataagaaagctagtatatttcatttctacagaaagtatgacatctttttattgattctttgattcagtcattgataacatcattcactcaacaaatgattattgaaaaactgttatgtttcatgcactctgctgtgtagaatatactcaaatgtaaaaaaactcagggaagttacagtttactggggatatagacaaataattctaattgtataatggcagttagaattatgggatgtcaatgctgggtaatacagagtgttacggaagcatggaagaggggaacctaacatgggtggtcatacaatgcttcagaaagggggtagtatccaatctgagaccaccagaactgtaagcatttatggtgggaggatggggaaaggaagaatgttctagataaatatattggcaggttattgctgttgtaacaagttaccacacactttgtagcttatattaagaaaaaacttcttatcttactgttctagagactagaaacccccaaatgcatctcactgggctaaactcaggaggttggcagggctgcattgcttctggaggctctcagggagagtcagtttccttactttttccagcttacaaaggctgcttgctgtccttgggttgtgcttctttatcttcaaagccaggagctggacatctttaaatccctaaccctagcctcttgccttgttcttccacttgtaaggactcttgtgattatgtggagcccacctggataatctccccatctccaggtcagctgctgagcaactttaattccctctttccatgtaatttaacatcctcatgcattctggggattaagacacggacatcattggggctgctattattctgcatactacagcagacaaaagaacaaagtatgtatgtagagctgaaataaatttagcatggctgaaggttagcccatggggaaggagatgagaagagaaggggctgaagaaggaagccaggtaaaaatgtgattgaatttcattctaaggaaaatgaggggctgttaaagaatgatattaatgtaattagatttgagttattgaaaacttcctctacctgcatttggaggctcttcacggacaacacatgcctacttcactgactataaattgaagctaattaacttagaattatcggagcttaacccgaaatctgagatagtaaagaaaaaaaagaatgtctgtatgtgtaggcagaagatcaaaaaagcaattctgaaaagaatttgattacaggctgttcaagatattgatcaatatttggatgaagactctttcatctggtgaatacccaggtgagcctaaacttacacaagaggatttactggtttatgtaagtgaaaattccaaaggtactcccttaggtatagcagagtccagaggctcaaatgatgccattgctgctctcctctgcattgacttcatcatcggttggggtggactcttcccttgtggagctaagatgtcagcaacagctgtgggctgttaccctcctggatcacacaccccaacactgaggggggtgggctggcagtagttcaagtagaagtcctggagttgagtctcactagaccaccttgagttgtgtgttcatttctgagccagtcactgtggccagggagatgtgatcttgggcaggccggagttaatagttgactaccctgctattcaggcaactccgaaagcttgcttctgtaaatagcagtatgttttgagagccgggctctgagctttgtaaccaaaattcaattaaaactgtttaaatggggccactgtgtaaatttctttgtcatatgttattagtatggatctaaaaacctatcatattattgctgttctctgattgttctctacagatgggcctggatttgaaatcttaagatgtacatgtctatgttctgtcaaattttcatttaaaatcagcacaaaggcttttggtaattgacatcatttgcctgacttcgaaagtggaaatatttaattaaactttatataataatgaaagaaaatcatgcttttattttagatcactttcttcccttgagcaactgactgtctctttcagtctttgtcagcagatttaatctcacttccagtaaatgcttttccatcacattatcttcattaaaatacagatgttcattagaatcatcccatgttctttagacattgagtacgtaatgacattctgctcccagcatttctgtcatttgtgccttaatgtttgtaaatggggcatctcttttcttttaagggtacaatttcagattgagccaatggaaaatatattcgagtgtggttatttccctgattggctttatttatgttaaaagtgacagaagcacttgaagtcactcttcgtctttatcctcttcttctcagaggtgctgctgtttactactcagccttcaccaacacatctctgcagatgacttgaagcacatctccaaacctgacacatttttctacttccatttccagctttgtttttcacataacagttttgtgaacttaacatctcttaaaccgccctcattatctctgatgtctctgctgtgctgacatcccacgttcacactctcaccacagctcatcatttcttctctagcagtttctacccatttctttccagaatgattgctaccaactatttagtgccttataagatttctgaacctcttcaataacctgctgtgcttctgtttatgagctctttcacttccatcttggtacaactgagataaaaaaactttctaaaacactattaaagcttgaagcgttttgagagttgagctttatattcccactccttcttttgacagtaggttgagaagcaatttttctcaagtattaacccttggtgattgtattatttactcaatacttacttgttctgtgtgcagctgtcttatcttttagtctggactgtaacttcttggagggcagaagacatggtttatactttcctgtacgaagtgtatacagaactgagtactaatctttataaaaggtaaatgcttagtaaatttactatgaagatgataaaagggagttttgaggttgaggaggctgtctttttttcagaatggcagaatcagttaaaatggatagcacccttcaatcctaaatcaaagactagaaaaacataccatatttgtaatgttaaaagtattttaagaatacgtactcaagcttaaaatcaagaaagggaattcttcaggtgtcagaaatgaagagggaggccacagcattgaatggcaaggggaataacttgagaagatctgtgtagtggggtctacagttttaagcagaggctgcaggctgccagcctagtggcataccagaagtgggctgagacttgggcagggcactcccactggacatactctgaactgaacccacagtggaaactgggccctagctttcccttttctgtttgatgagccaaattttcattgtgtggaagaaccaagctcaggaactaatgtcaaatttggtctgcaaattcagacaccccatatgacctcatcagggatgtctccacaacccaggttactcaagggacttccacgaggataaaggattctgaattattatgagctcacagacaaatattgcaagcatattagaaaatccactgggtgatagctagtcagcagacacagaaacaagattaatcaattacagataataaacactaaaggaccacaacctgcaaggaacaataagggcattaaaattaatcacagactaatttggggaaaggggagtctacaaattaaaatatagcaatgaaaaattttaaaaaatcaattgactgatttatgagcaaaaagggcatcattgtcttggaaagatggagccacaaccacattctgtattattttgtgcagtgcagtgctgggctgtggccagagactctggccgctctgtggagcgcaggcactgctggtggtaaggacattcttcatttattttccccctttctctttaaatttagatgaccttattttagttgcctttgtaatgtggaggtgaatttataatctttgtttacaaagaacagggtaatacaccagctggtaagatgatgcaaaagcctaaaattgtgctagtgatggaagggagaacctatgggaagaaggttgctttttggaagacaaaactttgttttctttttctttttcccattttccctgactgcattgtgttctgtgccagaggtttgtggccctctgcctttcccacctccctttggggtagctacaggtagtatctccttcatctgtggcacctgggcagtgctttttttgagagtcttgctttgggcagtggtgctcatcatgaaataagcaattttcattttgtatcctagatttttctcctatgctagacctgggtctgcttccaagtgttcacgctttttcacggatttcagttttcaaagttggaagtgttgaatgtgttttcttgtagtgctgatatagagtagatttgtgatgagatgtttactaccatgtctcttccaggaaagactcttcttacactgccatggaacatggtcagcaaatacagaaggcagaaacagtaaacttcctgtaagctaacttgactaaagtttattaaaatgcaggatattcagctgttctttgacactttagtggttgctttaaattaaaaacagctgatacgcataggtttttaagaagcttgttcttgccccatccacaagttcttctatttatccaacccccaccacctcccgcccatgttgtgtgtcccacaataagggatttctggatgtctaattaaagttacttaaatatcaaaaaggcagctagaaaagaaggtgtgtctgtgccactcatgtgattgcctgcatttctttttgttgttgttgtcatctaagtgatttttggaagcccccaagtgaaaaaacaagtgcaccactctgttgagaaatgaaagataaacatagcataattggctaagactaggatcatgacgtgatgtgtgcctgtgtcgtattgctgacgtttatgtggttgaagaattacatctaagtaatatttgaatatatgcgatttttgacttcataataattgacgcagtgtgggtagagtctatgtaatgttaccgttggttaaatgggtgtaggttttgccccccataatttaccctgcaggtacaaacataaccttttattttttactcctcggattcgtggctctttttttctcactccagagataaagtagcatatctttcctgctgtccaaggaagacgagtgttcctgtgtccctgcgtcttatgcatattcataacacactgaaccctggtggttgtgagcgatggatggagcttcagggattgtattataggcagtctccaaaccgtgtgtttgccaatatttctttgttcatctctatttcatcaaatctgtgaactagaaacaagattgacagcatggaattcaattttccctttccgtgttttctggcactcccttggataattagagccatgtgatgaagtggtgcagacggaggtggaggtggctgagggcacagaggagaagcagggtgggggtgctggtctaggaggcccccctccatccatgtagaggcgagttagatttggtcttaacagtggggaaaatagaacttatttactgtgagattccacccagtaatttctgggatgaaatctgtgtcttcttaatttaaatggatgaacctcactgcatgtggaaaacatagcctgcctttcttacagaaactctgcctttgtgaggattaaagcaaagagttgtcctaatttttaattcttcactggattcaagtcataggaaatgagcctgaatttggtgacatacttcagatttttttctgttgtgctcaatcttattgtttgacaaaggactgaggttgaactgttgaagttacatatgcaaaatcaaaagatctcagctaatcttgaggaaagtttttgatgggttggataggaagttaaactctaaatataagaaatgacaaatgtgttagaatagagaacattttattagcttattggtattataactgtctcctgagtttccttcaatgtgtgactctaatattctataatattcaacgtgaatttgcagtgagtataagatgttcacatctgatttgtagcacattcctcattggaagaaacataagcaatacagacttccagattttaacaacaacagtaataacagctgctgattatggagtacctgctctaagtcagacgccctgggaggttttccccatgaatttaattctcagcagtcattacccacatgtgacagttaaggaccctgagacttgaggaggctaaggattcaatctcagtccctggagctggtgggtgttcccatgaggcttctagcctggctttctctctcatcagcccccttcatcacctggtgttttccaggatgccggtaggaggcggcaggcaagagagtgaagctctctctccagggcttggccgaattgctctgcttctctgtgctctattttccatctgcaaataacagcacctagctcatgagtagggctccatgagttagttcaggaagcgagatttaaagggtcaccaggcacacaggaagccctcagcaagttcacggtcatgtaggtttccctttcctaccccttccatggtcagctgctgggaccgctcttctcccctagaccaccgcactcacaccccttcttctccagcccaggtgcactgtcatgtgttgccctttccaagacagggtgcaggggaggggataactctgcctctgtagctcctcggtcctccacgtggccactgcccctcctgtgttaccatgacctctcctcctggcctcagctcctggcctgagggcccagcgcctcctttctctgcatttcctaccgtaagctcatcctctgccccaacacccaccctgttgtgattaaatgctctggatacctgagcccctttcggtgttacagtgatgttttactagatcccttcctgtgatgtttatcttccctttgagtttaagatgataaggggagggtgatggtagactagggaggaaagaatgagaggattaaaaagggttgggaacagaagacacaagtgccttaagggataggaactataaaattctgaagaaaacctctaggtgtgttcctgtttcagggaatatctgcaatattacattctttgacaacagattgtccagagagagtgattattcctgagcttctgtgggacttggtgagtttggaataataggaggcaggtggaacctggaggtggggttgggggagaggcaatgagagagccagctggaatcagaaatacccagcttagggatctgcagtagccaaacacccctcgcacctacccgctgcctttgtcaccgcccccaccacctttctcgagctctagtccttgttcctctaggccctgggaactgccctttggcatgttgagcttgagatatgaatgaagataggacctcaaaatgcaagacaaactgaattttcccctggtagcgttttaatctggtagttggtttctgttgtgcatgtgttactgtgctaactgtgaggatacagtgtgttatgttgctcattatgaatagcctggggatgcaaattacttgaagtacatagttttccttaagaacatttattatgatttctatatagtctgcttacaaatgaatttcttgagcaaagcctgtttgtaagcagtggatgtatgcatttgtgcttgattcataaagcattagagttgcaatggaaataacctgagccttagtttcctgagagacacctacttagtagcttgtgtgtgttggggagagactggggtggggggaggagggacaaggatttaaacagagatttgaattgcactgtctgtgaagtttgcaggggggcattaaatctatggattaattcaaacaaaatgtctcatgtatgtaacctttataaactgtgttgtatttattaagcctattttatataaattcagcttcaactagagggttattctccatagcattattttttctattgaaacatacagattttaccaaaaccccttttcattacctttaattctttctgctaggtcataggcaggattttgaattatgctattaatttaacttcattttaaatgaataaaatcagcacatccacagtttggatatttttctgaacgattgaatacttgttttattttatcctttgcccagtaattttttttcaaccaatattgggccagtggccaccagtcatattgcagcataggcaagcagtgtgcctcatgaaataatcctataggaaataaaatatgcaaaaatcaataaggtttcatggaacagtttctgcaaggagcagaaaggcaagcgtggctcaataaagtggcaacagcctgtgacaacaagcctggaactggtttccatcagagacacccttttactgagcacagtgaatatttctgtgatatcctgtccccatgtagcaggagcattttgccctggttgcacagtcccagcaaggggctttgcataggctttgcacaggatgcttgggagactcaaactctctccccaccccgagatggagtcttcctctgctgcttagcatggagctcagtggtgcaatcatagctcactgcagccttgatctctggggctcaagtggtcctcccatctcagcctctcaagtatctgggaatactggcatgtaccaccaagccgagttcatttttttatttttttatttttagtagagataaagtcttgctatgttgcctaagctggtccaaactcccaagctcaagcatttctcccatctcagcctcctaacatgttgggtttacaggcgtgagctactgtgcccagctgaagacttgaagtcttgatgccaaagggagggaggatttgttgtctgctctttggtattcctgagagtgacacatggggctgggttctctgtggcactgttatataagtcaagcagatcccttggaactttatgtgggaagtgttgttgggcaattataatctatattctgaacacttgaaagggttaatataaccagtgtttgggcatttgggtggtgtttgcacatatatggcagcctcttcctgagagactggatagattaatacccagaattactttatgtaaagttttccaggatatgttattggagtgaatttgaactctggttctgaaaccttttatataatagttatgtccatcaaggctcttgtgcactgattcttaatcaagaaaaaatgaattaaatccccttaaatgaattaaacacattttcaatttgatgcgttattaccaactttatctctgtgataacaatattggatgaagtaggcattactgagtgactgacacttctcaaattcccagtttttctctgcccatcattcacttcctttaagtattacttttttccttatttcaggttttcaagtgacttctgacattttaaaaaaccggttttgatgaggccatagattctcttaggtgcattgtgcactgctgttgctcttccttttatctctctccttccataagcaggagcatattttataagctgcttttctctttctagtcgaggtacctggaggcagccccattcacatttgtgggactgatggtgaatggtattttgcagtggaaagtgagcctcttaggtcttaagctccatgggtttaagcacaggaggggcatgagctgctccaggaatctcctgcagctatttataaaaagatggactctttctcttccctaggggacagagtatgatggattgtcatggcagtgtgtgaaaataaaactctacaaagcagcacaggagagctgtgtaatcagtctggaatttaaaatatctacttgccaacttcaccagtgaatgttgaaaactgagacttggaaagtttttttttttttttctttgacagcaatacttgttcaaagtgcactggcttatgatggagaaattgggtctggatggtctagctctttgaagagtgaacattaagtgccactgcacagtgtatgaatgaggcatgaaatgatgccatcagagcagcagtggcgcagaggtgctgggtggatcttgtcagtttgaggttgaaccgaagcacagaagcacagaacagggtatgtctaaaacctgacatggcttctttgtgctattcatgtgcacctagcagtgccttagccacctagctctatgagacatcatgctgacgaattacccctgtgacttacctgtgtgcaggttatgcccactttggtgatgtttcctttctagagggtctctttctcttgttctgtaagagacaaacatatgccagtgccatgttcttccatagaaatgaaagtacgagggataaatgagtgaggggaatggcagagggaaagaaaatgtgaatgtaagggtacagtagatgtacattagtgtgttgtgatctcagtgcagtagattaacgttagtgtgttaggacctcaaggagaaatttaatagctgaatcattgctgagattgacaaagatcaagtgcttggaaccggtagccagtaagactatttctcaaagacagagtgcatcatttatttctgggctctccgtccatgctgcagttcagttattgaatatcctttaatgcaacattcttggtaaccacgtaagaaatactcaaatattgaagacagaggacctggctccagggcacttatcatccagatgtggacccccttcctattcatcctgcttggaacttcgtgggccttctggaccgagaggatatgtgccttcaactctgggtacttttcttctcttatctctttagttttgtctgttaatttctctatattcttttaagtatttcttcttaatttttttttcatattaggcatatgttaaaacttctaagttcttgcttgtcttaactttttttttcacattttttcatctttttttccccctatgggagatgagttgtcttgtgggataattctttggctctgtcttctagattactaatttattcttcagctgtatcctttctcctgtttagaccaaatgttgtttttcctcatttaaaaattgtctaaaaatttcagatcacctttaaaaaattattattaacatggtagtctatctattttcagaccccttttaaaatctcctcttcactttaatacttatttactaaagcattccttatactattggttatatttgctgcttctctttcttggtcttcattttcttcaaatatttaacactttgtggttgtgtacacatctccatgcttgacatctgatggtatacaacttgtgaggttatacttgttttcagctacttttctatagggattgtgggagatgggtgctgagaggggtgtttgcctgtgctgtggggatccccgttcttccagggtcttggcagcctcctgcaacaaacttgctggggcctgctgtgtgtacacactgtatcaggctgggtgtacctcgttaagcacataggtggtaaaataagtaccacggtaaaattatggcttagggctcagggtaaaattataaaaaaggaacagattacatcccactgtgggcaataagaaacactttctgcaggattctgagatgggcctggaagaatggatgatatttcaacagggggtaatgaggaaatgcagtttcggtgtgggcacctgaacggacaaaaggacaggtgtcatggaaaacaggttctgggaaacctgcatcacctaattcactggagagggataatagtgatgctataaatagcaaatgaagtcagttgggctcttatatgtgttgagcaccaccatccatctgaatagttgcttaagccagaaactggggagtggccccagctgcttcttccttcccttcatccagaaagttagcagttcctggattttcctcctctagaatgtccctcaaacctgtcctcttttgtcttttctcatgtctgccacacttgtcttagtcattagcgaaatatccacattttatacttctgttttgaaactgacggaattgtcccagaaaactgatgtttatggtttcttttaaataagtacagaaatttaccctcccagtcttaaatcttgagaaagttacatttatcttatctgagttcctttttcaggaaaccaatcatcagtcctcccagtcttaaatcttgagaaagttacatttatcttatctgagttcctttttcaggaaaccaaccatcagtcctcccagatagtatcaaggaactgaaactttccagatcacagcatcaggacagtgagacaccacacccctcacccaacatgattgcctagcccaccacctactgcctgttggctaactcctcttccttaccctttcctggtcttgttttcccacatgtcattacgtttctttcctgctgtgtaaatccttaattttagttggcttaggagatggatttgagactgatctcccattctcctctgccgcagtacccgaataaagcctggcaatactctttgtcctagtaattggcctcctgtgcggcagcagtgacacctatctgtaccatacctttgacgctttgggggcagttctgtgaaggtgggaaaattgattgtggaataaagtgatacatttggtttggggcatgtttctatcttattaatagtatatttttcctcatagagatgtctactacacagttagaaataaaggcctaagctgggcatcattgcccttgcctgcaatcccagctactaggtaggttgaggtggaaagatcgctcgaggccaggattttgagactgtagtgtgcaatgagcatgcctgtgaatagccactgcgctctagccgggcaataataatattaatatatagatgccctgtctttaaaaaaatatagaaaagaaaagaaatagaggcctagtatttgagggaaaggttattgataaagcagcacattttgaagagattgtagtttaaagtatgggaatagatttaatatatggacagcaaatcaataaagaaaggcaaaatgaggttctactacaaaatcagtggaactcctaaacataaggaaacggctgccctcatgtagtgaacacaagatccacattgtttgaaggacatcagcgtatgttctgtcctctccctttgaagagagtctaatttaacaggtgtgataagacatcagtaatggtgactaatgtatcactgagtgtcaagtgagtgatatgtgccttaggtcccagtttatattctggaaggtctaatagctttaccaaagccaaagaattctgtgataaaataagcttggcagttcctttactccaggacttggtaaagttaacacatctgattatatacaatattttccccaccaagtactggaaacttgtgttctgctggttaaggactatttctctgttgtggtaatccctagaagctagagtctcagagttcatatggcatagacagttggcatagagatcttccaattagtttcttccaacttttctcttgcatataacctagaagaatttttaaacaataatgtaaataatatacttccctcatatacttgtaaattgacatgcaaagcttttaagaattgtaagttgcaaaataggaataaaggatgtcatttctaataaattacaaatcttggcacttaaaaattaagtggtataattattcttctaaagatgtcatctagaatctacattcgttagtattgtgaggtcaatttttttaatattaaatcatgaacaagttcttctttaacatttagaaattttacgtcattcctttttcttggagtcatttcattctacatcctccattgaatttacttctaatatcatgtgtttgcttccttaacacttttatagctcaccctttcatgtttctctacatctaaaataaacatataaattaaaggaatactttacaaaagtctcattaccataaagttctgttgtaaaagcaaattcttctggattgagtcatcattacaatgatcagtaacacacagttgatctgaacaacatagatatactcagggcggataaataatagttaagcataataactgaaatttcatttgaaatgcatctctttgagaagaaaacgtcttttattttttctagttagttaattaatttttttttttttttttgagatggggtctcactctggcgcccaggctggagggcaggggcgtgatctcggctcactgcaacctctgcctcgtgggttcaagtgattctcttgcctcagcctcccgagtagctgggattacagacatgtgccactatgcctggctaatttttgtatttttactagaaacagggttttgccatgttggccaggctggtcttgaactcctgacctcaggtgatctgcccgcctcggcatcccaaagtgttgggattaaagacatgagctgctgcccccagcctttttctagttagtttatttacctatgagtgataatgatatattgctataacgggtatcagtagatcatattgataatccagtgtaaacctgacattaaggaaagatacagtggtacctcataaaatatttatgtattatgtgtaataagttgatagaaatgtaatattagataccatttggggttattattgtactactcctgctcttttctagtaattaacagttggccactacaaacttgcacttggataaaatataaaatgtgttttttataattacaaaagggttcctagctttatgaaagattttaaatgattcaatatgtgaagtgatttctatgctctttttctatcatattattccatgaaataaggcattcttgtacagggatgaactttggctgttctgttttgctgtaacagtatgatggatagcattatctctggtaggataattggggtcagattgtaaaactggagttgcgtttgcaccatgtgattctcagaagtcttgggatgtgcagatccaaggcagcctgtcgtgttcctgtgtgctgtcttagtctgactgctggtctccgcttggagtaagactcccggaagctggaagggaatgaggctacagacctctctatttgagctttgaaagaagaaaaaatgtttccgtccagaaaagaaagctccgcaaggcagatggtacacagggaaggtggtgtctgtccttaacctcacactccctgggtcagggcagcctagggattttgcaagttattcacttccctcctccagggcaaaattatttcccttttatcttagccaacaccctctttggaggaagctcttcattagagttgtgtgggaaaaatgtcacttaatttctagggaatatgattttatacaacagcagtctctcttctctactaatttagttttttttccgacgagtcttgtattggaaagtagcttaatagttaagaaactagtattaatttctttggttaggtctaggtattatggcctctccatgagagctttaaaatgtatctaaccattcagttcctttacttcgttcagtcattcacaaacagttttgactccatcctagggtaagattaattccttccttctttgtgcctcttcctaccaggtacagactaacatcctagctcctgcaacactcacttgctccctgcgtgcctggtgtcctcctactggactctgaggttgtattcatctatgtatctactctagaaggtgggatacacagtgaattctgagagaggataaagaaagaactgccctaagcacttggacagtatttaatcctctctttcttttagtagctatgatatcttggggcagcttttgctcccccaaaatggaagtaacaataagccctgctcacagagttgtggttgaaattaaacatcagtaaaacactctctctgcaggtgtgaaatgcttaattcatatgaagtgccactcttagtgttactggtggagcaaatgcacaaatgaatgagagaggatttattgattctgtgaggcttgtgaacacagctcctgctgtccatggaggattcatgttccagtagagctggatacatacaatgtgtcgtgagagtacagaagggtggagaggattatagacagagccctagaaacctcaggtgtgaaaagtgtaattctttttaaggttaggcttgaggaagcttcctgggagaggtaaggcctgagcagtgatttgaggaaagggtattattcttgtctagatggtcagtatggtaaagtacagatagtgggcctgagaaatgtccagtggtttcttacttctatggtgttattgatatggaagaggggcaggggagtcctgggaggagaaggtgggcccctggcttgggcttcacccccaggcctgtgcctgtggacataggtgaggacaggcactcctgcttttgtacccaaatgttgcatttcccaagaccaccctggcctgccatgcccccttcctgtgcctataaaaactatgagaccctagcaggtagatacacaagctgctggatgttgagaggaacacattggcggaagaagatagaagcggctggatgttgaggggagcacactggcagaagagcacaccgacaaaagagcacaccgacagttgtcatcaaccagtggaatgacgcagaatttggccagggcagaggagagcccaggccactaagtggctcaactctaggggaaaagcatctcccttctggctcccccatctgctgagagctacttccactcaataaaacctcgtcctcattctccaagcccacaggtgatctgattcttctagtacaccaaggcaagaaccctgggatacagaaagccctctgtccttgcagtaaggcagggctctaatggagctgactaacacaagctgcctatggacaggggcttcagctgtaaacattcatgcctagacactgctgtggagtcagaaccccacagcctgtctgtctgtatgctcccctagaggtttgagctgtggggcgctgaagaagcaagccataccaccatcgcatgtcctaagagggggacaagggatctcttcttgtttcattttgaaggggaaggggcctggagcgggaagcagacccctccatgaaggacttttccccaagaggcagccaggagccattgaagtgatacataaagtggatggtctcatgttaatttgtgaagtcaccaacccctgtttgtgaagtgcgttgctaataaatacttttgctttatcttaagcttgggtgaaactgtgcaggatcttctgggaaagacatggaggggtctcttacaagacctcttgttgtgcctgcctgtatccagcttccaattagctatatccactcttagccagatgccatactcaatggcagtgggaagctttgtccttggagctgcctgccacaggtacatctacagaggtacgttagttccttggctgtgagctgcaaggagggcctggccggggattggtgagggcctgctctgctcagagggtcaattaaataactaggttcaagctgccctagctcattccagtcaacaggcacctccaactgaataaaaggtcattatcctagaatgtggcctctgcaagtcttcagacaataacccccaaatccattcactttacacaaacttgctttacttttattttttgtgtgattcttgaggagagaacacttagaatctgttggcaagacactgattttgactgtagaggtaattatgacagacaccctagcagctttattgctggaaactggccccttcgaggcacccccagtcagagtgtgttccctgaagagcctcgcctcttcagttcagaaatgtttccctggaaggttccaggcctcttatgttgccaggctgatgatcctctgggcacagccacctcccgtgggtgacttccccggaaagcaccacggtggcctcgcctctctttggcttctctcatggcagctgggccctttccattgattcttcacagcacagagaccaaactgccatttgcagcctgcctttgccagaggcttagctgctgtggagggaagtgcggcatggaaatagagcagcaggtcaaggtctacacatgagctcttctgctggctcccacctgcctcccccagccctggtcagctgccccccaaggactgggagagttccacaagtcagcctgccttgtggagctactgattagagaaagaggaggaaattcttctgtaacctgaattcaaatcccacctcctcattccctcctaggaatggtctcagtgttagtggtggagagaaaacccatctggtagaactcactctcagccccaggacgttgttctggctctatggcttagcaaggcaatcccataatagtctaccatggacactctccatagtctgggttcctttgagttaaacaacaccttattgggtagtatgtgaacagtctcatccaaggtgggctgtgccatgcagggacagttgcttttcagtccctctccagttagaatctagagaaatatcactgtgaaacaaggaaaagacattcttgttgccgaatgtgataatgtgttctagatgcctatgtaaagtagccctttttttactcataagacaaatacttagaattatgatggaatatggtagtttcctcttatccacaagagatacgttccaagtcccctagtggatgcctgaaaccaccgaggcaagtaccgaatcctatatatactatgtttttttcctatgcatatatacctatgatgatgtttaatttataaattgggcacagaaagagttgaacaacaacaataataaaatagaacaattataataatttgccagtatcactagtcttgtgctttggggtcattatgaagtaaaataagagttccttgaacacaaacactgcaataccccaacagttggcctcataactgagctggctactaagtgatttgtgggcagggcaggtggtatctacagcatggatctactggtcaaagggatggttcctatcctgggcaggacagagtaacatagaatgagatttcatcacactgcttagaacaatgcacagcttgaaacttaggaattgtttatttctgaaatttgccccatgatatttttggaccatatttaatcatgggtaactgacaccatggaaaacaaagcagcagatgagggaggactactatattgccacattataaatatagctgcttaagatgtaactccaaatatagttctacttccttccttcgtcaaatattattttacatttatatttattgacatcaccttgcccctgatgtgtacttttaaactatactttacctctctctgatgctcaatacttcttgtcccccatcaagtttcacaggaggtgtgtgtatatccagagctattgaagcaaactctaaactatctcatccacttcagaatgcctggcctgggctataatgtggaaatatacttacctccccttgtgatttatttgagtcaaaacaatttctagctataacatttccatttatagtgactgagaaaaaggggcaacattagtgatagaactcattcatttgcatttgacttgagagtttctgttctgattggtactttctatactatgaacttatggactgatatttacaatttcgccaatagatagagtcaccagagaatcttgcatataaaatgggcacagaatatttgtaggtttagtttcattgctcaggctctttgatgtgttctgtgggtgggagaggagtgttatctccagcttgttctgcattgtcattttttaaggcgagccaagcattctcaagttgcttttgctttcattacaacccttagaatgaattctctcaaggcctctgcggaccttgaactaaacccacctaaataaatggccaaattctactctgccttcttagtttttgtccctgtcacctgaaatgcttagcctctcatggcttccctggtgtcacacactcatgagcctattcttggccgtcctctcttgttttcacactgccttttgcacttcctttcctgccgcagctgtgtgctgtgggccaggcttgctctccggggaacatttgttgtatagtctccgtgacatcctgtgcagtgtaggatgttcagcagcattcctggcctctgcccactagatgtacacccctcttggcactcagaaatgtgtctagacattgccacctgtcctctgggagacaagagtctcccctggttgagaaccactgtcctaatgtttctcctatttgtagtatccgttctactcttgttgccctattcaggatttaatattccatagccccaggatgcttacaaagcttccccatgcagaaactctcttccctccactccctgcagagacacagaatagagcaagctgacactgtggtgtttccctgggtgaaaggttatttggagacttcacaagtacagactaagaaaacagaacgatggtattgtggggacatgggaaaggggaatgcctgcatttcacacgtttagttccacaaacagaaggatgcccatggacaggggtgcccagcaggcagatataaatttagccttggtgtgatcattaagtgtcaacttgattggattgaaggatgcaaagtattgttcctgggtgtgtctgtgagggtgctgccaaaggagattaacatttgagtcagtggactgggaaaggcagacccaccctcagtctgggtgggcaccatctaatcagctgccagcgctgcttgaataaagcaggcaaaagaagttggaaggagcagacttgctgagtcttccagtcttcatctttctcccgtgctggaagcttcctgtcctcgaacatcgaactccaagttctttggcttttgcactcttgaacttaaatcagtgatttgccaggggcccttgggtcggcttccctgcttttgaggttttgggacttggactggcttccttgctcctcagcttgcagatggcctattgtgggacttcaccttgtgatcgtgtgagtcagtacttcttaataaactccccttcatctgtacatctatcctactagttctgtccctctagagaaccctgactaatatacttggacaaaaggggccccaagccccaacctgctcactggatggatctgtctttattggccccttgcactggctgtacaagagccaaaggagtgagtgcccccttgtccttccctctctaacgtgcatatcttccatccccactcctaggccactttcactgtcatctcacagacaaatccctggtcttcatccgggcctcattgtggtctccctttctagtaccccgaaggtcagagcaccattgttcttgcctgagcattacctggactctgttatgagttagtcccactttcctgtgctgcatttgggacatcactgttcagagaaagcctctagaggaagtaggatctcccactgttctgcgggtgacatcagtcaggagagtgcgcaccagtcatggtggggacacatgaaacaactccgtggggtctcaggtgcaccaggcagcccaagagcaggtggacgtggtgatgtggttggattttcctgtgtgtgtgtgtgtgtgttttttcctcagtagcattttctttatttgtaagaagagatcttttagcattttataaaattacttttattgctcgttttttccccttgtaacttgaagggtttccttctctcttctttttctatttacttatttttcctattagtaactactagactatttctatcagcaaggtacatttttaatatagttgtattttctattttcctgtccagttactaagattaaaagctttgctttgcccttaataatggaacaaaacaccatccaaactgtggttaaaacatggttttcttctgggatgtggtaaaacgagaaagccctcatcatcccagcatgctttgcctaagctgacttacaacagaattgtgccctggatgtcagtgcatgaactctggccccagggaggctctctgggcaggcagcgctactcaacatggtgtcagctgcttgctggggctcccaggatgcatggaacctctattgtattttccagacttaagcttctcttcatggatttacaccaaatgcttaaacatgtctgtctgtttttaagatttggagatattggttttctcttagttcaactagcatcaaggcttgctgcgtttcatgtgcagggccatcagtgctactgggaccagcatttctgtccagcaattaaaggaggaaattccctaggaagaagtggccgggagccaggaggctgaactaaatagcattccaaattagttgcaattgtccgaaagaggaaattgctaaggccctggttcccaaactgtgggccaaggctccctggagtactggaacaactacaccatgttgtaagtgttcacgttttcaagggaaacacagctaggtaccatgcagaggactactatgagattgcttagacttcgctatttaataaatggaatggataggttgattttgcataggagtaccatgaaaaaaatcactgaaaggtaagagcactatgaactgagaaagtttggcaacttctgctctaacggtataatgaaggtttttgaaaagctgaggatatagccaggtgtttgtgagggatggaggataggtatataaaaggatgtgagggaggagaagacacaggtttggaaggtggataattgggccaaaatgactcttaatttacaaggaatagaggttggctgatccctgtgatgccatgggctggcagctcattatgttatccctgacatacaagccccgaggctcccatcccctagaagtaagcaccaccctaagcccctcagaccaagcgtttgcctctgtttttaccttggcatttattcattcatgaaatatattttcagtatcacctgcatgctaggagctagggagatggtagtaagcagaacagatggaaattcctgacgtcttgaagcttatgtttttctagaataatatcgaatgggacatagttggtgtttcctgtgtgcctggcattgttctagaagctttccatatattaactcatttaatcctcaccatatttattccataaggatagataggattgccatttacatgtgtctggtgttaacagtggctctcagagcaccttgttgcttgtcctcattggatggcatccccgtcaacctgatattggtcgagagctcaggtacaatagcagcgttcagaacctctctgtgtcactgagtgaggctctgttaggtggtgtgagcctgctctgtgttacctcgcagaaagctacacgctgcatattgactaagaaaacttctgtcctagcacatcttcatctccatatgtgagatttatatttcataaaacttatatatgatgaagtatttaaattcaacagaagctacattcacaaaatggtaagccttgctttgggaatgtcccctattaacatgcctttctagggcttgctcttcccgtacagcaagctgagtagtactggcactgccactcaaacaagtttctgatcataatgaagaatggctgacttattagttgtgctatcctgggatgtcaagcattgttaaatttgaaaatgtgaactggacatagaaaagtggtttatttcatttatcgtgtagctcagttgtttccttgaaaagcagaaagaaattaaagatgttgaatatttcatggttataacaaatgaaactcccatgaaataaaagagttcacactgttactttattttccaataatgaaagtaccatttgttcatcatggaaaataccgaaatttatcaaacaaaataaaagtaactcccatcatattatccaaagaaaacaactttttgttgtgtttccttttaccctttttctgggcatagataagcttccatttttttaaattaaaaacttactgtgggctagatgcagcggctcatgcctgtaatcccagcactttgggaggcccagacaggcagattggttgaggccaggagttagaggctagcctggacaacatggttatatcccgtctctacagaaattaaaaaaataaataaataagccagctgtggtgatattcacctataatcccaggtacttgggaggctgaggtgggaggattgcttgggtccaggaggtcgaggctgcagtgagctgtgatcatgccattgtaccccagcctgggtgacagcaaggccctgtcaaaaacaaaaacaaaaacaaaacatcttattgtgtatggactgtgttcagggcactaaggtttgctttggagcaaagtaaaataaacatatgttccctgttaatacaggtataaagaaaggcaaattactgtgtccctcatcttaaaaacaaacacagtactttccttcaatcatacatcactctcgactctcctgtctgccccttatttttcttctcatagctgtcgaatcgatttcattaaagatagctgaagccttgtagcccttctggattttctattaaaattcacctaatggtagaggtaaaataaaatgtgcatcttcaccccttcactgtagcactccccacagctgtactctggtttacaagactctcccattctcttgagagcaaattacttgaggttaaggacttagggcttatctgtctttttacctttggaaaatagtgaatgtttaataatgtttgcatctttctgtgagagccttcgctccagcacatcaatgatcttgggcaccaagcaccaagagtcacctagatttgtacatcagaagccaaaatggaatcaaaccatacactgaatgttcagggaatctgtcttatctttatcaaggctactcgtcatggttgaactggtagtgttctgatttcccatgtgagcacgtgtgcccatgtcaatacatttatatatccatagtggacatgtggtccatgattgtcaggaggcatggttttctcacaactgtgggcgtgattaattacttgctagaaagtccacccacatattccacttgtattgttacagggctatttaccagacacttcaggggctttagagaggcactggataatgcccatgaccacaggcggttcatcatctggagcagtgtgagagtggctgacatgatgatctgaatcagcaatggctgataatccgaatcatttgggaagtttaaaaaaaattgtgcttgtataggtgtataaatatgtgcaagtgtgtttaatgtttatatgtggtcctatctcataattagtaaagtcaaatgaggcaggattgtagaattacaaagctttcaggatggttcagatgagtaactagttttgggaactaatgagttagaattcttttttttttctttttttatttttattttttaattttattattattatactttaagttttagggtacatgtgcacaatgtgcaggtttgttacatatgtatacatgtgccatgttggtgtgctgcacccattaactcgtcatttaacattaggtatgtctcctaatgctatccctccccgcttccccccaccccacaacagtccccagagtgtgatgttccccagaattcttaatgccaaaaaacgtttgtcagagggcaaactgaaacctggcagtgacaagagggccacgtctcatgctccctcatggatgccacgttgccgtatgtcctgccactgctgaacccatacagggaggcgcttcatttatgagtgaggtgaaactgcgttgagagtggcggaagtgtgctgtgcagtacatctgtgtgaaaggattccgtgtttttctaggctgagatgaaaagtaggaaagaactacagtgaaagagattagtcaaatgcagaagcagtgtactagaagctgtctaaggaaagctggttttagaactagccctactggtcctacagctgatatagtacctgtgctgcatatatttagtgttcttgtaaaggtaaatgagggaataagtatgagcaaaaaaattttaaagataaaaacgtttacacaaatgaatgatggcattatataagtattgcaataaagaactccttttcttctctctctcttttttgttttttggtctggcctctagttagagttccaatagtttacattcagtgctgttaattcccacaatttcaaagatctgcatttcctgtaaatacctaattgtattttgaaattgaaatgatttttggataatctgccatttggactatctgcatcatttttatcttaaatgatggaaacctgaatatagatgatgataacagtgatataattgtgacatatttatatggttcaaagcacttctgttgagaggaataaacaaaacaacatacataaatgttagagacatttttgtgcacaatattttcaggaaacttgtatctatgtacataataattacatatttgctttccttagaattcaagatgacactcttcacattcaagataataatagatgcacatttgatatccaggaaaatactgttacattctatcctagctaatcaacgtatttgtatttcagagatgggtggccaaaactagattactaacttaaagtgacatttttacatgttgggtttgtagacaggtgagatatcctttcaaaaattatatatgtaaacaaacaaaacataagtttgtgttatattattgaaatattaaaagcatggctgtgagattgctcttaaagatatctcaagtcaaggggacctataaatctcacaatattataaaggatctgcaagaccatttgcaaggcttcttagtatatgtgaggcttatgaaatggaattctttcatttggccatataaaaactttcatgtggtacttccaaaacatttctattttagcagaaatgagattgctctttcttagaaaaggatttcctaaccagagtcctcctgtgttgggaattggaatctccctccctctctccctccctcctttgtttacttatgtatctatttactttccccccttttttgtgtgtgtcagacatttcaatgtttgagtattgattatcctcatttttttaatgttcaagtggtaattacattatttaacaaatattgtcctatagtttttggaaaggatgttctaattaacttagagccaaatggcatacctcctttctcacaactcttatgagttaaaatctcgttaacctaattcaatatacttcattgttttggtaaatttaatataacagaatgtagtaatgtagtatatttattctccatatccattccctttctttcacttcccaaacccacatttcctgtgggcccttcccctcttactgggcatgtgtttcaagtggagccccatctctggctggaggagtgggacactcctcagggctggccaatcagagcctcagtttcccccagccatgtgactggttcagaggtaagaatgtgacttagataccgcaagtccatgtaattccatctccctgtgtacacatttacagacatgcaccacttaacaagggggatatgttctgagaaatgcattgttagtcaattcctttgtgcaaacaccacaaaatgtacttgcacaaacctaaatggtatagcctactacacacctaggccatttggtatagcctattgctccaaccaccatcatatatatggtctgtcacatgcagtctgctgttgacaggaaagtcgttaggcagtacatgacttacctatgtagagattgagttcatccaatcagagtgaataatgagacatatgtcatagttgctaggaggagatatgttctatttcccaagggccttgaaataggtcgcataaagcccactgaagctgccaatcatcctgtctaaagagacagcagccagtggagggcaaagctgaaggatagagaggtaagtctgtgtccttcctccaacacacacccgaaagcatttttacctctgcacttgttatttacctggtccaatatatttcccttttggattaacgtagtttgatttttctgtagtcactgaacagaagagactctgcattttggttgtttttggtgtaggatatggagtttgtcttgaattgcttatctcactacttaaaaatgttgagggcagtgagaagatttgtaaaagaaggggttaaatatattttgtgatgttccagaattgtgttcaggcagagttatggtataggatggagatgatttaaggtttttgaaagttttgggcaatcacagtctttactgcacttattttttgaggaaaatatacactatttttattttcaataagggctagattgcagttcttaactaggagcaatggtcttaaatattgccaaagattatttatattttactttgaaataaatctcttggggagcaactctgcctttcttatcatgtcagtcttacatcaataaaaaatatatttattttctgaacattacagataggctcactgactggtagggaaagccttcctgagttatttttttaatgcagacatagaacatttatcaccttttattctagcaaatcttctgaagaaaatcatttttgttgttcataaccattttattttttccaaatctcttttaattttttaaaaattgttatggtacatagtaggtatgtatatttaaggagtgcatgaggtgttttgacagagatgaagtgcataacaaccacatcatgaaaaggggtatatatcccctcaagcatttgtcctttgtattacaaaccaattatactcttttagttatctttaaatgtacaattaagttactattgactgtagtcacactattgtgctatcaaatactaggtcttattcactctgtttttttggtatccattaaccatctccaccttcatctccacttccctcctaaccccgcattacccttcccagcctctagtaactatcattctaccctctgtctccatgagttcaattgttttgatttttagattccacaaataagtgagaacatgtaaggtttttctttctgtgcctgacttatttcacttagcataatgtcctccagttccatccatgttgttgcaggtgacaggatctcattctttttatggctgaatagtactccattgtgtataagtaccacgttttccttatccatccttctgttgatggacacttatgttgcttccaaattttggctgttgtcaggagtgctgcaacaaacatgggagtgcagctatctcttccatatgctgatttctttgcttttggatatatatgtgcagtgggattgctggatcctatggtagctgtaattttagtttttcgaggaaccttcaaactgttctccgaagtgctagtactaatttacatttccaccaactgtatatgaaggttcccttttctccatatccttgccagcatttgttattgcctgtcttttggatataagccgttttaactggggcgagatgatatctcattgtagttttgatttgcatatctctgatgaccagtgatattgaacaccttttcatatgcctgtttgccacttgtatgtcttcttttgagacgtgtctattaaaatattttgccattttacttattagatatttttcctatagagttgtttgcacttcttatatattctggttattagccccttgtgagatgggtagtttgcaaatatttccgattctgcaggttgtctcttcatatggttgattatttcctttgctgtgcagaagctttttaacttgatgtagtcccatttgtccattttggcttttggttgctggtacttgtgaggtattactccagaaatatttgcccagaccaatgtcctggcgagctcttctgatgttttattgtagtagttctattgtttgcagtcttagattgaagtctttaatccattttgatttgatttttgtatatggtgagagttaggggtctagttacattcttctacatatgaatatccacttttcccaacaccatttattgaagagattgtcttttacccattatatgttcttggcacctttgtcaaaaatgagtatactgtaggtctgtggatttgtttctgggttctctattctgttccattcatctctgtgtctttttttatgccagtaccatgttcttttggttactatagctctgtagtataatttgaagtcaggtaatgtgcttcctccagttttgttctttttgcttaggatagctttgactattctgggtcttttggggttccatatacattttaggatttttttttgttgctgtgaacaatgtcattggtgttttgataaggtttgcattgaatctgtagattacttgggtagtgtggacattttaacaatattgattcttctaatccatgaacatggaatattttttaattttttggtgtcctcttcaatttcttcaacagggttttatagttttcattgtagagatctttcactttttggttaggttaattcctaggtatttaatttcatttttggctattgtaaatggggttacttttttatttcttttacagattattcactcttggtgtataggaatgcatattgatttttggccaggtgcagtggcccatgcctgtaatcccagcactttgtgaggccaacgtgggcagatcacctgaggtcaggagtttgagaccagcatggccaatatggtgaaactctgtctctactaaaaatacaaaaattagccgggcatggtggcaggtgcctataatcccagctactcgggaggctgaggtaggagaatcacttgaacccaggaggtggaggttacagtgagccgagatctcaccatggcactccagcctggtccacaagagcgagactctgtctcagaaagaaaaacaacaacaacaacaacaacaacaacaacaacaacaacaaaagcaatgcatattgatttttgtaggttgattttgtgtcctgcaactttactgaatttatgagttctaataggttttggatagcatctttaggtttttctaaatatatctatcatctgcagaaggataatttgacttcttcctttccaatttggatgtgcttaatttcagttctcttgcctgattgttctagctaggacttccagtactatcatcaataacagtggggaaagagggagttcttgtcatgttctagatctttaatatgatactagctgtgggtctgttatatattgcttttactatgttaaggtatgttccttctgtactcagatttttctatgatttttatcatgaagggctgttaattttaccaaatactttttagcatcaattgaaatgatcgtatggtttttgtctttcattttgttgatatgatgtatcacatcgattttcatatgctgaaccatccttgcatcccatggataaagcccacttggtcatgatgaatgatctttttaatgtattgttgaattcagtttgctagtattttgttgaggattgttgcttcaatattcatcagaaatattggcctgtattttatatatacatatgtatatataaatataatatatgtatatgtaaatataagtatgtatatgtaaatataagtatgtatatataaaatacaggccaatatacaagtatacacacacacacacacacacacacacacacacacacacttccagactcattctttcaggtcagtatgaccctgttaccaaaaccagttcaaagatgtctggttttgatatcacagtcatactgacctgaaagaatgagtttggaagtactccatcctcctctgtttttcagagtagtttgagtaggattggtattagttcatatttaaatgttcgttagaattcagcagtgaagccatcatcaggtcctggcattttctttactataaggctttttattacaacttcaatcccattactcgttattggtctgttcaagttttgaatttcttcgtggttcaatcttggtagcttttatgtgtttagggatttgttcgtttcttctagattttccaatttattggcatatagttgctcataatagccactaatggttttttgaatttctgtagtatcagttgtaatgtctcctttttcatgtttgatgttatttatttggatcttttttttttttttttttttttagtctggctaaatgtttgtctgtttaacttttcaaaaaaacaactttttggttcagtgatctttgatattctttatttcagtgtcatttatttcttctctgatttttgttatttattctactaaacttgggtttggtttgttcttgcttttaaattattcgtttgacatttttctttttttttttttttgttgtaggcacttatagctctaaactttcctcttaatagtgcttttgctgtatcccataggttttaaatgttgtgttttcattgtcatttgtttcaataaattttttaatttccttcttaatttcttcattgacccactggtcattcagaaacattttgtttaatttccatgtatttgtatagcttccaaaattcctcttgttattgatttcttttttatcccattgtggtcagggaagatgcttggtattatttatatttgtttgaatgttttaggacttttgtgacctaacatatggtctctccttgagaatgatccatgtgctgaggaaaagaatgtgtattctgcagcctttggatgaaatgttctgtaaatatctaccaggttcatttggtctatggtgcagaataagttcaatgtttctttgttgattttctgtcaacaaatactgaaagtgggatgttgatatctccagctattcttgtattggggtctctatctctctttagcgctaataatattttctttatatatctgggtacttcaatgttgggcccatatatatttacaatcattatagcctcttgctaaattgacccgtttatcattatatagtgaccttctttgtctcttaaagttttttttgttttgttttgttttgttttgttttgttttttatcttgaaagctattgtgtctccatagagctcctcctgctctctttcagtttctatgtgcctggaatatctttttccatccctttatttttagtttacctgtgtctttatgcctgaagtatgtttcttgtaggcaacagattattgagtcttgttatttaaattaatgtcgtcactctttgtcttttgattggagagtttagtcctttacattcaatgttattgataagtaaggacttactcctgccattttgttatttgttttctggttgttttgtgatcttctcttatttcttttcttcctgtctttcttttagtgaagttgattttctgtggtgataccatttagtgtctggcttttttgtgtgtgtgtaaacattgtatgttttttgatttaaagttgccatcagggttgcaaatactattgtataactcattattttaagctgataacaacactgcataaacaaacaaaccagcaaaaagaaaacgaataatgctctgtgcctctttaatattttgtagtttctgtttatatcttcttgcactatgtcttgaaaagttgttatagtttttttattggttcattgttaattctttctaattaacataagttcattgtttattctttctactaaatataagagtagtttacacaccacagttatagtgttatattctgtgattttctgtgtacttactattacaagtgagcttcagatgatatattgctcattaacatccttttctttctaatcgaggtactccctttaacatttcttgtaggacaggtctgctgttgatgaaatccctcaatttttgtttgtctatgatagtctttattccccttcatgtttgaagaatatttttttccagacatattcttctaggataaaagttttttttccttcagcacttcaaatatgtcatgctacttgctgctggcctgtggggtttccactgaaaagtttgctgccagatgtattggaactccattgtatgttgtttgtttcttttttcttgctgcttttaggatcctttatcctcgacctttgggagtttgattattaaatgccttgaggtagtctttgggttaaatctgctttttgttctatagccttcttgttcttggatagtgatatctttctctaagtttgagaagttctctgttattttccctttgaataaactttctaccccggtctctttctctacctcttctttaaaggccagcaactcctttttaagtccaataactcttagatttgcctttttgaggctattttctagttcctataggtgtgcttcattttttaaaattcctttttcttttgtttcctctgactgtgtattttcaaatagctggtcttcaaactcattggttgtttcttctgcctgacctattctactatcaaatgactcatacattcttcagtatgctaattgagtttttcagctctagaaatactgattgatactttttaattatttcagtctttttgttaaatttgtctgatagaattctgaattccttctctgtgttatctttaatttctttgagtttcttcaaactcaaaacacattttttttttgagtcagagtctcactctgttgcccatgctggagtgcagtggtgtgatctcagctcactgcagcctccacctccgaggttcaagtgattctcttgcctcagcctcctgagtacctgggactacaggcgcatgccaccacacctggctaatttttgtatttttagtagagacagggtttcaccatttaggtgaactcctgacctcaggtgatccaccctcctcagcctcccaaagtgctaggattacaggcatgagccactgcacctggccaacacagctatttttaattctctgaaaggtcacatatttcagaattggtccctggtgacttatttagttcatttggtgaggtcatattttcctggatggtcttgatacttgtagacgctcatctgtatccgggcatggaagagttaggtttttactgtagtcttctcagtctgggcttgtttgtacactggcaaggttttccagatattctaaaggacttgggtgttatggtctaagctgtatctgcattagggggcacgctgatcccagtaactctgtggttcctgaagagaagactcatggagtgtattagtctcttctcaggctgctgtgaagaactgcccgagactgggtaatttataaagaggtttcattgactcacaggtacacatggctggggaggcctcaggaaacttacagttatggtggaaggggaagcaaacacatccttcttcacatggcagcaggagagagaagtgctgagcaaagggggaaaagtcctttatgaaaccatcagattttgggagaactcactcactatcatgagaaaagcaggatggggtaactgtcctgttttaattacctccccccaggaccctcccacgacatgtggggattatgggaactacgattcaagatgagatttgggtgaggacacagccaaatgatatcatagaggtaccactttagtggtcttggacaagatctggaagaattctctggattaccaggtagagagactcttgttctcttcccttaatttatctcccaaaaaacagagtctctgtctttgttctaagccacctggagctgagggtggagacacaagcacccctgtgcccactatctctagaattgctctgggtcaaacctgaagcctgtacagcactgggtctttcccagggcctgttgtaagaactccctggctatcacctaatttcactcaaggccttggggctctacagtcagcagatggcaaagccagtcaggcctgcctccttccctgcagggtggagagctcccctaggcccaggtagggccaaaggtgctgtcccaggtgcatggaatttgagtcaaaaaccttagaagtttacctggtgttctgttgtcctgtggctgagctggcactcaaaccacaagttgtggtcattcccactcttccctcccctttccaaaggcagaggtgcctcattccatcgccacagccaccatgggcccacagggagtactgccagactaccaccagagctcccttctggcccaaagggctcctaagtcagcctgtggtgaatgctgccttgactcttggatagcatttctggactcacccttcatagcagtatgctcccctctggcacaggacatgtccagaaatgccatccaagagtcaagtcctggaaccagggacccccaaatgcccacttggtgctctaccccactgtgcccgaggtggtacctagggtgcaagacaaagccctcttcattttttccctctgcttttctcaggtggaaggagtcttgcctcgtatagccaccacagctgggaatgtgctgagtctcaccagaagccagcaagtctcagaggctcaccaaggcccttgacatagcacctcagcatccctgctggctattcagaacccttggactctcagtcagcaggtgatgaattctgccaggactaggtccttcacttcaaggcagtaggttcccttctggcccagggtgtgtctagcaatgtcatctgggagctagaagctggaaagggggcctcatgattctgagcattgccctatcctgctgtggctgagctagtattatagatgtaagataaagtcctccccagacttcccccacctctgcccaagcagagagatggggtctctgttggagccacaagctgtggagcttgggcttagggtaggaatgatgccaatacttctttagctgcccttggggatgtctcagtgggttacatgccaccaagtccactggctctgggcccagttcagcactaggcctcacctacgagttccagtccttgtggcctagactgcctttcaagtttgggttccagagtactttaacttgcttgagaggcatgtgggagttcaagttcggactgttgggactggtgattcccctcttcctagggctggtttaaatgctcccttcatgggtgggcatcagttgagtttgctctggttttgttttctgctgtaacaaggcagcactgagtttagtgcctcatggctgctgtgctcccctctccccagcacacagaaatactctctgcaccatgttgctgatatgtgtgtatggggtggggtggggggtggggtggaggtggggggggagggcagggtgatgggggaggggtggtgtccttggcaattcaagactgtttttcccacctcttcagtgcctctttcagagataagttaaaaccagttactgtgtgtgctcacctgatttttggttcgtaagaaggtgcttttttagtgtagataggtgttaattggtgtccttgcaggaaagaccatccttctctgccccctgtctgagttttaaattttattctagatattttttcaagaaaaaaggtatatgtgtgattagttgagaactaaattacttattggaggacacatatagacataaggtgattaggcaaattcttcctctgaaggtatcgtattttgaagcacttgtttgctatcatacctgggtgctatgagaatcacttgatagatctgcctccaaaaactgacagtgtaactttcctgatctggatttcttagcattctggcagggtctgtgctataaaagccattggcagtgtgtctgttattttcaggcaagattcaacttcctgttcagactccagaacttgctgtagcaggaaattgacaaatgatcagaaatgtgccgtcagtgactagcctctgtgatgttgtgttttgttcaaaggatgaattggctttatgtagaataaaagccattggaaacatatggtacaacagttggctgtagaatttgttttgttataacttcagaagctgctactattttgctttgacatgcccttgaaaatccaagatgctttggtcaatgtgtttgttatattaaaactaacataaattttagtggaagtttggtagtgtaagacaggcttcacttattttttgtgtgtgttccaaattgacctgagatgaaaggacaagatgtaatttgtaaagtactacaatagaagtaactggagaagctatgtgcaaaaatcaggctcattattttatagtcacatagcatcattttaagttccttgaactgaaaagcagatctcatacaaggaatttctagccatgttgagcccatggtgaattgtaagtgatcataatatagccaaaaatgtgtaattcagaaaagatacaggggctgttctggagctttgcttttgcatattgcttccttataggaatagaatagttgtatttctaacttcaggtcagacaggtttggacatttttggctcaaatcatttcttttttttttttttttttttttttttttgagacggagtctcgctctgtcacccaggctagagtgcagtggcctgatctcagcttactgcaagctccgcctcctgggttcacgccattctcctgcctcagcctgctgagtagctgggactacaggcacctgccaccacgccaggctagtttttttgtatatttttagtagagacgggttttcaccatgtttgccaggatggtcttgatctcctgacttcgtgatccacccgcctcagcctcccaaagtgctgggattacaggcgtgagccaccacgcctggcccaaatcatttcttaatgtgaaaaatgattagcacttgattattcagagagtatgtacaggttatctggcaccacggttgcttaaatactctgacattagcataatcgtgaaactagtcagttaactagaaaatgaaatgccttacactactgaagctatgagtggccccttgtaggtgatttgagcattctgtacaatgccattacgatctgtaggttcagaaattttataggatgaaacttggcttggaagtggggtgtgtaaaagtgctagaacaaaacaacctacttatattttgaaatttttattcttcatagatataaatatgacaatttatgttattatttttttttctttgctgctctctttagcttttcttgttgactttggctttttcagaggcttacttagtatgaaggagtgtgactgtaggtccagttccttgagcaggtgagggcacctggagctgaagaagttgatgacttagatccatgttcccagaaacaccaagcatgtctgcttcctttttcttttagacccactttcacataaagataggaaaaatatgaggctaaatgaacctctggtttataaggttagtttgtaagtaataatgaagggacacgagggtgatatgaacaattatgtgagaacaataggtataagccagggctgttctgggcaaaatggttgtcaccccgataataactaacatgctttgatcattttttcattgcctggcattatgctaagcatctatgggcgttaactcaagccacccaactaaccaatgaagtgtaggtactattttcttatccttatgatggttaatttgtgtccacttggccaggtagtggtgcctagttgtttggtcaaacagaagtccagacgttgccgtgaagatatttttagatgagattaaccatttaaatcagtgggcttgagttgagattaacatttagataagtagactttgagtaaagcaaattacccaccataatatgggtgagcctcattcaatcaattgaaagcttttagaaaagagacagagttttcctaaggaagaaggaattttcaagattgtaacatagaaaccctgcctgagtttccagcctgcttaatttggacttgccagccccaccacttacatgagacagtttcttaaaatctcaatcaatctctctctctggctttctgtacatatgtttatgtgtgtgtgtgtgtatatatatatgtatatatatatatagagagagagagagagaaacatatatatatatatgtttctcgtgtgtatatatatatatgtttctcatatgtgtgtgtgtgtgtgtgtgtatatatatatatatatagagagagagagagagagagagagagagagagattatatgagccaggttcctctggagattcatgtagtgcctttatgtttctcatatatctactattgattctgttcctctggagaaacctggcttatacaatctccattttacagataaaagcacagagaggtcagttaactcagctaaagtcacacagcttataactggcaaacatgagatttgcaactagatttttggactccagggctcacatgttttactgttaagctttattgcctcttaaaaacagaaacaaaacaacatcaagagaaagcttttatgatttttcattcaactggccctgtctctcctgagagtctccattgttaagcagctggctgttttctttaacttaggaccctgaagcaaagttttgtgattattttgtatcactattacaggggaccacaggcatttctggtcaagattctgcattctttaattgcccttatagatagtttattcagggcatgtgaaggaatatttctgtgcagttttagaatttctgataggtgttttaggggaagacctactcccagactactaatatattatcattgtcatcatgagttagtgctaattcagatgtgatactctaggctagcatttcccaaacctgcttgaatgggctgttgcatgaacaacattgcaactttcattttcatgttacactggaatatggaatttttgtataacattagtattttgaggcactatataacatatgtatttgtcatctattgctgcatggctcaaaacaacaatcattgttatgcctctcagtttctgttgtctgacattcagataggacacaatgggaatggattatctctgttccatcatgtgtggggcttcagctagaggtctcaagtaccagggcctggaatcatctgaaggcttgttcactcacaagtctagaaattaatgttgactgtcaggtgtggaccacctggggctgctgctgggataacatacatatggcctcttcatgtggtctgggattcctcacaacatgatgacttgattccaatggcaagcaccctgagggggcaggtggtcactgctgcactgccgttcatgacccagccttggatatcatgcagcagcacttagcccaaagttgtaaagaccccaccaagttcatgtgaagggaatgtagaccccaccactcagtagaggagtgtctgtaactttttaagaagagcatgtgtaacaggatataagtgtggccatgattgcgaaatacaatgtcagtatcctcttaccataagaattcacatcatatgcttcctacatgtaaaatacactcacttcttccccttaagatctataaatcttatcctcattgggatgtcagatcaaagtctaggatctcagcccttaaatcaggttcaaatatggaagagatattttcattgtggatttgcacagcttctcaaatatagatcttagtctgaagacctgtgaactaaagagacaagttatctccctcccaccccctcaacatgcaatggtaggacgggcagaggagaactttcatgtagagcctcctgttcaggaagggtggaaacagaaggcatgcacgagtcactggttcatagaaactctgaaaaaccacctggaatgtgatgtaattacttgacaaggtctcagtcctactgcctaggaatgattctccataattcttgacttctgtctgagtcactcctcctcttccctaagaagtggccagtttcattgggtagctttccaagtctgatttctgcctgtagtacttttattttagcctcttggtagtccaaaggtctattttcattgtaagtgtctctgtccattttggtctgaactggcagtgtttctaatggcagtgtcagactaattctcttaaaaatcctatggatctcctgtgaatcttactgaggttcattttgttagacaaaattcacattcatcaatctctttgatgaatgagattctttgatgaatgagaatcccttgagattctgctgagggattaccctgttaaggtttttatagacagtactgttaatagacaggatctataaggtatgtccgtaagattcttagccttttatctgaatgaacagttctctgaggcactgacttaacacgtttctgagattttattaagggcttttatagtgtaccctcagcttttaagagttgttttctgggaggaattcatgatctatcataggtaagtattaaactagaaaaagtatgcattccaaaattactttttttctgaacaagaatgagaatatggctttaattgtgttcaaaattgttgcatttcatgagcttgcatttgctaagatggattaatttatgatatctttgagaagttcatgaaaacctgacaaatgtccacgtcaacttatgctttatataagttagcttgtgtgttcagtcactttttttgtgaagcagtgtaaccatactagtaataatttatgtgaaaagcatctcactctttcatgaccgcaaagttcctgcaggattttcttatgatcaaatattttacattgtaaaaatttttcgatacactgaaacctaaatatcctataggacaaatgaaacagtctgattagaaatgtttttctgttgctgttgatttctccttttcacatttatggacaacattccctgttattctaagtttgacagtgtctttttatttttgcccttcgtatttcaatggaggaaatttagaaataagacttccttatctttctttccagagtctctgtggtggtcctccgtgtccatacataatagtgcagttttgcaggtgggattccctgggaagccaactccaaggtgcagattagcatacaggatgactcttaagggttgctcttggggtcagtgtctagtggagggaagggaaggaagcagccttacttccccctctgcccaatcctgtaatacaggctcagcaaaggcctctgctgaccctatttgaaacagctgaagcttggctgttctttcagagttgtcctgagtcagggcaaggagattgagtctttagaccccagtgttcatcagtcatttgatgcggattacctcgggcaaaaacactctcttcattcaaggcaattctagaggatgacagctgatggccagtagtgtttgctgcagctgggaccataagctttttagtcttaaagcagaggagggatgtacatcagagtgtccactcacacgcctgaaatagaatgaggtggaagaaggcaagacaaattatttgtatgtgatggtgctagatcccccattacatacagcagtggtgtttttggttgatttgtttttgtttctaaataaaggaaaatgtttatattactgtacagtgaataaaacaatgaattctgttccaaaagaatcataggtaacttcaaactcttttgactgttttcctgtatttgctataacgagtaagaactgtttttctctaggatgttagggtgttgctgtggcaactggtgtcctatgctgtacttgttattgcctcatccttcatctgggcctggtggccctctcccgtgcttctgtagccgggaattatgcacagcatggttgttatccttacaggattgttattggtttgtgttcctgggttccccaatgaattggagggctaggccatgttttattaatttcacctgatttgcctagggaagcgcacagccctggagggcactcactaaatgcttagtgaactgactcttgcctgctttcctgtcctaaggcactgttttgcctacctgcttgtcttcggagctctgctcagctattctgagtagttactgctggctactaattctgatacctaatcagaccagggtttctgatgtctcttcctcttcagtgttcttgcccaccttcttattctactgtattttatcttatctctgagacttcttggatgatctaccctttatttgatttctctccctatttcagactatcactgtattttgaaggatatagcaacttatattcaaggaagtagtttaaactaggaatctttgcaaggtcccttagaatttcatctgcagttagttatctagtagttgcctcttcactgacaaagagcagagtgtagtgttggatttagaggggtattctagtctagctgcttggttgtagtttctgaaatacaaatctggcttttttttttttttgacagagtatcactttgacacccagcctggagtgctgtggtgcagtcacagcacactgcagcctcagccacccaagctcaatcgattctcccacctcagcctcctgcgtagccgtgactacaggcatgtgccaccacacctggctaatttttgtatttttggtagagacaggttttaaccatgttgcccaggctggtctcaaactcctgggcttaagcaatccacccgcctcagcctcctaaagtattgggattacaggtgtgagcccccatgcctgtccacaaatctagcttaatcataaatggggatttattggcttgtgtagttgggagtggaggaatagagtttggtttcaggcatagctggatccagcagctcaatgacaactgggctctgtctccctttccagagctcagctcacttctcactgtgctgtggcttcattctgaggcagagtttctcctataacataagagatgacaggctcaagcttatccccctacaactaaagattaaaaaggaaggaccttcccactctctctcagcatctatattacacatcttatagagagggtcacccatccaaacccaaatgatgtattcactgttaccaagggtggagaattctcctttgccagctggtggcatctgcttgtcttgattgatgagctgacccaggcgctatgccatcagagaggccccctcaagggagtggacactaagcacacagccggtattttctgtcacagaagaggaagaatgagtactactgtgtagagagctgtttcaggggagaaatgggcaaagcaaaactagaggaaatcttcctatcaaacttaatgagtctgaattcgcacccaaatgtatttacatttcaaaatatgtggacatagacctgcccatagtcacattgcatttacctccttttatctgggttggtctcccccttcactgtcctccccaccagactgtgtatccttgctgcctatgggaggtattgcctaatagtctgctggactgaaatcataatgttaaggcttttatttgtatacttacttaaataagttgaacattttggagttgagattggccaggcagctgtaagagattttgtctttctgtagtcaaataaaacagtatgaaaattgcttgctcagccatgctggttgtcatgttgctaataaaacttatgcaagaataggccaaccccaatatttcatgaaaaaaatgtgctttgctgtcatttagtgtcttcattttcattaagttctgaattacaaggaattgcttaaaaataaattttgtggctgaggctggtggctcaagcctgtaatcccaattttgggaggctgaggcaggaggaccacttgagcccaggaatttgagaccagactgtgcaacacggtgaaaccctgtctctacttaaaaaaaaaaaaattagccaggaatgcctgtagtcccagctactcaggaagctgggacaggaggattgcttgagtccgagagtttaaggctgtagtaaactagtgtcacaccactgtactccagcctgtgtgacagaccaaaatactgccttgaaagacaaaaattttaaaaataaaataaaatttgctttgggaaatttctactttacacagtgagagtaagccactgtttctaaaatgaagttttttttaaattttcatttaaaatgttggtaatttaatgtataaagttggacattaactttggaaagttaaatagctttcactgaaaatgtggtaaattttcatataaacaaaatactagatatctctgagctttgattctgatttaggaatttgaaagttcttggttcttttcctctcccctgccacaggggaacgcatagcaaatttggcttgatctgagatggcatctgcctcgttaattttttttggtagaatatattgcacccagaatgattttggctttcccctcacctatcaaatggattttcatgcagcggccaaactgtgatgttttgctcatttcactttgggttaaattcctatgtctatgactgcaggtaaaatgtctcaagtttcattggggattcagaatgtttcaggttatcaagaaagtgtttttctcctggagaaggctggtgtgtggcttaatgacttctccacatggctccttcctataccctgtgctcattccctgccctggcaatctttagcaaagagaatgaatcctagatgggtctcttttagagttgtagagataaagtatagctggaaaattcagatgaaagtggatctctaaaaaatagatgttaactctagctccaattcttaagtggggaatgaggagtaaatgtctttttctggggatgccagtactaacagtgaggcactttttaaacatatgtctttcagtttaaatgaaatgattggaattgggctgtctgttaatatgtttctttgcagctatgatatgtatactttttggaaatactttaaaataataaggagctgttgaaaactatgcagaaataacttaaaagaatggaccagttgtgctgcagaaattagcagtgagatgtgtctttacttagcaaaggttgagaacaacatatgagagggggaggcagtcaccagaagtgagcaactccagaaaaaccaccagtataagacacataactatcttccaaacagcatggtatgtaagatgctacttacgttgacatttattttaatactagtaatcataatagtttgctaacatgtatttgtaacatgttaactttcctaaacacattcatgtgttttatttatttcctcaaagacacctatgacattggtagtaaaactatccctgttttacaatcatgaaatggatgcacagattgagtaacttgtccagagtctaacagccaagatttgaacttaggtgatcttcagatgtgggtgattcatgtaccaatatgtcagtcttgaataagaacttatattgtatatgcatgtttacaacaattttgtcccaaggtgtatttgaagatatatgttatttgggagaaaatgaaatagtgccttaagattctgggctttgttcttgagcttttaaataacagtctagtaattctgttttcagtaatggttaatgtgcttgtttcagaccattctccatttagaacaaatagaaaatctggaagtggggagggatatcaatttgaaagtattgagatctacaagatagcaagaatttgtggggccaatattccagggagaaggtaacccagaaaaggagcaacttttcccattcaggcatttgctgaattaaaagtctcatctgggaagctgaaaagctgagtggagtttttggaaaactcaaagagctgtgaaattcatattttgctaaggaggaggagctctggaaaatagctcaagcttttattgggacctcaaagggtttcactgtaggaataagagtgaatctgagaagtgatttctcacagtgactgaagccaagcttctgatcatgcaagcactagaaagaagtaatctgttcccagcctgtgcctctgctagctgcaaaagtgaatccactctggatgaaagtaacattaactgtagcctcagattttctctacaagtttttatttccagtgttattcaattaaaaataaccaggtaccccaaaacatagcacttaactgaaaatcagtagcacaaaaagtatacaaataggaactcttaggagatccagatactagagttatttaacttcaatataacatgggttgaaggagtttaatataacaatgattaaaatatttagagaattgaatgacaaatggaataatttcatagagaactaattctgttaaaaagtgaaaagagattctagaatgaaaatctatgttaaaacctagtgagttggtttaagagaagattttacacagctgagagctaataaattaaccaaaatttctacagaaaaaagtatttaactggatatacagagaagaacaaaagaacggaaaacaccagaaagaatgtacaagctgtatgacatggcaggtctagcatacataattggagtatcttcaggaaagtcaaaaggcagaggaattgaagcaatattttagtagatagtcactggaggttttccaaaactgacatcaagccacagatgtaaagaagagttatggacccaaatgtgataaacacaaagaaaacttatatatgctgtcatcaaactgctgggaaccaaagacaagagaaagtcttaaaagcagccagagaagaaagacattccaccttcaaaggagcaatataagactgaaagcagcctctcagcagaaataatggaagctacaagacagtggattgacatctgcaaggtacagaaaggaaatatccaccaacccagaattctacttctaatgaaggagaaataaaattatttttataccaacaacaaacaaaaaaacaaaaaaaaaaactgaggcaattaattaccagcagaattgcaccaaaggaaacactaaaaggagttcttttggcaaaagaaaatgatcctaggtaaagcatgatcgtgcagggaataaggagcggtggcaaggagtattgctggaggtaaatctgaataaaaattgactgtaaaaattctaagtaataatggttttttgggtctcacatagagatttaaaatatgtgacagcaatagcttgttaactcaagaaaaagagaatggggttagtgttttaagtttcttgagattttcaggatatggcatatgtacaaactgatattgaacttcagtaatttagggagccatattgtaatctctacagcaatcacaaaaagaatagagaagggatatgtaaagaacaagctactggcatggaaattataataataaaaacaccaatctagaagagagcagtaaaggggagataaacaaagaacacagctcaatagagagctcaaacccaaatatatgaattatagtaaatatgcataaaattatttcaaaggcaaagattgttagatcagataaaaaaggataggaaaatgtctgtttgctgcttgcaagagacataaatatgaagatatagaaaggatgcaataaaaggttatatcagctgggcatggtagctcatacttgtaattccagtgttttaggaggccgaggtgggaggatcgctagaggccaggagttcaagaccatcctgggcaacaaagctggatcctgtctctacaaaaaaattttttttagaaaagaaacaactttgggaggccgagactggcagatcatgaggtcagaagatcgagaccatcctggctaacacggtgaaaccacatctctactaaaaatacaaaaaaattagctgggcatagtggcgggcgcctgtagttctagctgcttggaaggctgaggcaggagaatgtgaacctgggagacggagcttgcagtgagccaagatcgtgccactgcactccagcctgggcgacagagcgagactccctctcaaaaataaaaaaaagaaaagaaacaactgtggatggtggcatgcacttgtattttcagctactcagaatgcagaggtgggaggattgcttgagcccataagcctgggagttcgaggctgcactgaactatgatcacaccactgtactccagccagagagagaccctgtcaatcaaccaaccaatcaaaaaataaaaaataaataatacatagttacatagcctaaacaaaagaaaagctgacatagctgaactaaactgttaaaaagttgactttaggcaagaaacttaatatccaaaaataggaaactttacactgataagaggttcaatataaacggaaaataccacccttttaaatgttttctaccttacagcataatctcaaatatgtaaaagacatcatgttgcctaatattttagtggtttgacttcaaagaatagaatgttctaaagtcagaaagaacagataatgttctaatgttctgtatggacattggaaaaatattgatactgattccttctttttgcagatttcaaattcagaccatgtcatttctttccacaatccctttcaaaggaggttggtgttttctgttatccttatgtgagttacttagttgaggaagtgtaaatgtagggctcagcttgaagtaggagagaagagacttggtctcccttttgcaggtggagttggtgctaggtgtcctcccttgggagcttcaggtaaagtctggaatgggtagtaaggctgtttgtttctctgctgttagcagaagtcttaccccagagtacagtggcttcagaagtacctggaaaaatgaaagcataccaggaagagtaagaatctcaccttgccttgttctttggtatttcactcatgcatcaaaaatgtgagcatcaggaaaattgcactggatttctgaatcttctcttcttctcaaacagttatttgttggctattaagagcatctccattgattagaagtggtagagacatacttgtgcctttggaaagggggaatagaatgtgaacacaacctattcttgaaagagcttgaaataatattctataccaagctgattctctttggaactgctgttgtccaccaagataaacagcttcaatcagggagcagttttttctaatcaggtttacagctttgaacttcaatgaaaactgattttctaaattgttagtcagtggaattatattttcagtctggttgtcttttcattcaaagaagctgagctaatgagagcaggtgttggagagaaaatgagccataaaattctctgtatctgttggacctagactgctgaattgagagttgcagaattggccatttgttagaatgcatttcaggatttccccctgaagtttcacaaaacagaaaatttaaacagcaatattagtttttatgtaccataagagaatgaaggaaaataattccttcagctaaaggaaatgatggacatagttgcttttgaagaagtggttgtctaccattttccagtaattgtctttcttctatcatgttacctctgattcttattgctgaaatgtagaagaaataagagcctacaagggaaagagttctctgaacttggaattctgacctcatacttcttacctctcttagctaaagcagaaataatgaggatctagtatattacccctttacacttctgcaaaggttcttaacttatgtaagaatcaagtcaattttctatgtaaaatcttgacagggattgtcagaaaaatttagtgtggaatgaaatggagcctaatttcattttacttgaaactccattacagatggaaagtttgtagtataagatactggcaggtacttgaaaatgcaggtagcagaacagaaattctttggcttgctccctaaccttaaaatactatttaaagatggatcttgtatctgaaagtgcacacacaagattgttagcagttgatcacctctgaggcatgaaattaaagggttgagagagtggaagacttaatttttactttttaaacttttgaaatgttaggagttttttttttttttttttacaactgatatatgtttttaaaaatggatttttaatgacctagaagttttctgtgtaaatgcattgttatataaagggtatggaagagaagcttcactgcttattgcttcatccagccgacctagacttttgatctttgacagatttgtttccaagcaaataattataaataagttatcattttactgcatatccttgaaggttaggtagcatctcctaccctcagaaatgagaatgccaagcaaccgccccaggcagataaacattttatatttaaaggcttccaggggagaatttaccgctctatttactatgaggatattcttgaatatatctattttgagtgactcatgctataatgtaggtgttttcttctccttctcccctggtggaggagaacagctgcttgctaaccttctgtgtacctacactcttacattgttattattagaatgctgtgcaggggggtatccacttaaagctgggtgtgactgagaagtattccagacattatgtgacatactggcatgtagtgattaaggagacatggtctcacataaagacaccagcatgggcctgtggctcagggggccttgtggcttgggaagtgcctcattcccatctccacttagcactcctctatctgatgggattgttccccaccacaaagctgcttttggctccttctctttgtgacttccatggaacatgccacctacacaaagaaggaagaagaaagaaggctgtggtaccatcctatttgcaaagactcagaaactgaccttcctttgaattccatttccaccctctactaaatcttaattcttcatttgttaaatggaactaatagcactgaactcaccttgcagtttgtgagaactaagtaagctttttgtcagtacaaggagtgtggatgagcttcttggtaactaagctcccaaaagacttagatgaaatgaaattccagtttattatttggcaatggaaaaatagagccctccatctgagaagacactgtttcctctggctagcacatgaactacatggagagacatttgtgtatctttgtgaacacagattcagagtaaggagaattaatggcataattcagatgtttgacgttgtcaggaatgtggctgaaaatagtatcccacagcaagtaggtcacagtagaaaaagcagaaggtgcctgggaatcaaacagtcatctgggacaagttgctttttctcagcttctggaaaatgggtatgataacacttgctcatcagcttggtttaattatgagataattcaatgtgaaaaaggcccaacaaggactagactttttcatctccttcctataaaacattgagccatatctgatttgtaattagtgaagttaatgatccagcattctagattcccttctattttccatgggaatggaagaggcttctgaagcctgttttgttcttatctttgcttgcttatatcatgctgtccttgaaaaccatagttacctgtcttgattgcaaagatttataaacaaggcatagtcacactttatacatacatattcatagacatggaatgcaactatgatagcagtttgaacagaggaaattaaaaaatgttttgagtaatgcccatgtctgcataaattttacctagtcacccgtctctacttttgtttattgatacccacattagaccagttgaaaaggacagcaggccgggtgccatggctcatgcctataatcccagcacggagggctgagacaggaggattgcttgagcccaggagttcaagaccaatgttggcaacatagtgagaccctgtctttgcagaaaaaaaaaaaagaaaactacctggatgtggtggcacatgtctatggtcccacctactctggaggctgaggcaagagtatcacttgagcccaggaggtctaggctgtggtgagccatgatcatgccactgcactccagcctgggcaacagagcaagaccctgtctcaaaaaaaaaaaaagtcatcaagagtgtgcctgctttgaatgacactactgttatctccatatctaagctgtagacagatggtgtatatgcagacaataagaggcagtatcagtattccctgtgctgatgcagaggcggtactcacctcaaaaacatctgacttataaatgactcacagataagagcaaaatgggagcattatctcctggctgatgtctcttgccctcgctcctgaaactagttttcagaggacctgtggcttcagaatgctttcctgctccctctccttttatttccctatcattgctcaatctcacatgccatctcttctgggaaacacttcttgaatcctgcagaatgagtttctggcttttctctgctgtgggaaatcagtagatggtctctgagctgagaagtggtgcagaggggcacatgacgggcaggttgacagatggtcacattcagtaggtaggctgagctcagttcgaagggtcctgtgtggcatgctgaggatgttgagctttatctgataagcaacttggaaactagattgttaaaccttgaaatagagtaacagattaaaattttaaaacttgttttaaaatatgtagcctgcaggctgattgccctgtagtctaataaagtgctaacaggtaacctttcgatacagctgggatgctggcttcagggattctgcatgaaagaaatcttcatgcaaaggctgaaaattatagaagaaatattattgcaacaaatgcatgatgatttgctgaaagacgtatgagaatacacctgtgtttacatttcactttgagatttctgtggctcatgggcctgtgacaggacagttctgtcttctccatttgcccttcctgcaaatggagcatggtacaggtatcctcactcctcagggccattcatccatcctgcatccagggactcagtcagtttctttcagccattacctttccagtaataagtgtgttatttggcttgtttgtggctgtttgtacagccaactttttcgacatcagtagaggactagaacaaagcccttgaatacagaaatttgaggtgtgggtggaaatcaagctaagattacatcataatgttcatttcttagagctgctgacaaagataaagaagcaaatgatggaaccctgaaaaagtaaagcaaagtagagaaagagcttactttaatggctttcttcttaagtgctattagaagagagagagggcagatctttcatttgaatctttctaatttcttgggttataaggctcttgcttggccctaagtatttccagcaattaaatcaaagcccattaagcttaggttcatcatagatcttattaaggatttaaatctttatgcagattttatttttcttattgaataggataaataaaggtgacgtacaaggaagttcacattttgaaagagtacaagattacttcaccaatgcttccttgaaatgtggcactgagaaactgcaaagttatgtttttgtttattaaaaagtaagttctgggctgggtaaggtggctcatgcctgtaattccagcactttgggaggccgaggtgggaggatcacttgaggctgggagttcaagaccagcctgggcaacatggcaagactccgtctcttattaaaaaaaaaattaaataagccaggcatcatggcttgccttcagtcctagctattctggaggctgaggtgggaagattgatcgcttgcgcccaggagttgacattacaatgagctgtgattgtgccactgcactctaccctgggcgagtgagaccctgtcttttagaaaacaaaaaataagtaagttcagagggaaacttctagttttattgttgtgatgagaattaccaatataatttaatatattttaatacaagtgttaatatatgtagaatacttaacgcagtgcgtggaaatgttttggagagaagtcttgaaataataagagctagagctatcataatggagactcacactatccttgtaggctatatccttgttccatctactaaataatgtgcctttatttacggagcacctattaagtgccagttagtatgttgataccaaggatatctataaacaagtcctcccagagctgatatcccagtggacgattagctagtcttcaataaagagaacaattcatgatttgatttacttgttactgtaattatatgagtgtctaaaaaatagtgcatccttgaattttagaacagagttcctgaggcagtcagtgcattctggggttttgccccaaagtgcaggaaatatgaaatccaaatttatataaatgagatttgagcagcttcacttataacctaatttctactgatattcccagttttgtgtaaacgtctacaaaatgagttctatctaaagctgacgccaactgtttaatatgtgtattagatatacatatatgtatagatatatatgataaatatgtattatgtatattaatgtatatgttgtgctggacccagtttattcatctcccaggatcttcttggccattcttttctgctgtgcttccctgatccccctctagggaaattccctgatgcccactgcattctttagacacagagctcagatttctaccctgatccttgctggtggcagccaggtagtcaggacacctctgctgggccagccaggcccattattactcccgtctcccaactctgatgtcacttgtgatcaagaactggcattactgcctggcacctggggcttccatgagccttctgaacttcagtgctcctattctgacccccaggcacctctggcccaagtatgcccactggagttcccataaccctggcctgcatagcagatgtcactcctgttggggaactcaggcttccaggatggctgccagagggaccagggaaccagtcagaaatgggggttgaggagtcggtaccctgtggtgcaaacattgatggttgaagaccagagctagtagaaattctgctcccatggtggactgtgtgcagattcaggggtttttacagatactctgatctgctgtgcctgtgaaaaccgtggccaggtcagtaaccaacctgccccatatacctccctcccctgcctcaaagccctgcctccctcacaaccatttacatggaagccaggaagtgttttcccaggctccattttccagagaacccaggcaaaagtacaagtggagggctagtagattggaggtttatatttgagaaaatttatggagaattttctgatcctttttgaattgtgagtatttctgccagttttattttttaaatgtttttattttatttttttttttgagacagagtctcgctgtgtctcccaggctggagtgcagtggtgcagtctcagctcactgcaacttcggcctcccaggttcaggcgattctcctgtctcagcctcccaagtagttgggattacagttgtgtgccaccaaacccagctaatttttgtatttttagtagagacggggtttcaccatgttggctaggctggccttgaacttctgacctcaagtgatctgctggccttggcttcccaaagagctgggattacaggtatgagccactgtgcccattctgccagttttttaagtttttcttttagtttgggagagataaaatggattcagataaacagatggatctatgtgctcagtgagggaagagtgcagggggcgggggtctgtcttgttcaatctcagatcccaggcaaagcacctgctggtatatgcaacttgggaaacccacctgctgaagtcacagaactaattagcctttccaagctcaggaatcatctggcctctttcaccaccttttcctctcgtttatcttgttcctctggattatttgcatttaacagaaatgctgaatacttctatttagcagaaacattaaaaacaaggtttgtccagtatgcagggaaataatcttagatgtatgttacaggagaacttaacaggtaaagatccatgatttgcaccatatttgcatggggattgtgatgctcttgagcaaggtagaggcccactccctactctgtctcagctttcctgtctttgtagaccatcccttgctttctggtttctgctcctaccatttcaaatgaattatgctgactagtgctgtcaagtactttccttctggatccttatcccaattattttctggcacagatagcaaatgcattcttaaaagttcttccactgagaaagaagccatttctgatctgacttcctactctgttcctcctaggtccctccctttttacactgtatgtccctctgttggatgagcccatgatctccctgaagccctagtccatgtcctcttcatttttgcatcctgtatcctaggctcttcgctctgtttctagacctttaataaatgagttctacatggctgaatgtatgatgtttcaacctttcttgccttccctacaatttttttttaactggaggtttgcagctctgtaaatcccctaaaaaaattatggtttgtgcttttaagtttctgcttataaagtaaacagaataatgattaaaataaacacactcagtatttatagtaatatgaaaactaagtgagactaacaattactcactgaggattttcatgtctttaatatttgaatgcaatctggcttattgcagcaggactttgcaggtgacagcataatatttaaaaatatttatacttgtacataatcagcattttctacaacttattttgggtaaattgaaatgaccctaaaagttctataaaatatacctaaaacaagtctaaaaacaatcagactttgaaagcttctgttaggaggtttctattgcttgtctttctgaggatctggttcgttttggtggggtcaaggcacaactcggcacacaggtcttccaccttttactcaaaatcttgtgcacctttcttgggataggtagtggaatgaagactgtttgatattggggtgtgtgtgtgtgagagagagagagagagagagagaatctgcacataaacaggaagccaaaatgctaatatagacaagcagtaaacctactctcttacccccaccctgcaaagtagacatggatatgtaggctgtatatttgattgaatattggggaaaaaccctctccttaagatttctgtcttacctaggtgcctgaaattctgtgctttttgaaaaccactttataatgcacatggtcataagggacgaggaatcacagaaagacatgagcatttagaacatgaattcttgattgttttcatgccgtgtacacctttggcagcctggtggagtctacagacctcttttcaaaatgatatgcataaatgcataacataaaatttataagattatagtgaaatcagttaagttcaaaataaaggtatccaaatattaaaacaaaatttgctgtataatagtaggtgtctttatttatcagtgccctaataatgatatctagcaataagtctattcactcaggtaattttaaagtagtgaatgtaacatgttgatgtgaagtgaatatcttctcattttttagtgatgacaacgtcacaaatactgctaataaaattgtgctttgtcaactacatcatatttgaaggaagtgccacattcaaatatgaataccacattcaggtgttttcaatactttcagttagaaggtattgaaaattaagatgtaattttgttatcattgacgtttctggaccctttgaattttatccatggacacctcccagggatttctctgattccattgaagaaagttttaagcaagtgaatggaggcacaaggagatggagggtaagaaaagtaaaatgggaaagaggaaggtggaaaacaaacttgataactttgctgtggctagttctgctaagactgtgaatggtgctcctatgatattgaataggctaaatgcagttgctcaataaatgtaacaaactcgcagaatcattttaccttcatttgaatctaaagaggacatgattcttctctgattaatacagaattctgatatccccatcaacaggtctcggtatgcagcctgcctgggcaagttacctggggatgtctacaactctctaagttgcttaggttatcagaagtcacagcagagtctttggtgagaaaaaatgaaatacggacaaacttgtaaagggagatttcttgggaaactctgtattgcttccaatagtcatacttagctttcttctattaggtttggggtagagaaaagctgggaataagattcgttctcacaatttcaccatcagtttgctaaaaggcttgtctttttaagtatagaaatggactgtaaactatgggtttgacttaattggtctgagatttggcagtttcatgtgcgtaggtgaatggtgaggcttttacattttttagattaaaaaaattttttcattatactttaagttctgagatacatgtgcagaatatgcaggtttgttacataggtatacacatgccatggtggtttgctgcccatcaagccatcatctacattagatatttctcctaatgctatccctcccccagcccctcacccccgacaggccctggagtgtgatgttcccctccctgtgtccatgtgttctcatcgttcgactccctcttatgtgggagaacatgcagtgtttggttttctgttcctgtgttagtttgctgagaatgatggtttccagcttcatccatgtccctgcaaaggacatgaactcatccttttttatggctgcctagtatttcatggtgcatatgtgtcacattttctttatcctgtctatcactgatgggcatttgggttggttccaagtctttgctattgtgaatagtgcctcaataaacatacgtgtgcatgtgtctttatagtagaatgatttataatcctttgagtatatacccagtaatgtgattgctgggtcaaatggtatttctagttctagatccttgaggaatcgccacactgtcttccacaatggttgaactaatttatgctcccaccaacagtgtaaaagcattcctatttctccacatcctctccagcatctattgtttcctgagtttttaatggtcaccattgtaactggcgtgagatggtatctcattgtggttttgatttgcatttctctaatgaccagtggtgatgagccttttttcatttgtctgttggctgcataaatgtcttcttttgagaagtgtctgttcaaatcctttgcccactttttgatgaggttgtttttttcttgtaaatttgtttaaattctttgtgtattctggatattagccctttgtgagatggacagattacaaatattttcttccattctgtaggttgcctgttcactctgatgatagttgattttgctgcgcagaagctctttagtttaattagatcccatttgtcaattttggctgttgttgcaattgcttttggtgttttagtcatgaagtctttgcccatgcatatgtcctgaatggtattgactaggttttcttctaggatttttatggttttaggtcttatgtttaagtttttaatccattttgagttaatttttgtgtaaggtgtaaggaaggtgtccagtttcagttttctgcatatggctggccagtttccccaacaccatttattaaatagggaatcctttccccattgcttgtttttcttgggtttgtcaaagatcagatggttgtacatgtgtggtgttatttctgagacctctattctgttccattagtctatatatctgttttggtaccagtaccatgctgttttggttactgtagccttgtagtatagttggaagtcaggtagcgtgatgtctccagctttgttctttttgcttaggattggcttggatatgcaggctcttttttggttccatatgatatttaaagtagttttttctaattctgtgaagaaagtcaatggtagcttgatggggatagcattgaatctataaattcctttgggcagtatggccattttcatgatattgattcttcttatccatgagtatggaatgtttgttcatttggctgtgtcctcacttatttccttcagcagtggtttgtagttctcttggaagaggtccttcacatcccttctaagttgtattcctaggtattttattttccttgtagcaattgtgaatgggagttcactcatgatttggctctctgtttgtctattattggtgcataggaatgcttgtgatttttgcacattgattatgtatcctgagactttgctgaagttgcttgtcagcttatggagattttgggctgagaggatgggtttttctaaatatacaatcatgtcatctgcaaacagagacaatttgacttcctcttttcctagttgaataccctttatttctttctcttgcctgattgccctggccagaacttccaatactgtgttgaatgggagtggtgagagagggcatctttgtcttgtgccagaatgcttccagtttttgcccttcagtatgatattggctgtgggtttgtcataaatagctcttagtattttgagatacgtcccattgatacctagtttattgagagtttttagcataaagggtgttgaattttgtcgaaggcctttactgcatctattgaaataatcatgtgctttttgtcattggttgtgtttatgttatggattatatttattgatttgtgtatgttgaaccagccttgcatcccagggatgaagctgacttgatcatggtggataagctttttgatgtgctgctggattcactttgccagtattttattgaggattttcacatcaatgttcatcagggatattggcctgaaattttctttttttgttgtgtctctgcgaggttttggtatcaggatgatgccggcctcataaaatgagttacggaggattccttctttttctcttgtttggaattattttcagaaagaataccagctccttttggtacttctgatagaattcggctgtgaatccgtctggtcctggagttttttttggttggtaggctattaattactgcctcagtttcagaacttgttgttgatctattcagggatttgacttcttcgtggtttagacttgggagggtgtatgagtccagtaatttatccatttcttctagattttctagtttatttttgtagaggtgtttatagtattctctgatggtagtttgtatttttgtgggatcagttgtgatatcccgtttattattttttattgcttccatttgattcttctctcttttctccttcattaatctggctaagggtctatctgttttgatgatcttttcaaaaaaccacctcctggattcattgatttttttgaaggttttttcttgtctcttgtctttttcagttctgctctgatcgtagttatttcttgacttctgctagcttttgattttgtttgttcttgcttctctagttcttttaattgtgacgttagagtgtccactttggatctttcctgctttctcttgtgggcatttagtgctgtaaatttccctctaaacactgctttatctgtgtcccagagattctggtatgttgtgtctgtgttctcattggtttcaaagaagttacttatttctgctttaattttgttatttacccagtagccattcaggcgcagattgttcagtttacacgtagttttgtgattttgagtgagtttcttaatcctaagttctaatttgtctgcactgtggtctgagagactgtttgttatgatttccgttcttttgcatatgctgaggagtgttttacttccaattatgtggtcaattttagaataagtgtgatgtgctgctgagaaaaattcatattctgttgatttggggtggagagttctgtaaatgtctattaggtccacttggtccctgtctgagttcaagtcctgaatatccttgttaattttctttctagttgatctgtctaatattgacagtggggtgttaaagtctcccactattactgtgtaggagtctaagtctctttataggtctctgtgaacttgctttatgaatctgggtgcttctgtatcgggtgcatatatttttaggatagttagctcttcttgttgcattgatccctttatcattatgtaatgcccttctttgtctcttttgatctttgttggtttgaagtctgctttatcagagactaggattgcaacccctgctttttgtttttgttttttgctttccttttacttggaaaatattcctccatccctttattttgagcctatgtgtgtctttgcatgtgagatgggtctcctgaatacagcacactgatgggtctcgactctttgtccagtttatcagtctgtgccttttaattggggcatttagcccatttacatttaaggttaatattgttatgtgtgaatttgatcctgtcattatgatgctagctggttattttgcctgttagttaatgcaatttcttcatagtgtcgatgttctttacaatttgccatgtttttgcagtggctggtactggttgttcctttccatgtttagtgcttccttgaggagttcttgtattgcaggcctggtggtaacaaaatctctcagcatttgcttgtctgtaatgtattttatttctccttcacttatgaagcttaatttgggtggatatgaaattctgggttgaaaattcttttctttaaaaatgttgaatattgactcccactctcttctggcttgtagggtttctgctgagagatctgctgttagtctgatgggcttccctttgtgggtaacccgacctttctctctggcttcccttaatattttatccttcatttcaaccttgttgaatctgatgattatgtgtcttaaggttgctcttcccgaggactatctttgtggtgttctctgtatttcctgaatttcaatgttggcctgtctttctaggttggggaagttctggataatatcctgaagagtgttttccaagttggttccattctccctgtcactttcaggtacaccaatcaagcataggtttcttcttttcacatagtcctatatttcttggaggctttgtttgttccttttcattgctttttctctaattttgtcttcatgctttatttcattaagttgatcttcaatgcctgatatcctctcttccgcttgattgatttggctattgatacttgtgtatgcttcacgaagttctcgtgctgtgtttttcagctccatcaggtcatttatgttcttctctaaactggttattctagttatcaattcatctaaccttttttcaaagtacttagcttccttgacttgcattaggacatgctcctttagctcggaggagttcgttattacccaccttctgaagcctactgtcaatttgtcaaactcattgtctgtcgaagttttgttccccactggtgaggagttgtgatcctttggaggagaaaaggcattctggtttttgcaatttcagcctctttgctctggtttctccccatcttcgttggtttatctacctttggtctttgatgttggttggcctttgtatgggtttttggtgtggatgtcctttttgttgatgtttatactattcctttctgtttgttagttttccttctaacattcggacccctctgctgcaggtctgctggagtttactggaggtccactttggactctgtttgcctgggtgtcaccagtggaggctgcagaacagcaaagattgctgcctcttccttcctctggaagcttcatcccagaggggcacctaccagataccagctggagctctcctatgtgaggtgtctgtcaacccctgctgggaggtgtctccccatcatgaggcacaggggtcagggacccacttgaagaggtagtctgtcccttagcagagcttgagctctgtgctgggagatccactgctctcttcagagctgacaggcagaaacgtttaagtctgctgaagctgcgcccacagccaccccttcctccaggtgctctgtcccagggagatgggagttttacctataagcccctgcctgggaccgctgcctttctttcagagatgtcctgcccagagaggaggaagctagagaggcagtctggctacagcagctttgcagagctgtggtgggcttcaccccgttcgaacttcccagtgtctttgtttatgttgtgaggggaaaactgcctactcaagtccagtaatggcagacacccctcgcccagcaagctggagcatcccaggttgacttcagactgctgtgctggcagtgagaatttgaagccagtggatcttagcttgctgggctccgtggaggtgggatctgctgagctagactacttggcttcctggcttcagccccctttccaggggagtgaacagttctgtcttactgtctttccaggtgccactggggtatgaaacaaaactcctgcagctagctcagtgtctgcccaaacagctgcccaattttgtgcttgaaacccagggccctggtggcacaggcaccggggggaatctcctagtctgtgggttgcaaagactgtgggaaaagcgtaatatctgagctggagtgcaccattccttatggcacagtgcctcatggcttcccttggctaggggagagaagttccttgaccccttgcgcttcccgggaggcaatgccccaccctgcttctgctctccctccatgggctgcacccactgtctaaccagtcccaatgtgatgagctgggtacctcagttggaaatgcagaaatcacccgccttctgtgttgatctcgctggaagctgcagaccggagttgttcctgttcggccatcttgccagccatcgatcagttttttagatttttaagcttcccaaggaaagcaatgatcttttcttcctgaagtggccagtaagtggccattatttaactgatggctttttgaagagtgctgatttttctgaggatattctaatgcaagtaattattagatgctttctgtggggcgtggatatcagctcacttgatgtctgaccacatgatgttgctcttctgtagctcctaactggcatatgcatcaggagtatcctcaaggctaagagccccagtgtcttcccttaggctagagattgggccatatgcaagttaatctttgtaatcttatgaaagctcatggttctgaaatgaaaagtaaaactgaagttgaaattgcacagtggcatggtggactttgtcttcaggagatgaagtcggtttagagagctgaattttcaagatggctgacaactggctgcactatggtatcaggaaattttactgcttttaggtgaatatcactctaagctttatcaggcacctttttgccttactcaacataaattaacatgtttgtggtaagttaaggccatgttgaaaaacataaatgtttttctgcagatttgctaaagagtagtggcttacttatgctcctaactacccctggctgctgtgctgcaacttggcatgactgtattttatattttattatgtcttcccttttggcaactcagttttctcattgttgcttgggtgtctgctttagcagtctttctttcctgtgaatttctgaaggtgtagataccagataacataatttttgtgcatatggttgagtacaggctgtgagtcaactgaataaatgcatggatttgacgacatctgttttggctgctcagaggttttgttttggtatatgtactctctagtacttaattttctgtgtaactgaaagataccttaactctaaattgatggtaccccatcccctcctctcttcattacactgcctaccaatcaataaaaaatctgatagacaattttaaatattaaatcacctgaatattttttatttgaaatataaaatcactgaagattttttttcctcaacgatttaaaaatattctttgcctttagttcagctttctcctctgggcctggctgtagactctatggaagtaattctgcctaataaaaaggtttagagatgttgtctaaaacactttagaaaagaaccgtctctctggcagttaactctcatggggataaagtagctttcaaactccaacaataatggttagttttgacgtatctgacctgtttgtgtgcaaagtgggagttcgcctccctggaatgccacttaaggcagcaatgcagctcttgaaagaagttttataaaagcaaaacaccaagctgtaaaggacaaggcattttaatgtgaactgctattactttcgcaagagcccagttgctttcctagaaagccataatgtgattcccaacaataactgtggacatgctgttcctcctgtggttaaatcacatcttgatttcagctgtggagcactgattaatccttctaaagtttggacaatgaatgaagtgaatgaagtttggacagtgaataaagtatcttcctctaccctccaaggtattgatggtcactatttgcatttgtgtgtgctctacagtttctcagtgacagtccagttcagttcttaatttaccctgatgatgatcctaaacttgcgttagccattgttttctgcggtgccattctgtcactttggcatttgaatatgtctgacatagcaattacaacttcgtgttttaattacttaattacacagttgcttactctgttagactggaagcttctgaggggccgtggacatgtctttttcatgcccaatgtcagtgtctgttcactgtaacaggctcacaaatgtttgtggaatgaacaaatgttgaatccccagcctgttctccatctgtggcctgtcttaatgcctcatcctggaggactcagctcagagttccctttctctaaagagctgtcactagcaccccacctccctgagctagcttcagtgccacttttgtgtgtgccctcagtgaatgttgaacgagggaggtgttcacaccattgcaacatcactgtcttcctgccacacctgacttaagaatggggcttgagttattatactcaactttgaatcagtggtgcttacgacagtgcctgggcagtgattactcaatacatatacacagtacattttaaagtttgctgtttctttttagaataattgtgtaaatgataaagaagaaaaaattaaagaaaaagtgtttctgccaatgagatacataaaaggatttaaaatgcctctgttgttattttttgttcatagtgcattgtggtagttaattcaactaattgagtgccaggcatatctcagattatccgtcattggtgatatagatgtatcaaattactgtttctgcttttttgtcagataaaattcagttgtcagcataaactggaatcatgtaagtggtgtaaaagaaccaccgttctttcacatattttaggctaagaatcattttggacaccatcagctccccagcctctcagtatccattcagacaaacaatcctttgattgtaactcaagatatcccatttatccttcccacttcctcatatcactgccttagattaccattggtctactattcccacctaatattttctcttcatgttattataaaattatattattgtgcagttattattcatattattttgctattctacccagtgtgtttatgggtacctggtttgttttttttacccggattgaaaacgattacttgaaagagttatttacaaaaatactggttaaatgaaagaaaaattagccttgaataaaaatacccaagataatcagtggtattacttcttgtacatttcttcccatttccttgtcggcaacaataaaagtgccatttatacaggagtgaatgttggaagtgattcacgtggcatctcttgacagacctgtggagggcactctgtggaggcagaagatgaagagcacttagtatcgagtgcctctgtgagtcatcacagatatgcttctgaccttcagaccattttggcacttaatagataatgtttgtcttctcttgggttgtgtaagctcagagaattggtcatctgttttgaataatttgatcttaaataacatttttaagtaaagccacatgagtgttattatatcattttattgcattaggaagcaacaagaataaaaatatcctctgggcttctgaagagatccaggggtttatttaattgtttatattatattaaatgtcttacttaaaattcatgtttttcaatgaatgttggtagtttttaaatgatagattttattttcatctccttatcttgcattctgtcactaattcttttgtttccttgagaagaaataatagaattagttttggttccatactgtcatcataagcatagtgagttttaacttttatttttaaataagagaatagctcatgtaatttgagaatcgattaattttactttttaagacttataattcaaagctgaagatgaccctaatagcttctaatgcacttttttttgttctctttttaattttctccagagagcatatgccaccaatatttggttatctgactctgagatgtgctatgaaaccttgattatatgttagactaaatcatcagctccagaatctgactgactggattacaatctgcttttctgtgtgaccttagggaagtttttttaaaccctcctggttataaaatgacaatacttctctcaatggttaccgaagggaccaaatgacataaagtgcttagcagagtggctggcacatagctagcactcagtacaggttcggtaacaacaagagcaacagtaacaccaccaccaccaaaaggagggagtgggggaagtcaagatgattgcttgtgcttagaacagaggatgccaagagacttcttttcttttgggctggaagctgctttcacattagccagtcttcttttctttgaagtaacagggccactttatataactttatataactttatataaaccactgaccatgatcattaataaattaaaaaatactattttcatgtctggagcagttgcttagtatttatattcaataaatcaaaaccctggaagattaaaaatacatataccttttggctagaaatctgacttgtaggactctcttctgtagaaatgaagaccattcacatggctctttattggatgttctttgtcgtagcaggtgtcgaaagtgtaaatttgggtctctgtgtccttattggcctgaagagttgtcaacattatattattggtaaaggatcagaacaagctgcagaggaatgtgtcagcttattattctttgaataaagtaggaaaagttttaaaaaaaaaaatcccttcgtatatgtgtctgtatgtttatttgtatataaagaagtatcctgagggaaacatactattgtctaaatgggataagtttgtggtcagttaagtgaaagttaggaagaaatgtttaatttttcctttgaaatctattttttgacattttataaaggcatatgcaatttttgttaatgtttttaatgaaaagttaaaatggggaaagaacgaactgggtctctatgtaaacaaaacagtttgcaaggatatctagaatttagctatcttgtttttatattctgagagctgatataaagaattttccctaatatacagttatttccctggaaagctgatcgatcattcatcatcaagtgaggacatttcaaatgaagcttttaaaaaatgaaatttttaaagtggttatgctagaggcaaaaaaaaaagagagagagaaacacctctttagacctctatgaaaaacgagttttaaaacctaaggttttaatagaaatgtaataagttatactgggttctgaattaacaacaacaaaacctgaaaacgaaatagtgtactcagtaaaaataactttccacccagccaagcttagagatacagtgatagaaatatatgtgtataaatctgtttctagaccacctacctaagggaataaatcaagatgcactgagttcagttattttaattatcctatagctcccacagaaaggagctgaggagctgaaaacactaggagaaacagaaaaccaaaagcttccttcagaaattcttcacaaatggcctggcgcagtggctcatgcctgtaatcccagcactttgggagtccgcggcgggcggatcacttgaggccaggagttcgagatcagcctggccaacatggtgaaaccccgtctctactaaaaataaaaaataagttagctgggcttggtggcaggtgcctgtaatcccagctattggagaggctgaagcaggagaatcacctgaacccaggaggcagaggttgcagtgaactgagatcgtgccactgcactccagcctgggtgacagaacgggtctgtctcaagaaaaagaaaaaaaaagaaattctttacaaatgataagtgacatatcccacagtgggtaaattgttcactgtattatggtgtatcctaggatactatgcgtatcagtgaaacattcttggtaacgtgcaccattttttttttttttgagaaggagtctccctctattgcccaggctggagtgcagtagcacagtctcagctcactgcaacctctgtctcctgggttcaagcgattctcctgcctcagcctcccgagtagctggaactacaggcgtgcaccaccatgcctggctagtttttttgtatttttagcagagacggggtttcaccatattggccaggctggtctcaaactcctgacctcgtgatctgcctgcctcgacttcccaaagtgctgggattaccggcgtgagcctctgtgcccggccaacatgcaccattcttgccaaagacctgaactttaccatctttactcttttttcagcaaatttgtttgtaaaaaccatttcctccctgcctcttcctttctctctatcccggtcactctccctgtatatttgtatgtgtgtatatacctgtaataaagtcatgcattgcttgatgacaaggatgcattctgagaaatgtatcgtcaggcgattttttttcattatgcgaacatgatagagtgcacttacacaaatcgagatggtagagcctacagcacacctaggctatgtggtatggcctattgctcctagactacaaactgtatagcatgtgactgtattgaataactgtaggcaactggaatactatggtaagtatttgtgtgtctaaacatggcaaaggtgcagtaaaattagagtattacaatcttatgggactgcagttgtgtatatggtccatctttcgccaaaatgtccttaagtgatgcatgactgtgtgtgtgtgtgtgtgtgtgcatgtgtgtgtgtgagaaattcaaaacgtctgtattgatataaactcattaggtgatttaaaaaaattggtttagtcaaattaaattttcaaattggttatccttttttaaatcacatgtccaatcaagtacccaagaaagacatattaattttctgtaatgcattctcaatgatataacatgatccaaaattcaggtcatttagatattgtttgctcttttaaaaactttaaaaaaaaacatttaaaacttttattataaaaatgctcaaaatacacatgagtaagaatccaccctcaagcttgtcttaaaacaacactcatagctgataattctatgggtcagcagttggggctgggctcagctgaatggttcagctgatctgagccatgcatggctgatcttggctgggttcacttttgcatctgcagtcagctgtcaggtcagctggtcctaactgggaaggctgaatcctgctccacattgtctcctgtcctccagcagtctagcctggacctgcccccgtggtagtgagcatgttcacatgttgttcctttctctgctatcttaggtttatttagctctgctatcttaggtttatgaataaaattagatattatttatatatatacttacaaggatataatgttcctcctgaagttatctaactaatgtgctgccccttaaactgagaggcagcttagtatcatgcttaagagcacaaagtccagagcacatttccctgaggttcatattctgtctccaccacttacaacctacatgatcttgagcaagctacttaacccctctatgcctgagttctgtccttgtctgtaatgagtaaaagagttaatatatgtaaaacatttggaagagtgctcagcacgtattaaatatcatgtaagtgttagctattatcaattcccatattaattgttaatatagatatatatttaatgatttgaaagtttttaataattggttttataagtataattagcagctttcataatcaccattaattattgtatccttttgctcttataattaaatatatgtatttataatttaacagacttggtagcatctaagcatttaaatcacactaggagatttttcactccacgttgcacctagaatgattatttatatttgaaaattcatgtttagatattgaagataaattcaagtgccatgcctagtttgtattactgaccttgttatgctgatttaaagatggatgttggtaacctgtgtaatcgcatgatcattgatacacataaattttatgggtgtaagaaatttccttgaagtaagaactctgttatcttgtcttctaggctaagttcaaatacatttggataaaaactgggaccaaggttgaattttgacatatatctattctatgccagtcacccttttaagaagtattttacgtgatttaccttatttaatttattcaaccacctctttgattaggaaacttgcaaaagagagttagttcacttactcaaggacatacaaggtgtgactgagtcaagatcctaattcaggttgtttggctacagagcttagcttttcctaccaagctcagggagccctcctcaggtcctgcccagcacagtccagagtactttgcttgctttagtccaattctttcacagtaggcactgtttgtttttgagtttatggacgaactgactcagattgagagtgattttcataaggtcacagaactagcaagttttgtaaggtgagatttatctaccagcctgctcttggcaaggagtgtgactctctctgtggcctctgctgttgggatgctgtgtgtgataaaatcccctgcttctttctttcctgaacccttgcaggagcttcaccagaacctcacaagcatatagtgttgaaatgtttatgtaattaagaaatttatccatgttaaaattatacccagcatttgctttaatttaaatttcttggtttagtggtaagataactattttcccagacatctccattctaattgtatttctgctaatgcagattgctttttcatattatttgctaattatttattggtattttgatgctttttctggttaattaatccaacagattacttaaattccagacttttgataatttataaacttgatactgtgttgttagtttaatgtggacaccgtttcattttctccactgactcaccttgttaaattttgaccattccttctttctgccttctgatcaagcagtgaaaattcctgcatgactctggtttctgaccctagttgggctaatgaaacatcctttggcttcttcttcaggaatgtggggagctgtcaatcagggatgtcaacagaacccttggagtcttttgaactgttttttaggacaaaggatgatttagcaagcttcttctgagtaccactagcaagtgtttgaatgtgtcaaagacagacctttaaaatatttaagtttggcctgcattttatgtaaaagctaactgcacaatttcttcttaaggcaagtcatagtttagctggtagactatcaccagatagctctgatctgcagaccatactgagtagcataggcttttttttcacatgtggaaaaaaaaggtttctgaatcaacactaatttaggggaaaaataaatggaagcttatattgtgatggcttatgtcattctgagatttacaacagaaactaacccgtttctaaagatgtcaatcaatgaaaaacttgacgtatgggaaattaaacagtctctttagaacgttctaaatagtcaacctgtcactactcaattgttgtatgtgtggctcatttcctgagatacagtcattagcgtcatcagatagttaaaaggttgtgtttgctttactcagtgtttgttttttacttataaattacaaagctcacacctagtattttctacctaagtcactgaagcagtttgtctaaatgacacactgtaatacaatttagttctcattaaagcttcccttttcttataaaaggagagcacattgcttgttactacagaacccaccgggtttcctctctgcagtgagcctcttccaatactgctttgtctcttatgataactgtgtttcacaagtcccttttaagattgatggtcctaaatccataaagtttacagccacttctggttgttacttatgtaactgttggtgaacttaatgatctgatttgctaattctgtgaatctctttttattctttctgtgctcagtgaaaacaacttaaaatatgatatacaactaaactgtgaagttcttgctgcaggaataggtccaagtttgtctcgtttgtagttctcaaagtgccccaatacataatgggtgctcagatgaatcctgccatggctaaaagtgactagttaaggtgaaataatatatttttcttcagctcaatatttttatgaataataaaaatggccgttcagttgtgctgtgaatcactaaattgacaattgaatatctttttggtatttaatataaatgtcttaaagcaaaggttataagcacatctgaggtatatgagctgtgcttattaattttgtagcacctagattcatgtggaattctctcaagtagaacagagtaacgtgaactaaatggcatgatttgtagaatgatccatgccaggatgatcccatcagctgctgtccctggtgagggagtgtattagtccattctcacactgctatgaagaaacacctgaggctcggtatttaaaggaaagaggtttaattgactcactgttccgcgtgactgggaaggactcaggaaacttagaatcctggcagaaggtggagcaaacacatccttcttcacatggtggcaggagagagaagtgccaagcagaggggggaaagccccttataaaaccatcagatttcatgagaactcactcactatcatgaggacaacatgagggtaaccacccccatgattcaattaactcccactgggaccctcccacgacatgtggggattataggaactacaattcaagatgtaatttgggtggggacacagccaagccatatcagagagtaaagggatgtgcagttggttagagagttttacttcagcttccctgtgatacagtattacttctttttgctatcttactgtgttttcaccagcatgtcatgaatggggcaaaaattaatacaactaacaaatggtctttttcagtagttgttgggaatccacaaggaaggcaagaagagacagggcaaacggaaagaaaatgtgtcatttgggagaagagagaatttttgttattcatgtcttattccctagtggctgagaaataagtattttatgtttgtaggaagggcatagaagaggcagtagcttaggagggatatatgatatctggtctgcagaatgtgaatgcagcttggagactgtggtttcatcagactgaaatgggtgctaataaacatttttagggcgatggtggcacctccctgcagaggctttgttccctttgagctttgctcccgtagttcatttatttctccacaggccttcctcttccctatttcaggaaatttctggagacatattctttaggagctgtgtcagtactgactgagggagttggaggaggggtgtaacctggtattatgataatcaggggatgagatcaaagtgtaaaggacaaattaaaaatgaaaagctttcttaggaagcagagcacagtggttttgattattgggaggagttgcattatggtcttaaagcatttgtgggctctgatgtcagttgtaggttgcagccagaattgatttgattttgcaaaatgcaattgagttagaatagaaaatgtacatgcagtacatatatacacatggttagaagcgtagtggtacacttttttttaatgaaagcctgggtatgtgtgtgtgtaggtaaatgtatatagagacatgtcgctttacacatgtatgctgaaatgtaaagaacaatatattggcgtggcacagtggctcacatctgtaatcacagcacttgggaggctgaggcaagtggatcacctgaggtcaggagtttgagaccagcctggccaacatggtgaaaccccgtctctactaaaaatacaaaaattagctggacacagtggtgcgtgcttgtaaacccagctactcaggaggctgaggcatgagaatcacttgaacccaggaggcagaggttgcagtgagccgagtttgtgccattgcattcccacctgggcaacaagagcaaaactccgtcttggagtagggcagcgggggaagtacaacctattatttcgtactgagttagtcaaaatgtttgaaaaatattagtcttaggagcactgcctttgcagtttgaaggtaaaaactttgcattccccttggccctatccgatgctttcacttgtcctctagtgggttcaccctgctctctctttcttcagagcttcattgttgtgaggatttaattagatcaagttcatggagcacctggcttaggcactggtggcccattttgttcccgtaccctcttcccttctccttaagacatgcagatgtacgtggtgattccatgtgccgtggcctattggcaccctttattttctcctttccttgaagccgggtcttttctatattcagagcctgggtgcagcctttccattcaccatgaccatgtgtgtccacttgcttcccactttccctcttcattttcttctgcaacgttctttcgtagtcaaaggggttggcttttataacttacctttgggttaagaaagcagatttttctttttttcattcttttctttcaattttcctcatctgctgttgaggaaaaatgtatatttgggtaccaaggatgctatattgtttactctttgctataactttaagcctatgctactcagtatggtcggcagatcagagctggcccactcattgtttctggtccctgaccagtacagaaactgagagcaagtctttagaaaatttttataggaattggacagaataattttatttcatcgaataataacaaatctggggctaccatgttgtgtgactaaacaatttcatttttctagcaattcatgtttattgtattttatataaattggtctgagatgcactggacttttttttttaaaaaaacaacaacaactggtttttcattacaggttgtttgagaagtgctgctctagtgaactgaattgttctaactggttgtatctgcataggtcagatgaagcacaaataaccccataaactagagtcaggagatatgcctgcagtgatggaacttgttaacattttgtttgcctctcgtattctaaatccacaaatttaaaggcatggtcatacaagaaaaaggcaaaacagccaaagggaggcaaagaccaataatctgtggcttttgctaaaattaagaagtttaaaaagtgaattttataatagctttaaagttcataaaatgctgcttctctgtaagccaaagtattgaagaagccatgtaactctttcttcctgctggataatggaaaatattcttttgttgttgttgtttgcaaagtttctcaaatacacttggaagagaattcatgtagttttctcagccttgacaaatctagagctccaaacacaccaatgcaaattttaatgatgggttagaaaggaataattctgtgcagttattactgctgtcacaaacaatgatggaagatagtttaatcaaaagcctttgccagtggatatgattggctaaatttaattcacccagagatttgagaatgtgaacattgcatgttcttatcaaagagttttcctttttggggaaaccaaaataattattcttaagaagcttctaagtctgcatctaaaggctgtccctttttgaagctgactccatcatgcagagctcatttcatttgcctgcaatggtatattttctacttatatactagtgacttaagggtgttttgttatctgaacacaaacggaatttctatgctaatttgaattatgattttttaaaaatttaccgagctggaatgctttttgtaggaggaaagaattgtaaggaagtaactacagagggagacccaattactctttgaaaatgcattacctcgcagtcaaaacatttaagtagaaggtgaaaattaaacattcagccatatagggatagtttaaaaaacagacttaatagtctaaaattgaatataaatgctttgaattctgtaattctctaaacattggttggtgagttgactttataccttcatagcagataggtgataaaaacgaactaagaagcaacacttctctccctcctgccaactgtaactttactgcaggttgctagactttcatatttgcttctgtaaactcattggcacataatagtacaccactgtcaggaaacacgagtgtggatagaaacgtcaccttttgtactttaaagctgtgagttaagtcctgatggccacacactgaaataaagataccctttccccaaaaacgtaaggggaagattaattgagttgaaggttttgtgttatctcagtactaatgttcttctctcgtaaagaaaggaaacttaaaaattaccacttaggtgaattatagtaggaccaggagagttgtgaggtgaacagggggaaatagagataaatggtaaagaattccagctgggcacagtggctcacacctgtaatcctaacatttgggagggtgaggcaggaagattgctttaatcttggagttagagaccagcctgggcaacatagtaagaccctctctctacaaaataaaaaataaaaaaaattagcagggtgtggtgatgcacacctatgatcccagctactcgggaggctgaaatgggaggatcacttgagcccaggaggtcgaggctgctatgagccgtgactctgccactgcactccagcctgggggacagagtgagaccctgtctctaaaaaagagccacataattttaaaaagccatacatttaggagggttgtggagctaaagtcatcataatgaaagtcaggagcatttgctgggcttgtgttttgtggcaggctttgtcccgcttgccttgtatgcattcgtggttaattatgaggctgcatagatacaccaattgggagactgtagaggaagggaaaaagggaatctcacagaggagtgtaccgcaggggaaggtgcttggcagagacttttcctctaaaagatcatgagtgttgaaatctgagtgctgcttaattgatttccagatcagttgggagagactagctgtgctagtgaccatgggggcagtccagacagaattgcctcccaaggacctgaacccctgccagaggaagactgtgcatagagtctgcatttccaccaaagccctgcccctgcacttgagaagcctctcatgaatttcacaaaatcacatgctgaaaatagcagatcttaggccaggtgcggtggctcttgcctgtaatcccagcactttgggaggccgaggtgggtggattacctgaggtcaggagttcaagaccagcctgaccaacatggtgaaaccttgtctctactaaaaatacaaaaaattagccagggatggtggcaggcacctgtaatcccagctactcaggaggctgaggcaggagaatcgcttgaacccaggaggcagaggttgcagtgagctgagatcacgccattgcactccagcctgggcgacgagagcaaagctccatctcaaaaaaaaaaaaaaaaaaaaaaaaaaaggagagagagaaaatagcagatcttgtgagaagaacagggttggggctgacccttccaaatctatgcagctttgtagctggcaagtgaacaaaaacattgacaaaactaataaaagtgctggctctctgaactccactctggcacagaccccatgagaccatccttggccctgaaccccagaccctgaacccaaggcctccacttcttcccactctccatagaagtcctcgaagtcattctcttctaatagagactacttgctgtgaacgtaaaaatatcatctgaggtttgtcttcttcatcagtccttttcttttttttgtcctttttaaacacagaggaagggggcagaggcttcacagttcttcacccgttcttacagtttcagagacagcttaggagtggaaagaggaatgaaaccaccaaaccccccttcttgccactccttgcattgaggaaagatccacttctgtaggatcttcagctttgtttaaaagacatcatgcactgataaagctttccctttatttgagaggacagttgcccctcatcacttcacaacatgaatgtcctgcaaaaaattgcacataaaccaagaggacttgtgtgtaatagggatgtcactcccctgtctagtaatcctctatgagttaatctgcactacagaagcatgcctcaaagcaaaatagactattcttagtcaaacagggaaaaaaggaggagaaaagactataaaagctaggatcacttgagtaacttagattatacctgaatttcacctggatctcaacataaaaattcttgtgtactttagacacaagagtgtaagagcatttcatgctggaatggagcagagtggatttagcattggaggcaggctgtgtagctagtaaaataacagttttggaaaactgggtgatttccttaacagtaatggtagaaaggtacccagtttatgtaaatatgtgaaaggaggcccctctgagtgcttcacaggatgtgggcaacacttattttgccgtcctgtgtatattgccgtgctttccacccatgcttgcccaagcttaagtgatgggaacaatgagagatacaatattcttggcaatatggccatactccaggttttgttcattcagacgtgacctcaagaacatgtcatgcctcagctccaccagtaaggatatatgtggtaactgttgtagataacagagcccccagtgatagaatctggcgtaaatcagcttctatttcactaagagcaggaaaacacaatctgtaactcatacacaggaacgtcctactctggatttatgatggggttcatcaaccctgcatgttttgaagattttttacatttgtaaacagtaactaacctgaattatttcaatgatactctcgtcacttgttctttctctgcccctctttcttaaatgacagttaaagttcttccttaatgctgaaatatatttcataggtaagttatatttcacagataggttcgcttgtgacttggcttttgtatttctaggtacataacattcattgcttgaaaaattgctctgttttaaaatagctactataatttcccttcactgctgtgaaagggtatttttttcatatgtgttcaaaaagcacatgaagaaacatggggttactggagtgtggcataatgagtaatgggctggaaactcagaagctcaaagttctggttttgccactaactcatcctaaaacctagataagctgcttctaatctctctgtgaccccattcctgtttatcataaatggtgttaaacctggctcacctcatagctgtaaaggtagcaaccataagaaagcatatgataatatagatcctttaacaacaacctcttaatcggtgaaggatatctacatctgtatttttcatttgatacttacagtcattctttgggaattactataaaaaagtggtcttcttgttttgctgtttaggcaatcacagcatgtaaacaagacagaaattccatacattttctagtaccgtgtatgtgtgtgtttactgataatgtgtgggtagacaataaacacatattaacatatatacacaccttgaacattgtgattcacaatgagggtacccatctgtgtagtatttttatttttttcatttttatactccaagttcaggtgtacttgctccttagaatttcaacgcattttttctctgtgctaaagccgacctatgatagcctattttcccttgtatcttagaacattttgcttttatcttttactgtgtgaaatataaaattcatatggggaaggctcaagtgcttggtatctggaaagcttgaatccatctggaagctcctcaacactcatgggtaggttagggccattggggtcaagatccaaagagctcgtgagacttcttagaatgatcgtccttcagttgggacaatgattgcctaagtcatcaccttgttgtgagaacacctccactgtcaaggagaagtcagttgttccagtgatggaggtggggtactggtgctgaagtgcaagaggatcgtattacattgacagcagggaacagatggggccaatatcatgaccctaagatgcacagcccacccaatcttttgtctttctctaggttatacagagtgattactgagtattgctaacatgatgggacagtgctgttcagtagaactttctgctggatggagatgctctgtatctgtgctgcccagtgtggtagctacttgtcacacgtggctattgagcacttgaaacacagttggtgtgaatgaggacacgcattttaaatatggaattttaatttttattttaaataatcacctgtgactcctgactgctagacctaaggcgagtctacaaacattatgctacatttctgttatttagaagtcaaattacagtaacatccagggaattttccattaatactatgtgcactcttgagaacatatagggggatgataggaggaggaggtggtgatatatgaaataggaatggaagaaatggcagtttaagcctaagtaagacatggaattgcagtgccaacccatgtaaatggtggtgggttttcagagataaccagaaagtagtgtttcagggtatgactctccttgattttgtttttgcaggttctttcatgctggtgaatgcctctgggagacctgaggggcagagagcccacctgctcttaccccaacttaaagaaaatgacacccactgcatcgattttcactattttgtgtccagcaagagtaattctcctccggggttactcaatgtctacgtgaaggtcaataacgggccactggggaatcctatctggaatatatctggagacccaacacgtacatggaacagggcagaactggccattagtactttctggcctaacttttatcaggtatgtgctttctttttattacatattttgaagcatcctctaatttctaaaaatataaattattgttatatcattataatcagaaaaggttgttgtatttttgttggcaaggttgtggagaaaggggaactctcatcctatactgttggtgggattgtaaattagttcagcccctttgtaaagcagcttggatacttctcaaagaactgaacagagacttactgttcaacccagcaatcccattactgggtatataaccaaaggaaaatcaattacatgagttcaggtgtttttttggtagaatgtttatcacagcacaattcataatagcaaagacatggaatccacctaggtgtccatcagtggtggactggattaaaaaaaacatggtacatacacaccatggaatagtgtgcagccataaaaaagaatgaaatcatgtctttagcagcaactggaagccattatcccaagcgaattaatgcaaaaacagaaaaccaaatgctgcatgtttttacttataagtaggagctaagcactgggtgcacatggacataaagatgggaatagtagacactagagaatacaaaaaggaggggagcaagggtggaaaaactaacttttgggtgctgtgctcactacctgggtgacgggattaatcatacctccaaacctcagaatcatgcagtttacccaggtaacaaacctgcacctgttcctcctgaatctgcaatttaaataaatgaataaataaataaataaatttttataacagtgcaagaaaaacctatgctatttgataaggagtgtcttaaggctttgtcaaattagtaaaaaatacaattcaaaatttgtttatgcctggcatgtattgttttaagaaaataaaagcagtcacttgtaggagggcaagaaatgctatgtacggggtttgcaaatatattttcttttctttctttttttttttttttttttttgagactgggactcgttccatcacccgggctggagtacagtgttgtgatcacaattcactccagcctcaaactcctgggctcaagtgattctcccacctcagcctcccaagtagctggaactatagacatatgccacctgtcgggctaattttttatattttttttgtagagacagggccttgctatgttgcccaggctggtctcaaacttctggtcgcaggtgatcctgccaccctagcctcccagagtgctagaattacaggcatgagccattgtgcccagctggatattttagtttctatattaagtaggccatatgtgacgcagaaaggcatagcacctgagtctaaaagaagacaccctctgcaaatgggtctcaggagtaaatgagatgagccctgtggagacgagccagtgaggggcaggtccctgcttctacccatgtaagcaacaggaagaaagtaccagatgtagatggagtccttgtcacagaggcactgccacaagacctgtcctgttattttgggggctctgtggagacctgcagtaactgctttgagttcctgtttaaagtaactgaagggcggaggcccatggacattcagaagtggtaccaaagcagttctgacgtcacgtcctgtctgcccttctgtgggggattcctgtgacacaagagcatcctaacttaggatcaaagtgggaaattagtgacaatgggcatttggagagctttttcttttttgtccacagcatcttttaaaaataacagtattgaaaatactcaattaatggccaactacgaggaggaataaagaggattgcaatattttgcttttctctttctttaattcctttggctcagacaggagccagctggaacatgcatctaagatcatttttcatgtttaattgaggtgcttggctagacatagggaagggaaagctagggctttccagggctgcttgtcttcaaaatgggcgtgaacagcatccagtaatccattctgcagctttggtgtttatgagttaagatccatcaaccccaatttctctctccctggactgatgaataaatgggctgtaaatttcttgcttaatttatctttgtaggcatatacctacaacaatttctaggatttaatgagtgacaagtaaatgtgttgtttttttttaatggaaatgaagacatagggaaagctctgtgagtacacgtgtaaattgttaagatctttttagagtatgtactttggcagtaagttttaaaattgttaaaaaatttagatatgcttaaatctagcagtccactattaggaatttatcctaaagaagtaatgaagagtgattgcaaataattaactactgggatattcatagcagcttatttatagtaaagaaaaatcagaaacagtatttttccaacaatagaggatttgttaatttatgctacctcaatacaaaaatttattttgcagccattaagaataatgttatggaagaaaatttaatgatacatttaaggttatgttgttaaatggattaaacaggtataaagcaatacattaaattctatttttaagtttaaaaaatctaataaagactgaaatatatcctgaaataaatacttaagaaagtggtatcttggcagggcacagcggctcaagcctgtaatcccagcactttgggaggccgaggtgggaggatcacctgggtccaggagtttaagaccagcctgggcaacatggcgaaatccagtgtctccaaaaaaaaaaaaaaacaacaaaattagcaggacatggtggcgtgtgcctgtagttgcagctactcaggaggctgaggctggaagatcgcttgagcctgggaggtcgaggcttcagtgagccgtggtcatgccactgcactccagcctgggtgacagagtgagaccttgcctcaagaaaaaaaataaaaataaggaaaaaagaaagcagaatctctctagctagtgggataacaggtaaattttttttttttggccatctgttatattctcagttttccccaacgtacatgtactgtttttatttataaaacaaaaagtaaaaatttgtttttcctccagaaggaaaatatctttttaataaacacatgctttttatataaatgtactggtgaccaatcagtagtttaaagcatatggcctctgggacaaaacttaggaaatgcgtttcatagggttaaaaagcaagtgggtggccgggcgcaatggctcgtgcctttagtcctagcactttgggaggctgaggcaggtaggcaggtggattgcttgaggtcacgagttcaggaccagcctggtcaacatggtgaaaccccatctttactaaaaatacaaaaattagctgggcatggtggtgcgtgcccgtagtcccagccacttgggaggctgaggcacaagaatcccttcaaccagggaggcggagtttgcagtgagctgacattgtgccactgcactccagcctgggagacagaacgagaccctgtctcaaaaaaggaaaaaaaaagaaaggcaatcagtagaactgggtttggccaagctaggcctccagaggtttttgtatggtggcctaggctgagaagctgaatgtgattaaaaaccttcttttggaggagcctttcccaaagtagggaagacagggatctggaatgttcccactgcccctctgggacctattctaggttcttcctcagtctccagttgtctgctggattgaggccagtggacagcactcctagttgatatcagaaggtatgtcctgctcatgttttccctgagtttcttctcttgggccttagcagtgtccacacaaaacctctagaatgggctttcttgagaccatcacagcctccagagccacagtgtgctggtttagcgtggccttggctgcagtcagacgtggaatttctgttttgccttttatgtccctacctcagtcagctgcattaaaggaatgatgcggtttatgaacagtcttggaagaccagactttaaaaaggaactgttaaactacattgagagtaagatggtcccatatatttcaggccattgtcattttcagtgaattcttacttatcttgagcacctttggataacatatttcaccttcccaattgtgaacttttctgctcctaacctttaagccctctcacttttcactgtcatcactcacactttactgagcagtaaatgatttgccaaattaagttagaagttttttctcatagctttttggttcatttttgaatgtattgcttcattgatatcttagtctgctgtgctgcagtaacaaaataccacaggactgtacggcttaaacaacagacaatatttctcacatttctagtttgagaagtccaagatcagggtgccagcatcgtccgattctggtgaaagttctcttcctggtttgcagatggtcatcttctttctgtgtcctcacacagttagggggaggtcagggaagcaagagctctcacgcctctcttcttatgaaggtctactcccatcatgagggctgtcccctcgtcaccccatcgcctccccaaggcccacctcctaataccaccatttttgggattagggtttcagcgtgaacttggggagtacacaaacattcagttcatagcactgatagattcattaggaatagcttcatactttgaatttaaagatggatttgtagagattctttaatacagtgttgctaagtttttatttttttgttgttgggaaaatttttattttaaaatggaaatggaaatatacaggaaaagcttgtgctttccttttttttctttgcataaacaataataatgcaatccaggtcaaagcacaaggcagaaacttgagaaaagaacagttattacaagtacatggtcttcttttcaaatatccatgaaaacgtttaacgactggatggctaggtacctacagaaagctccaaagcagtaatctggccttttagtttcaacaggactattttgaatcttagatttatcagtcactcctttcccattctacttgttctaagaattaagtatataatgaaaataaaaagcccacatcctgactttaaatctccactctcctaaaaacctgtttgaggaaacaaaaatggggaagaagaagatcagagcaaaaatattgttaacactggccgccctcatgcaggtgggctactaccaactcctgatgaacatctgtaaagagtatagatctactgaaaacccacttgtttgtttaattcctgagcacttccagcaagcatcggccttggaacttttaaagacagagttaaggtagcacttccttattatttcccctttatctgctgggcagtaaacaaattgaaatcattgccctaatagcaatataaactattaggtaaatggcacattgtagatgcggcaagagaaatgtcagcaggaaacttcccagacactgaactgcaggccttaaaatcgctatgtaagacctgaatgaggtttcccagttgggttaagaaggacaggccgtattcacagatacaaagtaaaaggaagacacctaccaaatccaattttcacccctggcctgaggtgtcagcctaattagagatggtcagaagaaaagcctggacaaaaaacaaaacaaacaaacaaacaaaaaaacaataagctctgaagttgagccaggggaggggcttccttgggctgcagatccagtccctagtccatggggccagcacacgtgtaccgaggagatgcctgttgtagtctgatgctctcagaaatacaagtcatgcaagagcccgtctgcttttgatatgatttcccatatagatttctttataaggagttctgtactggcctgaaaatgtgactctggtttttgactattatatttctgattccaaaatataaaaaatatattttccaagccaggcatggtggctcacgcctgtaatcccagcactttgggaggctgaggcaggcggatcatgaggtcaggagatcgagaccagcctggctaacacggtgaaaccccgtctctactaaaaaacacaaaaaattagcgggcgtggtggcgggcacctgtagtcccagctactcgggaggctgaggcaggagaatggcgtgaacctggcaggcagagcttgcagtgagccgagattgcgccactgcactccagcctagggggcagagcaagactccgtctcaggaaaaatatatatatatatatattttttaatattttttttccagtattatgtgtgcatggatacatgtgtgtaacattttcttatgtgaacatggtgcataaaactcaatatccaagtgatgcattctcaggctgtttctaggcctgaaagctgaagacaagataataggatatgggcatctaaaggaggtgacacctttgagaagccctctctcaaggtacaggaagtcagcttcctctagacaccacctctacaattattacgtaggctgcaggatatattctagaattctaaaatattaatataagtttcatgtatacttgaaatatttatgtgttaaaatacttcatgcagtactttatttctataagcaaatttcacactagtaagtagttttgatatgagtgaaaattgattaatgaattcttttaaaggaatttcatattataaattgtttgcacatgggcagcatcagaggacagtaaaagaacatacactttgtgttacaaagaatgggatttgaatatcagccctgcttacttagaagcttgggcaactgatttaaactttatgagcctcactttcctaattacagcggggtggggggtagtgattaggggtaattaggggttggagatgaaaggaaaagcacattggggatatgctagcctcttaagaagcggtggcagtttgttgagccactgttaagatttgtggaagatggtaaaaagagggaaccagttaatagttgatgctttctccctgctaaggcgcttcctaaatgtgtttagtggaatgtcaaaaggtgttaaatgaaaaagggttccaggaacaaatccttttgtggaacactgcatgagacaaagtgaaccaagttcccttctgtcagaacattccagacctgctgtcatacagcactgcaaggtgaggttctgtgagggtccgtgcagttctcccttccctggacttgtttgactgcatctcaaggaccaggtgcccttgggttgtattcagggaccgctgtgttgggctcttcagttggctatttcccatgaccttctgtgccttcttccagaacgtccatttctcacttcgctttggctacaaaatactgagttaattttcatcttgatcagcatctgaactctgcaattgttggactaggcaaagttttcaggcaatctagacacaagtgtcctgtgtacttttgataaccataataggtcttttggggcatctcttactttcacagttttttcctctagctttaatattgacattgttagacatttatagaattttgaaaagtttcttagcagagtaaagtgttcttgccacagtagtcattttgtgtagtttttactatttatggtagaatagtatgctacaggtacacatcacaatggtaacctgcatggaatacagctaatcgcaggttaattactgttccttaaaacataaattgccaagtatttagtgattaacacatatttaattccttaattaatgtttttcctaattgcttctgtgttgacctgccctcctatggttgggaagcagtggggaagggcaggtacctgccatcctcagggcacctgcctcctttgatttagacattgattttttgccatttgaagaataatattttcctcatgtactcgcccttttgctttattgtgctgataaaaaaaaagaactctgctttgattctgcacccccgcctcctgtttcccacccctacaccctgaggcaaaggagctagccacagatttcgtcatattctaatcatgcatgcaccccagaagcctcagctcctacccagaatttcagccttcctctctgctttcagaagacagtgattttgagcccagtcagaggccagggaggcagtgatctttgatataaatggttgctttaaaaagagaaacaatgcataggtagctgaaaatctccttcccccatgggtctccataaagaagtggggctggggagggtgggcatggactatagggaatgggaggataaagttatcaaatatgagagccttgtgggttcacgagagcctccttgttaaaacaaatgccttagatatactgaagggtcctgggagaagattaggtgtggattcagcttgcgccctgcttggagttctttgtgcagcaaggactcaaaggaacttgtactggggagaggggcactaaaccaagattcacccttatcagtctgacatctttcctggtaaaagaggagttgagggaatagggatgacttgatcttacctatcttttcacattttgctgcaaactttattcccctgcacagctagctcggtgcctgtttctttgctgtatttgccttcagcccactgattttactacaaagccatgtaaagccacagctaagtgacagcaggcccgcatacatttgctgcctagagacagtgttttagagttgaattggtgagtcttttctagattgtgttccacaaatccagggaatgttaggaggcattaattgaccaaatggaaagaagcactgggttaaacaaagtagaactgcttcgttctgcaggccatttcggaggctaggagtgtttttgaatctccgggaaggacacatggtgagtgtgggtgcccagctggagccagaatttgggctttgctgagtatttcttgagtctagtgttccctgaagtacacttgggaatactgatatgtgccagttgaaaaatagaacatactttgactccataaattccttggctatggcccttattccaagtgcaagacaattgaattgcttcatgcctctagaggatgtggggaatttgctgtggcagtgaaatatcactctctctcaagcaggaaagctagtctagtaggtgccgcaatactctgcattttgtgcttaaaaaagacaatatgtctcaagaagccactggggacacagtaggttgtcagtttaatattgacttagaactgtatttaggaagtagaacaatttgcgtgattgttttcaccctcaaagatcttatttttgattattttttaaaacttgccacatctctaaatttcattcttaacttgtacttcttatgtgatgataaaggataagtacttctattgtttaccatcttaatctctgcgtggtctgccgctatatgcatatcaaccctgttctttatgacttctaagccatgtttttgtcctctaccttaatttctgtgcacggcctcttgaatgagtatatgacctatgattatatcatacttttctctaaagggaaggaggaaacaaagagaaaagtgaggaaggttgtgttattggtaggaaaaacaggtgaagacatttaaaaataacattgcaagcactaataattagctccattgcaaattttgctgtcttttgagtgcctttagctttctcaaagtagatttttattttattttctgataacatgtcaatacaaacacaaatgcttgaatattttgctcctgattcttaatgtgacatgttttgtggttttgcctggactctttaatattaaagaaactttactgtatatgttttatttttatgtaactcatttgacacaaacaagataaagtttttgtaaatgggtgtgacccacctttgcattttatttaaatcaaaaccagaaggatagactaggtaatgtgtgggagaaccaacgtttaatcccctttgttctagggaactgactaatgacttccaccagcacattttccttggtgagtatctgtgttggtaagcaaatccctttctttgcttacacatagcaaggaaaagtggcagcatggaaagctaattttgctcttcactgaagcggggaggatcagggaggctgtggtgttaaactgcttctgcatttctcctgtttggcagacatctgaaggatagcctgatgtcaaacctctcagaggccagtatccaggatggattttcatgagcaaatgagagcaatagtcagtttaaacaactggtttaaccagttgtttcctctctgaaagcaaatggcttttcccacagtctccaaaggctatagggatacaacatcttgtctcctgaaatgctattagttgagattgaatgaatattgattctctctattctacattttcttacatcccagggctgcaaatatctgggcgttatcagcaaaacagtgaaatggagactcagagtgaaccacatcacatgaatagagttgattctcgattatttgcagcagttatgttctgtaaaattacagagaacactgaattagtgaatactgaactacttctataggaaatatggggttaggttcctgtgagcctttggtcacaatgtttttgtaatgtttttgtctactgatcaataccggatgccgtatgtaatttatgttgttgattcattaactttgaacctatggcaaaggccagtaccactgtaactcatgctgactggagcgcttctaacatgtgtattttttccttaaggctcatcttagcgtccttgcactctcaggagcactagacagccctgaagcactatatttgggttcattttaaaaagcaacgttaccaaaaagaagcacaaaaatggaaaagcatggcactaactagaccacgataaggatactcttttatagtatcagagctgaaacaaggcgacagaacattgccctgcctgacttcagctaggaacatgtgtgttgagcaactcacattttttgctgctctgtgcatgtccgcagataccatgaaagctttgcaagtattgatttttgggggttacaaataaattttagggagtagcaaattcacaaatatgagccttgaataatgaggattgactgtattttctgtcaagccaagtcaaaaaaactaagttctgtgttgtgacaaaattatttcataataagataaggtgactctgtgattctgtcagacccacaacttttaaaataatcacaatttagattgggctaaagggcaaaaacatttttcctaaaaatgtttgtttcagtaaaaacaacaaacaaaaaccatttagtccaaatttagctaacaccaaagaagatggtataaaatgagatcttagggtaggttttaatattaaagtgttactaattctcagtagtttacagtgtctttatagaagatttttgacttctaaatgagttaggttttattttattttatttttaatttttctgatattttgaggcctatgaagtaattaatttttctggctttgttttggtatattgcaaatatgtattttaaaaatttgataatgatattacaaacttaagtgggtatttagaaaaccacacatgtgatataattgaaaacaagtcaagccagggacagggtcttcttctcattgctagaatgtgaggctcccccatggagcgcaaggcatattgtatttggctgtgataaagtattgcttttgacatgtgctttcttgttaatcagagtattgatggtgcattggtgagccaagcaggaaagttttctctaaaaacaggaggctagatagtaaatatttcaggctttacagtccaaacgctgtctgtggcagctactcaactctgctgctgttgtatgaaagcagccatagccaagatgtaaatgaataaacgtggctttgttccaataaaactttattcatggacattgaaatctgaatttcatataattctcttgtatcacaaaatattcttctttctgttttctcccaccagtgaaaactataaaaaccatctttagcttgtgagcgatataaaaacaggtggtgggacagatttggccgtgggctgtagtttgccaactcttgtattaaacttgatgctgtcaaaactatgccgtatcagtcttcccaattgctatatttcttataaatctggatgtaaaaattttagaacctgtgtatctatacattaaaaggtgtgtgtgtgtgtgtgtatatatatgtatgtaaaggtattctatatacatatagtgtctcatacttgctagttaggcagtttggcaacatgaaaagagtccagacttggaagcaaaatagatctaggattagacccaaatctgtaactacttgtgtgaactcagaaaaattacttaacctttctaagtcatcttatccctgaaagggagctaatatgacctacctcacataattgatgggggaaaattagataatatatgcaaaggatacctgggacatggaagtatacaaataaatagttttttttgaattactaaattattctttttgaagaaaaacttggtacatggctccataagaaattcaaaccttctaatatagaatattttcaatatattttgttccgtttcataaaaatgaacatggcacatccccagatcaatttcttacacgtttcttttttccttttccaatggtactgttggtattctcatgttactctttcctctgacctcaatctttttcgacccggatgctggcattttcaaacattcctatgattcccactgggttctgcacacacttggtatacttcactagagcaatacctgtacttttcattagagtagttccttatttgacaaaaagagaaaaaagattatttttgcttttgaagccttataagggcactggctagagaggtgtacataatggaaaatttgccagatagccagagttcacaacagtggaaccttgaacagaattccaaaatctgtttataagaaacttgtttaagatgaccctcatcctttgagctgcatgttttttttttcttttttgataacggagtcttactctgtcgccaggctgcagtgcagtggcacaatcttggctcactgcaacctctgcctcccgagttcaagtgattctcttgcctcaggctcccgagtagctgggactacaggcgcccgccaacacgcccggctaatttttgtatttttagtagagacgggtttcaccatgttggccaggatgggctcgatcccttgaccttgtgatccactcaccttggcctcccaaagtgctgggattacaggcatgaaccactgtgcctggcctgagctgcatgttttaatcctcttgtttgttagaaaaaaaacaaagggaaatctctcaatggttgggtgtttaaaataggtaatctcagactactgtatggcatctaaattcagataacttcatttagtcgtatttatttcacaataggaaactctccagtacagctcatacctactttataattgtggtatgtattgaaacagttgcatactaagttgtaaacttgatgaagcagctaataaaacttgtactcaagtcccttaacaagtttctaagaaagaactagaaaatggttttaataaacatagaagttgttgcttcaaacttgtgacacaaatgtatgacataagaaacttttgtttatatattatgtattaattttgtatgtatgtatgggtaggcatgcacacataaacgtatcaacaaagattgcttttctcctatcttgactctgcaattagctttaagtcagtgttggaacctgtcaagtttgagaagtttactttttaaagtttctaattaaactcagagggggcaggaaacatatttgtaatcagctgctgtccttctttgcctcttgatattctagttggaagactgaggggagcaaataaaattgcagatagaagcttgtctctaattcttttttgtggccttgctgacaagtcatcttgctgggaaatatggggcgaattggcttgtttctgagactctctttgcctctagtccacagggatgaaggcagatagttgctgggaaatccatgagttgatactagcaggctgaagctctgtgctgggggttgtgtggctgtggcacaggttccctggcttgtttggaggggaggagtcatggttctgcgtcaggaaaggatcccattgctatgagctgtgtttattgaatctgtcatttggccattgctatcttgttctattctttcatcattcatgtttcttgttttttccctaactaaagcttactttttataaaactgtctgcattgcttagatcttccaaagcatgcggtagatattttataaatatttggactaaaaggctcagaatttcttagcgtaaaacttctgagtcatccattctgtgacgcgatggatgaaaaaacagatctagagaagtctagatggctcttccaggtctcagatcttctctgcctttttttttttttttttgtactctcctttgctttggtaagggtatgaccctgtatagctttaaacaaaacattatggattaaatttacacatacagatcaacttaaaagtagattcacacgagcacgtctcacatgtacactatgttctaaaaggtaatgcattctcttcaaagaataaggataattccatttttagtagaagcttcagacattgtagttgataaagcaaaataaaatttcaatatgaaagatagttttgatgaggaaagatttcttcagctgttctatccatgatatattccaagtgcttatcacagtgcctggcagagaggtggcactcagtagagccttgagttcattgaatgaatgaatgcatggatgaataagagagaagaaggaagagaggatggcaggtgggatgaaggaaggtctgatgaacatttctgcgtttggttttcaaaacacatttttctaaccacagcacccatgctcttgggtagctggtagtggtagcatcagcagccacccctcagctgtccctgcagtagccattgtatcagagcagcttgcaggttcctgcagtgccaactgtagctgtttcctgggaggcaggatgtgactgttattgaggggacctgttttgagggcctcaggaatgctttttcctttacttgctctcaatattcattttccttttgtactctcagttgtcttcttatagactttagtagtagacagataaattagcagggtcccattgcaggaatatccgtgcatatcttcctttctcttgtattgtcagtggaaactatttattaaacttacgaacaggatgaagttttatttcatttctggttttctgttgtgcctttcctctccgctgtgttatatgttattgtaatagtgttgtggcacagtgtcatctagtctagcaagagtttctgggatgtcttctgtccctgtactcttgagcttttccactctgggctctgctgattgctttctccagtttcacatccatcccatacacaaaataatgcaggcctaggatcaaagtttttgtttgagcaatgtgtagaagtgaaaacatcatatttggaatcagaaaaattgagtttaaagattgcatctacgatagactcgttgcatttatggacaattactttgtatctaaagatttcattttttttgaaacatgaaattcttgatttttcgtatgaactaatgagataatggaatgatatcttcctagtgtgtgtaacatatctgcttactaaatgttaacttataattacttttataaattgaaatttttatggaaatcattgtagagtcacatgcagtagtaagaaaaaagatattcttgagtacatgttatgccatttcccagaatgctaacattttacaacactgtagtacaattgccttctgtacaattgtacaaatatgtacaatttgttgtgtacaactttgttacctgaataggcttgtgtatcttccaccacagtgacgatgctaaacaattccaccaacacaaggagtggtggtgatgtccttttgtaagcaaacccatctccctcctgtctcatcttcctccattcctacccctggcaaccactaatttgtcctccatttctagaatcttaacattacaaaatgttacataaatggaatcatagagtacatgatcttcggggagtggtgtttttcactcaccatagctatcgggaagttcacccaagttgttaggtacatcattaatttgctcctttttattgctgagtagtatttaatacagtggatggaccacagtgtattatttacaagttgaaggacatctgggctgtttctgttgtttggctattatgtataaagcttctgtaaatatgatgtgcacagatttttatatgaatgaaagtttacatttctgtgggatgaatctccaagagtgcaatggttaggttgtattttaagacttaccatcatgagtcatggttccccggtgagatagtttcattctgtgtgtaaatggaggtcaaaataacattcatgtggatcttttaaatgatagcctgacaactgacacttttagtcaattaatcagattaagaaaattgataacccttttactggttctttctttctttccttttttttatttttttttattttgttgagactgagttttgctcttgttgcccaggctggagtgcaatggcacaatctcggctcactgcaacctccgcctcccagattcaagcgattctcctgtgtcagcctcctgagtagctgggattacaggcgtatgccaccacgtccacctaatttttgtatttttagtagagttggggtttcaccatattggccagctagtctcaaactcccgacctcaggtgatctgcctgcctcggcctcccaaagtgctgggtttataggcctgagccaccgcgcccagccctggttctttcttttttgccttaatttctctgaagtggctccaccatcttaaaaaactccgccattcttagaacctccaggcatgtaggccttttcctcttctcttgcttctccaattatcaaggaagagctaacgccctcttgattttgccactgtggacatttttatattattttcctcttgattcatagctttattgtctgattttcagttagcatattctcttcactgcattattaataggctatctttcctggtgtctctgtcctgaagtggagtcttctgcagcctggccacagctgacctttgtggcggtaggtcccaattctccccttgaaggccatggtcatgaccacctcagggccttcacatgtgcccaggactgagcctggtcctcttcacactgttagctccttctcatcctgtagctattggcacagatttcacctcctcatgggaggtcctccatgtgtatattcttatagtacactgcactcttctttcattacacttactgtattttttttcacttgtgtaaatcttactaccccacatggtccagtgtggtcagagagttactttcagaaccttcagaaaaggtttagatcacctaaagcaatctgaatcttaacgttgtctcttgagggaaaacaaccacaatccaaatgtgtgtatggcagtgggtttaacatacagtgcaaccttaaaagtcttctttagactttgtttcatgttcaggatctctcacaagctcaaccctggctttgggtggggaatcctttctatctgctgaaactgttggagaggtaaccccaaagcctcttctatcttggtgtccccatcttccacccaagcagcttacccaccaacaagttgccgtctgtgccaactcactatcctgtgagcttccttgcttttcctacagtgtatgtgtcatcccccgcaaccccatgaagtatcctttcactatgggttttctaagttggggttctgtctaacgcattcactacctattgacctccctgaagactggggtggggtcttgcctatctttgtagtctagaacctggaacattgactagcagatgttacgtacatgaatgaatgaattggtgaaagaataaacgaaattatgtgtcttatatataggagatacttggtaaaagtaagacaaaatgaataaataatgtaaatctttcttaattttccaggtgatttttgaagtgataacttctggacatcaaggctatctcgctatcgatgaggtgaaggtgttaggacatccatgtagtaagttgtctttatttgtaaatattcgggtacatcattgggggcatgtttacattatgaatgaagagaagggatgaaaacctgtgaagaggtcatcttgccaagacagttccctgacaggcctgtattgttggtttgccagcccagaaatccaaaagcatgtactttgtgtaaatgccatggtttgtataagtcttttaaaatttggttcaggaatggggaatcaaggaattctttggcatgctcagacatctttgcaaagaacctgtttatttgttgccgtggtctttagaattcgcttttcagtagtagcacaaagttaaatattgagaatctgtgcgttttgtttataagtccagtatgtttttggcacagttccttagtatttatcacatggtttcaggtgatatagctgcaaacaggcctgggatctgtcaaataaaagacacctacctaaaccacctggggaccccagaaatggcctgctcttcatcttttaaaaattaatactttaaaaaagtacaataggtgataaacatacaatttttaaaatttctactatgaacaactaacagtttgtcatatttgtatgtgaacctttttccttaaataaaatagtacaaattgctagatctgtttctccccaaaccctgccccccaggggccaccacagtggtgagctggttgttgcacctgttatggtttctagtctgcacacagcaacagactgtagctgcttgaagcagaaaaggcatcctgttgatagagaattggagggcagtggtattcctgagaacactagtggtctagactcagatgatgagcaggcccccaaagtgaggctacgcaagcagccacagcaaccactatggcaggggagccagctgcgaggacaaggggagctggcgctgtgtctctgtgcaccttacccttggaagatgacccttgcctagacattctgcgctgatttgggccttggcatctttggccttaggtgcaaagccctgagggggatagtcagggtgagcgagctagatcatgcactcattcatgcctggcaattggtgtcactaggaaagtgagttgttggcttttcccactctgtcaagggagctgggcctcaacttttactgagaaacatatagtgctgagcaactgaacaccgcaaatgtgtgtgtgtgtgtgtgtatgcgcatgtgtgtgctctttcccataatccccaagggtttataaaagcaaaaaagtaaggattgccttttataaatgctaatgaatggtttccagccatacaaatttctctgtattctttttttttttttaacttaagtgttagatattttaggtcaatccatggtattctatcatatggatttactacattctatttttctagtattttatgaacatttagtgtttcccacagtttttctctattaaatattgctgcagtgagcattatggatgtgcctactggtgcagtgttgagagcctcagtggagtgtgttcttagaggctgaattgctgggatgtagtgcagagacgttcttagttttattgggtgctgccaaaatgctatgaagtgtctgaaccagtttatattcccaccagcagtgcatggtagctttattttccctgtatctttgttcaaaattgatatcaccagacttcaaatttttggccatctgagggatgataacctgctttatttttaggatctctggcattaaagagaaactggctagttcatatatttcatgggtctttcctgatgaccctatgcaaaattatgaaagaatgattatatctacaataataaaaatggaaatatttgcaggagtggctcagctttttattgcatggatttgaatagaccaccaggaccctctttgttaagctttatagagaagacctgtgtggttgttacctgatgaatgtatcatgacacaggtgttttaattccatctaaaggggttttgctctctctgatatctttatttggtgctttgaagcttgccaaacattgaagttaacataaagcaatcatttgttcattacaaaggcagatgttacttttgtgtcatgttacatttgtcttttcttctgttgtcagcaaaactggggagttcaagaagattccctgtcccctcccatttcatgaaaagactggaaaaccatcaaggctgtacctaattgaaacagcagggtaaatttaggaagcagaatgcaattacctgagctggaactcagccaaatcctcagagtaatagcctccagctagaaaagtgccatgagatcttctaatatgcacaaagttcatggactctgattcacttcttactaggaggttaaaaacataagagctgtaattgcatgcctactaagtgctgagcactctaatgacatagtctgcctccctgtttcttagagcagagctcacggcaaggcagatgtactgggtgcaggtgtggtggctgcagtcaaggttgcacatggctttctattacatatcctgggctccatcttccacatctggccactagccagcataagagctcctgaagtgtagtgccttctattttactggattttagtcattgtgtgcagcaaagacctaaagacttcatgcttatcagtgccttcctaaaacatgtctcaagcaattttgttcttcccataggagagagctttctgtagccatagaaatggtgtttatcttctctcctttggagaatacctgtgctaatacctaattggctttgggaactgctgtgagggcacagaattgcaaaacaggctctgtaccaaggtgatgtatggtacaacagcattgtgaactggaagccttaaatggttttgatgatagctcttccttagcttattttttcctgaatctctaagttaatgggggaagcatgcaaataaagattttaaagaaggcaatagtttgttcttaaaatgaaagctttacaggtaatattttatgagctttcttatcaggatttcataataatgaattattttgaaattttgatgttcattaaatttaaatcctaaaggagcattaatattttatatctaaaactatgctttccaaatggctgcaaaattgctgaatctcatttgctccactgtaaaggctcttgtttggattcatataggtttatgagtaagcattacaacattttttaatattagatattctgatacaagtatatagttgctcataaaattgactttagtgacaataagatgcaagatcagcctgaaatatggagatgactttgcaaaatcagcagctctctagcatatgaccacttctaataaacagataatttttgcatttgatatgcacactaaaaatatatttggaatttggttcaataatcctggtaagaaaagaagcattttattacaatagcttcctaatgttgcctcctgttcttaaatacattatgagctgtgcatatatgggtatttctcttattaccttctggtgctgataatgtatttttatgtcttaaaagccgtatgtaattttaatagatttattgacatatcactgacataatttatccatgtttaaagtgtacaattcagtagtttttagtttattcacagagtatgtacccgcgaccatagtcaaatttaaaatatcttcaacatcccccaaaagacccactacccattaatagtcattctttattttctcttgttactggtggagggtgtccaggttcttggtgtcttgaacaaagaattggacaaaacgcacaaacaaagcaaggaaagaatgaagcaacaaaagcagagatttattgaaaatgaaaaatacactccacagggtgggagctgcccgagcaagtggctcaagatccccatgactgaattttctggggtttaaaataccctctagaggtttcccattggttacttggtgtacaccctgtgtaagtgaagtagtggccgatggtcagtctgattggtcgtgggaggggaccattcagaggctgaagtgaagatacaaagttacaccctctgcaaacatctgattggttgcagaaagtgaccaatcagagactgaagtgaagttacaaagttatactcctataaaatgaaaacttagcccaagaccagcctgactggttgcaggaggggaccagtcagaggtactttcaatttttcatctgccacccagaaaaagttgggggaggcagtgtgcaaaggaagtagtctctggtccttttgtcacttgggtgtggaaagttgggattttccttttgatttagttctaggaagtcagcatgattcggcctcaggttccttgcctctagaccctattctcccgacttactctggccaccactcctagccctaggcaaccattaatttacttgttgttcctgtagatttgcttgttctccatattcatttaaatgcagttgcgctatatgtggccctttgtgtctggcttccttcacttagcgtgtttcaaagttcatccatgttatagtgtatatcaatatttcactccttcttaaaaccaaatagtattttattccatggatataccacattttatgtaagcatgcatcagttgatggacattcaggttgtttcacctttgggctattgggaataatgctgctgtgaacatttgttatcagttctcttgggtatcatgctctcagacatatacttaggagcagaattgctgggtagcatttgaagaactgtgaaattgttttttaaattggctgcaccattttccatttcaaacagcagtgtatgatttcaatttcttcatattcttgcaaatatttatgtctttaaaaaaatcatagccatccttgtgggtttcaggtggcacctgtttgtagtttggattacctaatgactaatgatgttgagcatctttccatgtgccatttatatgtatgtttgggagaaatgtctattcagatcctttccccatttttaattgagttgtttatctttttattattcagttataagaggttttatatatctacatacaaattccttatcagacatatgattcaaaaacatttacccccaatctgtgagttgttttctcattttcttgatggcatccttaacagcacaaagatttaaattttgataaagtccaattttctgttttttctttcatcacttagatacaaaactatttggagttgtagctaataattcttctaagatcacaaagcttttctgtgttttttccagagttttatggtttcaattttttttttttttttttttttttgagatggagtctctctttctcacccaggctggagtgcagtgctgtgatctcggctcactgcaacctccgcctcccacgtttaagtgattctcctgcctcagcctcctgagtagctgtgattacaggtgtctgccaccaagcccagctaattttgtatttttagtagagacgcggtttcaccaatttggccaggctggtctccaactcttgacctcaggtgttctgcctgcctcagcctcccaaagtgctgggattacaggcataagccactgtgcccgtcctatagtttcaattcttacttacaggtctatgagctatttgagttaatatttgtgtatgctgtaagaaagtggtgaaaattcattcttttgcatatggatatgcagttattccagcaccacttgttgacacactgttctttccccattaaattgccttggtacccttgttgaaaattaattaataaatataaagacatttctggaccctcagttctattcagttgatctacatgactattctgctacaagtatgatactattttgattactgtaactttttagtaaattttgaaatttggatcagtgggtcttccaagtttgttcttttctcattattgttttggctattctgaatcctttgtactttcttttctttttgagacagagtctcactctgttgcccaggctggagtgcagtggcactatctcggctcactgcaagctccgcctaccgggttcatgccattctcctgcctcagcctctcgagtagttgggactacaggcacccgccaccacgcccggctaattttttttttttttgtatttttagtagagatggcgtttcacagtgttagccaggatggtctcgatctcgtgacctcgtgatccgcccgcctcagcctcccaaagtgctgggattacaggcatgagccactgcgcccagccaatcccttgtactttcaaatgaatttgagaatcagcttatcaatttcagccaaaaaaattcagctgggatattgatagggattgtgttgaatctgtagactggtttgggtgaggggttattgctatcttaacattatcaggctttgtgatctgtgaatgtgggatgtctttccttttattgaagtcttttaaaatttcctttaatagtgtttgtggttttcagagtacaagttctgttcttcatttgttaaatttattcctaagtattttattttgaagttgttttaagtagaattgttttcttaattttatttttcgattgttcatttctcgcttgtagaaatgcagttgattttgtttattgatcttgtatcccgagatcttgatgaacttgcttattagctctaattggttttttggtggatccataggattttctgtatgcaaaattgtgtcatcttcaagtaggttttccagattcctctttttccaacccaggtgaattttattatttttcttgctagtttgccatggctaaaacctccagtacaatgttgaatagaagcaaaaagaacagaactgcttgtcttgttcctcatcttaggaggaaagctttcagtcttttagcatgatgttggctgtggtgttttgtaaatgcttgtttttaggaagaaagttcctttttcttcctagtttgttggatgtttttatcaagaaatgctgttgggttttagcaaatcctttttctctatcagattattatgtggtttccatcctatattctggcatattatattgattgattttgggatgttaaaacaacctagcagtcctggaacacatctcacttaggcatggtgtataatcttttttaatatgttggcatgtagtaatgaaacattatacgaagttactgggatatatgatgccttcaattctgaaatcttaaaattatacagaatcatgccccattattttgatgccaatttaaaaacaaaataatacagtaaaaaagagataaagcccttctaaacccatgtgctgtatattggataaattgaatacaaaatccaagactgtcctgtattattacttgggcaatagaaaataagtcagcaatttctttaaatattaaagtttataatatggcctcctaaattcaaaattattcttattttttaaaatagtattttccttattaatttgtgtagtcacacattgcttaccactcccaaatttagattttttaatgaagatttattaaatagtgtgattgaaataagaataacagtgacaaagcacaaattagaattgttttcggaattatgttctgctgaataaagacagattcatgtgctttggttgagagatgtgtgggactcagaattgacctttcattttaaacatgtgggaacacaatttggacttttctctaaaggaatatcattcttcttaagatagagtcgacttctaaaagttatttatatgtagtggctaccttagttttctctgataagaatgttgaatctgtttttccacttgaaaaattatttcattaaagcctattcttacctttcaaggaaaacaaaactgactttgacctgaaacatgttaagagaaattttctgcttctatcacaggaattacttggctttttttggacctataatctcatttgtataagaagaaaataataatgtttttctcactgagtaaatatagggattacattagttaatgtacatatagaatttatcacaatgcttaccacattctaagaatttaattaatgttaactattattattattaggcactacattgtgatagacttgctagaattagttagctgctaatggtaaacctctaaatagctaaaatgattgatatgctagatggggaagtttaattgtatgtccatcgttaaattccaaaaatgtttgcaaaatatattggttctcagcgttagagtaagcagtaccaggctgttctttttggcagcaatttgcttccttgtttgtgatgatatgttacacaaatagagagaaatattaactatttttattctggtggttgggcatgcatcccgtacatttcaacctatgccattacattaaaatgtaagttaaagcaaaagggggttaggacatagtcctcttgttccacttcagtttgcactttgatctcacaaattactcttctctgattttgttgctagtatttgtatgcagactctgaagaatcaataataatgaaacatctacaaaacgatttgtatcttggtcaatgataattcttggctttgggatcaaaggcttatttgagatcaattaatacacgaaaacctctattctttcttagtaagaagaaacagaatatggaagcgatgagaggataggagggttgtactaagaacatgtttgttattcatggaagatatttagtttttaaatctcctacaggttttagaagaaagctggcatagcattttgaaagggtatccaggagacaagtgggcctgtaaatttggagagagagagagaatgtttctttttgaatatgagatagattgaaatttctgttctaaaggtggtatacacctgatgttacaattaaagtagtatggcaagattcagagcatacagctcagcatgggatctacacttttctggccatagagctctttttcttgggctcttttccaggttccagtgatagatcagttattttaaatagtaaggaacatttttgtgggctaagtatgaggcacagagaacaccttggcttcatcaacttgtttattctttatatcaacactgcgaaataggtacttttaaaaaatctctattttacaaataaaaaaattttgtgaagatttaggtttaagaatttttgcatatattcggagataataaaggactgaaggaagtactgatgcttgaacacaaatgtgctgaaatccaaatcttaaaatagtatcagcctaagctgcttgccacctgaaaatggttgtaggatttatagcactaaacaaggggaatctaggcatcttaaaagcttggaagattatataagcctttaatatttactgaaaaaatttacaccattagcagaaagtttgactttcatgttcttggagaaatctgatctcacagtcattttgttaagtgaaataacttagaaacagaaaaacaaaaactacacgttttcacttacaagtgggagctaaacagtgtgtatatatggacataaaagaataatagacattggagaccctgaaaggtgggacggggaaagaggtgagtgatgagaaattacctatggtgaataatgtacacaattcaggtgatgggtacactaaaaatccagacttcattgctatgcagtatatccaaggaacaaaactgcacttggatcccttaaatccattaagatacaaaactttaaaagaaagtgatattccaaaactgggcgtaccatagatgaacacacctttagcagaaccagcgacaattctcatattcacattatttttttaactcttataacgtttgctgatagagtgtatgcattttataactttctcaagaaagattatagaagttagtacttattgtattttttagaataaacagcagaaatatacttcttacagttctggagcctggaagtctgagatcagggtgccaacacggtcaggttatggtgaggaccctcttctgggttgcagacttccatcttttttgttgtgtcctcacatggcagacagagggggaaagagctgagtccttttcttttttaaaaaaaatgttattttattttaaataataaaaacaaaaaataaatcgacacataattgtacatacctatgaggtatagagtgatattttgaaacatgtatacaatgtataatgatcaagtcaggattaattagcttatcacctcaaacatttatcatttttttgtgctgggaacattccatatcctctcttctattaataggtatttgcaaatataccagaaattattgttaattatagtcaccctacagtactgtaaaacactgtaactttattaatacttatatctaactgtaattttgttttcattagccaacatgttgtccctctacgccctacctttcctatcccttagtaaccactcttgacttctgagatcaactttatgatctctcttacatgagtgagaatgtggtatttgtccttctgtgcctggcttttatcacttaacatcatgtatgtactctaggcacatccatgctgcagcaaatgacaaggtacttttgaaaaggtggtgaaaaagctccttcataccctgatggtaaaaatgtgaattgttataagcttttatggaaagcagtttgacaatttatgtcaaatgtcttttaaaatgtgtgttttaaaaattatctttggccaggtgcggtggctcacgcctgtaatcccagcactttgggaggccaaggcaggcggatcacgaggtcaggagatcgtgaccatcctggctaacatagtgaaaccccatctctactaaaaatacaaaaaacaattagccaggcgtggtggcaggcgcctgtagtcccagctactcaggaggctgaggcaggagaatggcgtgaacctgggaggcggaggttgcagtgagcccagctcgcgccactgtactccagcctgggcgacagagtgagactctgtctaaaaaaatatatacttttttattgatacataatataagtgcatatttgggggtacatgtgataatttaatacatgtatacaatttgtaaaaatggaagcagtgtaactgggatatccatcaccttaactattgtctttatgctagaaaaatttgaattgttactatcttctagatattttgaaatatacagtagattttgcaaactgtggtcaccctgttgatcttcaagcactaagttttatttctaataagtgtatatttgtacccattaatcaactgctcttaattctgcacccccactccccctatccatcccagcctttggtaaccattaatctactctctatcttcatgagatccactattttagctccaacataagagtgagaatatgttctatttgtttttctgtgcttggcttatttcacttaacataaggccttccagtaccatccttgttgctgcaaatgacaggatttcatgcttttttgtggctgaataatattccataatgtaatatgagatattgtgttcttgtgtgtttgtgtgtgtgtgtgtgtgtgtgtgtgtatgtgtattacattttctttatttacttatttattgatggacacttaggatgactccatattttggcaattatgaatagtgctgcaataaacataggagtgcagatatctttttgatatattgatttcctttcttttggatatataccaagtagtggaattgctggatcttatggtagttctatgtttagtttttgagaaacctcaatgcagtttttcataggggctgtactaatttatattcccaccaacactgtacaagggttcccctttctccacatgctcaccagtatccgttactccctgtcattttgataaaagccatcataagtggagtaatgtgatagctcatttttgttttgacttgcatttctctgatgattagtgaggttgaacattttttttcctgtacctgttggcaattttcatgtcttatgagaaaattaattagaggctcttacttaacaacagaatgggtcaagcagaggaaagaatcagtgaatctgaagacagctacttgaatgtccagttttaaattggactatttgtatttttgcttgagttatttgagcttcttgtatattctgatgattagtcctctgtcaaatggatagtttgcaagtattttctcccattccatgggctcccttcactttgttgattgtttcctttgctgtgtagaagctttttagcttaatgtagtcccatttgtctgtttttgttttggttgctcttgaggtcttacacaaaaattctttgcccagaccaatgttctggaatgtttcaccagtgttttcttttagtagtttcatagcttcaggtcctagatttaaatctttgggtctattttgatttgacttctgtagatgtcgaaacagaggaggctagtttcctttttctgcatattgttctcctgttttcccagcagcagttattgaagagactgtcctttcttcgttgtatactcttagcacctttgtcaaagacaagttggctacaaatgcgtagatttattactgggttctctgttctgttgcattgatctatgtgtctgtttttatgctggtaccatgctgttttggttactaaagctttatactacattttgaaatcaggtagtatatgatgcctccagcttttttctttttgctcaggcttgctttggctatttggaatattttctggttccatataaattttagcattatattttctatttctgttaagaatggcattgatattttgatagggattccattgaatttgtaatttttgagtagtattgtcattttaaaaattattgaaacaaatcataacagaaatacaacatacctaaacctatgggattttcctcttaatttcttcgattggttgttcactagcatgtttttaaatttccacgtatttgcgtatttactgaggttccttttgttactgatttctagttttattccattgaggtcagaaaagatacttcatattatttctacttttttaaatttgttgagacctgttttctggcctaagatatgttctgttctggataattttgtatgtactaatgaaaagaaagtgtattccatagcatttgggtgaaatgttctatagacgtcagttatgactatttggtgtagcgtgtagtttaactttaatgtttctttgttgactttctgtctgaatgattggtctgttgatgttccctgctatgactgtattacagtttatctctctctttagatctatgtttgctttatatacttgggagctctggtgttgggtgtataatatttataattgttttatcctcttaaccaatccctttatcattatataattaccatttttgtttttacagtctttgatttgcaccctattttatctgaaataaacatagatactcctcctctttttttgttttccagttagatggagtatctttttctacccacttcactttgtcttacctatgtgagtgcctttatagttgaggtggatttcttgtaggaagaatttaattgtgtcttggttttttatatgttcagcctctctatgccttttaattggataatttgctccatttacattcaatgtcattattaagtaaagacttactactgccattttgttgcttaatttctggttgttttgtagctcttctctttcttcctttcttactactttgtagttaaatgattttctctggtcacgtgttttaatttgttgtttttcatatgtaatgaatctattataggtttttgcattgttgttacaattaggcttataaaacatatcttatagatataagttatcttaaagagatgacaacttatctttgatgacaaataaaaggacagaaaaatgaaaaaaatgcttttatgctttaactccatccccctcacattttgaatttatgttgtttcagtttgcgtgtttttatacggcctatctcttaacaggttaccatacctattactgtttttgatagatttgtcttttgggcttcacaatacttacgaatagattgcacaccacagctgcagtgttagaatattctggatttgtctgtatattaatattatccgtgggttttatatacttttacatgttttcttgttgcacattagtgtttttttcctttcagattgaagaattccctttagcctttcttgtaagatagatctaatagtgatgaattttctcaacttttgtttgtctgggaaagactttatctgacctttatttttctgtggatagctttagtggctgcagtattcttggatggcaatttaaaaaaaatttccacactttgaaaatgtcttcttatacactcctgttttcattgagttctgttgccatatgaaccctgattcctttatatgttatttgcttcttttctcttgctacttttaggatactctctttgtctttgacctttgagagtctaatcattatatcttttggggtagccttatttgagttgaatctgtttggtgttctctgaactttctgtccctggatatttatctctttcatgttttggaaagttttctgtaataggtaagctttttgccccttgctgttgctcaactacctcttgagcaccaataattcttaaatttgatattttgaggtatttttcagtattttgtagataatctttttccttttcatttttttctttttgcctctctggctgtaaattttcaaatagctgtcttcaaattcactgattgtttcctctgcttgacccattctgttgttaagagcctctaatgaatttttttttttttttttgagacagagtcttgctctgtcgcccaggctggagtgcagtggcgcaaccttggctcactgcaagctttgcctcccgggtacatgccattctcctgcctcagcctcctgagtagccgggactacaggcgcctgccaccacgcccatctaattttttgtatttttaatagagacagggtttcactgtgttagccaggatggtctctaactcctggcctcatgatctgccctcctcggcctctcaaagtgctgggattacaggcgtgagccaccgcacccggcctctaatgaattttttaattcagcaaatgtatttcttagtttcaagatttctgtttttttttgtttgtttgtttctctgataagtttctgaattgcttttctgtggcttcttagagatcagtgaatttccttaaaatggctattttgagtttttggttataaagtttacatatcaccatcttgttcaagtcagtcactggttccttgctttgtccatttgtagaagctgtggttcctcatttgtttttgtttcttgtggatgtatgtctatgtctttgcattgaagggttggttatttattccagtcttcccagtctggcttgttttgttttttattggacatttttgcttagagcttctttgtaatttacctgttgatttccctttttttcctctgctaggttactgcctaatttttggcactagatgacaccttaagccaaagtttgcctcagttatggtaaacaatgagagtgctactttccctgaatttgagaggtcccaaaagggatataccagtagtgtgggaaggctggctaagggtttgtgcagaaaggatgaacaattctcctacagtgaggtgctgcttaacagccactctgatttggcatccctttggccaagttacagagaaagtttctaatgctggggtggcagtcctgctgccccgtacctttttctctgtccttagggatatttctcccttcaggcactttcgatgtttccattgggttggggaagggacagatttcctgccaggcaatccacaatagtggggaaattgtttacccactttgacctcattttttccaatgtagaaattatgagtcagaggaaattttccggttactttctgctgggcagattgggggttggggtttcacagatattgaagtctggttttcttccctctgctcagaaatttttcatgtctctggctcctggaatagtctcatcctcatatttgagttcttgggtattgctggtgataatctctgtgctgtatatttatttattttttgtgggagtgagtgaagccaacttgcttctatgccaccatttcagaactggcaaaaatgcatgtattttttaattagtaatttctaatagtttaacttataaaaaaaaggttttaattatgaaaacttttatcttagcattatatgtagtggaaacaaacctcagtgttcaataatgggggatgtttccgtaaacttgtttatgtatgatatgtattagggtttcttaaccttggtgctattgagattttggcacccgctaattttttgttgtgggggctatcctgcacattttagcagtgtctctagcctctgctttctgggtgccaatagcactgccttttagtagcataattctgctgcgagacaccaggagtcattactgaaaatatttaacaacccttcagcacaggctcagaactgaccagcttaactgagcggggtaaaatttagaatagtggccgcaagtgcaatacccctttaacccaagttatcctgagaaatggctacatacccagacaccttgtgttagagacctagcttgctgtagtaacctgtagctgggggagagcaggattaggtgtctgggaaatccactggagagaccagcaccagggagagaacctgttgttctgagtgtgccagataacttcagcctttaacactccacagggagatggaaggcggcgggggttggtcaacatgtggaatgaggcttcaaggcattgtcctgagatattattggaaggaaaacttttccttttctgatttgggtccagtggttggggacctgcagattaactgacaagagacagattaattgaagaaaagacaaagtttattttcacaggacagagttcccagcaatggaaaacccactaaataaccagagataaaggtttatattccaaatttaacaaaagattggggagtggttttagggcttcagtgggaaaatgtagaaagttctatcaggctttttgatggtaatggcaacaggcagtttgtctacctgggagctgaattagacaactcccttacaggggagttaatggcaactattttttctgggaaagctctgttttagtcaactacttgaagttcagataagatttctttctgcatcttcttttgctcaaatgttttcactttaaaataatctgtataccaactctggggatctgaatgggtccccgtattttccctatgtagaagttccttcaaaaaaagaaagtgggttgattgctgcgcagagacatttgtgttataaattgcaaggtaagagatctataaaagagagcgaatttagattagaacaaggaaacaaaaagaaaccaaagaataatggttggagcaaactataaactcagattctgagtccagaaggcagccagttgtgatttccgggtgttggatttgaagcgtcttcagtgatgatagtagtgtcacagccacggttactccctggagcagaatgtggaagaggcaggtattccagtgggctttctgagtggcccacacagtggtggtgattaatcttttgaagttttatcaagtcatccagcttcagcttgcacagctttgggagtatgcttagaattatttcattggggaattttttttaatgtttccagttaatgacacatgtactaaaatagatttattagaagaaatttgtttaaatttccttgacaagaaacagcttttggcttctaatatattcctattaattgagttaaatcttaaaattcttagtgaactctattcatgttggggacttgtggtgtaggtaaacctaaaattataatgattataaagttttttatatggtaacatttcattagtatcagatgagagtgagagagtagaattctacagaaattgaaatctaaaatgaacagtctttaaggataggtgtgtggttttaataattgtaagtaatatgaatttaatgatgataatgagtatctggtgtgtgtgaggcaataacatcaagttctgttgcatcaagtgctgtggccgttgtgatatgagaaggcctaaccacaaggtgagcgaatctacagaagcttcatggaaggaacagcatttgagaaatgccttgaaaattcccgcaggcagacccaggggagccactgcaagtgggatgaagagataaggaaaggcacagatggtgggaagactggggagaggcactgtggcttcgtaaaccgagcctggtgtttggaactggatatactggagtttgttctttttcttacacttactagccaagtacccataagtgttccccatcttggaaatggagaaaatatctccctcacagaacatttgtgagtactcaatggaaaagtttctggcacataagtacccaataaaggttaccttgttccattttctaaaaacaatgggtctttgactttttcaggaacaaagactaaaagagaaattcatttagggactttttacagagatcttttaaaaacacataattatgttattcttgagcaaggggtaatttgattaagtcagtgaaaagcagagatcatagagttgtatgttaatatattagtattaagaaacaatggtccatggttatattgctttgttggaagttatttagaacattttgcatgctgagcatcatgaatactttgtctgaattattagtggcctccaaattaataatggggctttcctgtgtgtttttgacattaaattaagtttttctttgttctttgttctgaagtagtaactcaacttccattcctaattacgttctgcccaggctaatatgagcactagtttgtaatcttttgctacccagtagtggggcacccttttttgaagctgcctagacatggctaaagacacatttgcagtggggaaaagctggcaaggcgtgacagatgcattctggttattatccagatttatctgtctctcccagaaagtatgatcatcccctttgcttcccacctcttctgtgggaagcactctgctgtgcccacccttcccgctttgttactctttcactctatcattgttataataaggaaatgttttcctaaaagtagaattttcataaaatttaagtcctgacttaccgtcctggttcctggacacctgttttcagtgtgatgcagaaattggcctgtgcttctcataccaaatagaataatcctttatttaaacagctgtcccatatggacaatgtacattacgagacaatggtgttcaccatttggaatccttctttgttcttgaattagaaataagaatcagcaaacattgccatgctatggcagtctcagcatcatttcacagagtgtgtctaaaggagtagtatttttggtagctgaaaaatattacataagtaatgctgcataccagttagttgtattaaaatatatattatgtacagctgtgtacttggcttgaaaagcttccttgacaacatcatttaacttcttactgttcttttcatgttgctggtataaatatctaatatgtttttgttcaaaacatcaattaggtttcagtataatctttattaatacagatctgttattacaagaagactgccgagctatgataatttgcacagcaggaacaataaaatatctcctttctgtttcattctattccagaatgcttggctttttgttattcttttacacaacatactaaaaccttttatgattttttaaaaattatagttaaatctttaaagcttatataagcaaaagcattatttttttcccaaggtgaacaaaattgaaaggccaaaaatttcagatagattgaagaagacatatattagttacaaatctccacttttaatatctttcattctttttctttatgtagccaggactcctcacttcctgcggattcagaatgtggaagttaatgctggccagtttgctaccttccagtgcagtgccatcggcaggaccgtggcaggagacaggctctggttacaggtacagtaactcattttcatcagttgatgagagtccagcgggaagaatacactccccctggaggaggaacccagagaaacagactcaggtcctagtgtaagagtttccttctttgttaataagtagccagattacttagtaatctataaaagctaattatttttgtttaaacaccttttgtgaatttcttttttttttcctttgcttatgcttagtcatcttgcttggaagatctgattgtcaaattacttatatggcagtttattaaattacaaaatatagcactcttctcctaagtcttcctcttgagaaaaatctaaagagtctctttctctctctctctctctcttacacacatacacaccacagaacacttcataggcctttttgtcatttgaatttccaagctgtaagcttaaacttagaaattaataatacatattttacttttgagcttttaaattatatttctttggtgtagtgatcaattgtgtgacttgttttgtaattattcaaattccaccatatgtgttttgcatggcagagggttgcgtggatacatccatgctctcaggaatcctgacagaatgagtgggagtaaattgcctgtcccttctaaccagaatgccacccacttctttaagctctaggtttggggtttgccctgccttggtattctccagttgcattcttgtttctttcttttaagcattaatctggaggctgctcatttttcatcttgagtggtgttgattttttgtccttatctttccgtgttttgtgtgggtgtgggtttttttttttaaagtattatctatttatttttagtttgctactgagttgaactgtccttcgggttttaacccttctgtgtacgcggttgtgctccacactggcttccgctccatcatgtgtgctggccttgtctctgcacgtgccatctctccacctcctgtcatgcctcgcagtgtaattatgattgtgattggagactccgtgtgacactctgtaatttttaaatccttcattccttttaatcactgcaatgtaaatctgtagtcatttgttttgttttgtgtttgtcttagagacagggtttctctctgttgcccaggatgcggtagagtggtaccatctcactcaacctcctgggatcaagtgatcctcctgcctcagcctcccaagtagctggtacaacaggcacatgccaccatgcttgagtaattattttgtcatttttatagggatggattctcccttgttgcccagtctggtctcaaactcctagcctcaagtgatcctcctgccttggcctcctaaagtgctgggattacaggtgtgagccactgcacccagcccagtagtatttttattcttctctttctggggaaaatgggagacatttgagtgtatgtcccaagattaatcagcaatgcattgtcagatgggaaatgcattctggagaggcttcttgttgttttctctgccaggatgttccacccctctgcccagtgtcactctgttttttcataccctactgtcccttttagagactttgctggccaggaagtgtatgcagaggattatattgtatattccaagttcatctttactttcttctttgtctgtaaaagttttgtaactgctaacttaagagttttttgccgcttgtgaaaactgtcctccgtattcaaattttttttctctttttaacctacatcccaattgttttaaactcttgatgttaaaattcagaattgttttctcagataatggctatttggtattaaacacaatcaagattggccatctgtggtaattaatgatgagacaaacatcttctattgacattttccacagagtattaagcaccttttaaaaatgaaactatttgttcctttgatttatctctagaaatcttaattatttgtggaaaaatacgttttgctcctaatatttatgatattacttgagagaatacaatataaatactatattaagtctagagaatacaatataaatactatattaagtctaagctctcgccttaacagagtcatcttagatattcccaagaatttaaggtttgttgaggacatgatttgctctttttatttttgcaaacgtcctggacttggtgtgctcctgcttaaacttgagcacttatttgggttgggaatctttcactacttcctacacttccaggaactttgttttagagataatttgtcatgtggtatggagaaagctacttacagttttggggtttgaaaaacaaagggtctaaatgcaaagttatcagccctgactctactatagaacaacttggaagggttttgttttgttttggtttgttttttttcacaaatgtcttgtctatttccagattctcatttagttggtctagggtggggcccagcgtgcaatgttttattaaagactctccaagtgattccagtgtgcacccagggttggaaattactagtgtgaagcaaaatacaacacacattctaaatcaggaaagaaagaaggcagacataacatataactggtacctgtattcagttgcctcagtttgaccccaacgtttaattttccatgtactgatctttgaattttttctcattagatttgaatgatggtgttggtagttgttttcacagtcggtcccttaatgcctttctttttctcttgctgagtcttttctgacccctcttgtcttcagtgaccatttattgccctgcagctttctacactgcgctgtcaagaaggagatgacacagatagaactgttgtgactttgagctttttactgaaacttactttatcctggaatcaggacactatttggttagtgaatctttgtgatgttagaataattttactgttaaatagtttattttccctggttgggtaggcattttgtggggaaatatttattttattaatagcttatgaaataagacccgtgtccttcacctgcaagggtggtttttattaatctatatgtgtacaaagcagtttccagtagtgatgaaggttttcagcagatgctggttttgcacagcccttcctgccctcttgcccaggacccctcactcccccttgaacattttctcagtccattctttagaggtcgtgaagacatgtaaacctttcgtcatggaccaggtctttctaatctagagttgtaatacactaacacctgtctgcgtgtaaactcatttgggtcctcaaaataatcctgagatccaggcagaaaattgaagaaaagaacttatttttagttttttctgtgattcgaatctctctcaagagtgagtcaatatttagaaattaataatacatctttgtttgggggtacattggtgtttttgaatataatcatttacaatatttttttgagacagggtctcactctgtcacctaggctggagtgcagtggcatgatctcggctcactgcagcctcgaccacctgggcttagatgatcctcccacctcagcctcctgggtagctgggactacaggtgtgcaccaccacacctggctaattttttgtattttttgtagaaacaggttttcaccatgttgcctaggctggtctcaaactcatgggctcaagcaatccacctgcctcagcctcccaaagtgctaggattacagacgtgagccaccatgcccgacctatttacaataatttttactacttgtgttgcagtcttttgaggcccacaataggtattctgcacaaagtttcatggttgtatcccatggtagtttatctgttttgtaggagaggagttggaagtttaggattgtcctgggtcacaaagaaaaatgacatagctggcaataatacaactctgtttatttacttttatttcacctttaagtaattccactctactataccgtcttgttgaatttggaaggtagatgaataggcattatgcacttacgctttgatagaagaatttgggtgtgaccaatattacatcgttaatatcaaggtgccatcctgaccgtggaaaataatgcttatatgtattacatgtcatattgatccatacctgtgaaaatggccaaggttttgatttttttaaatatagattaaatataacccttgtcagagtctttcacaataacgtaacgtaaataaatctgatgatgacactaatgaagaaatgtttatgattaacagatgtgtcccatctgtttatattttcttagtctcatctgtggaccacacaggttatgttgccaagtgggattgttttctctagaacactgaacaatagaataagacccagtgtgtgagcgcatccattgttacagctacaaaatactttaaaaaattttccagacagtaggaagacaacatctgtagaactcttttcttgtatcgaaaaacctatatgcaatgcagttcttgaagatacttgtgatatgttatcggatatggcaatctattcatataaacatggactgcaacagtgtgagatactaaaattaagtgtatttatggaaatcattcaagcacccaaaatattactgtaattttttgctatcaactttccgatcactttttgagcccacattttgaaaatatctcagagtctgtatacatatactgtgtgtatgtgtgtgtatatatatataacactgaaaagagaaaatggaatttgagattttctttttatactttctgtacacttttatacttttgaaagtactttcttggctgggtgcagtggctcacgcctgtaatcccagcactttgagagggcgaggtgggtggatcatgagatcagatcgagaccatcctggccaacactgtgaaaccctgtctctactgaaaatacaaaatttagctgggtgtggtggcacgtgcctgtagttccagctactcaggaggctgaggcaggagaatcacttgaacccggaaggcggaggttgcagtgagccgaggtcgtgccactgcactccgtctcaaaaaaaataaataaaaataaataaataatttttgtttgctgatgggaaacttctgatgttgtatattttttatgtagtcactgacctttaagctatgtatggttgtattaaaacctttattgttctttcttcagtattccaaatattatttgcctatatttgcttgtttctctcaggactttctatttataatactttccagtaaatgaaggtgacaaccaaagctagctagtgtttatgtacctatagatgactcatgcacgtgcagttacaagacctgtggcatgggggccactgcctttctcttcccctgcctggggtcccattttggtgtttttgtaacttctgctctttaattcatttcttgtaatcgttgtagaggttcctgcattccttactcctgttagcaaccacatcacattcagagtgggtgggaaatacaaaggttctgcctccaggacaaagagcagaagacggaggtggggaggagcgatgtcttttcaacaaaggatgaacagatctttgatcaggctaggggttgaggtgtgcatgttgagtgaatagcagttggcagtggaaacctggaaaataacccctttctcttcacagtcattagaggtccataccatttttaaatatcttactttttaaaattacacaattatgtaacctctgaatttggagcaatcttcaaattaaattcctaattttattgacgagaaaacagaagcccagaaaatgtaggaaactttagtgcagctgtatatcctgtttttatgtttattataggtaactccattttattattgaaagtcagttttatatgtctaatatttttatgtctgtatatatatgtacatgtttatacttacgtataagtattgttatttatttacaaatgcatgaattttttctcttggacatttttcttcactgagtgatcttgcatctcaaatattagccttttaacctgatagtctcagatttactgtgatttacctgtgttaaatttagaaccttaaaatccatcatagcacaatataattgagagttttactgttttgcaagcagagtttggcatttattataagtaatgcaccagaatagccttttaaaatgattccataatatgcattagtttatacaaatagaaaaggaaatcagatgatgttactgtaaagtacagtagtcccctcttatccgagattttcacgttccatggtttctgttacctgtggtcgatgaaaatgtggtccgaaaatgtcaaatggaaaattccaggaataaacaattcataagttttaaattgtgcaccattctgaggagcacaatgaaaagttattctggcccaccctgtcccactgaggacatgaatcatccctttgtccaacaaatcccaccacctacccagtagttactaaggaggtgtcttggttatcagataggctgtctcaggatcacagtgcttatgtttaagtcacccttactttacttaaccattgccccaaagcacaggagtagtgatgatggcaatttggatatggccaaagagaaggcataaagtgtgcttccttcaagtgaaaaggtgaaagtgctcaacctaataaggaaagaaaaaaattgtatgcactgcttgctaagatctacagtaagaaagaatcttctatacttcaaattgtgaagaaggaaaaagaaattcattctagttttgctgttgtacctcacactgcaaaagtttacagccacagtgcatggtaagtgcttagttaagatatacaaggaggcattaagtttgtgtgtgcaagacatgacagaagctatccatggtttcaggcatccactaggtgtcttgaaatgtatctcccatggaacaggggggactgctatactgttaaaaacactggtacaaccgagcacctagactagtgcttgtcacatagcaaaatgctcagtgaatacctactaatgcatggggcttactggctacccaaacaaatcgtgtagctccttcaggtgagcatcaaaagtagatttgtagttagagcaggaaaacaagcacagaggaaatcgtttctctctgggatgattgctttaggcctgcagttcctgttcagaggatggtctttgatgagaggagcaattcatagaatgtagtggtgcctctgctgcttcaggctatatagcaaatatcatgcagagttacaaaaactgattaataaaaacaggcatatgttggagtaattttagaagcaaatatggtcaatatatcatctttcctaaatcttcatttcttgtaccctttgcctaggttttcttattctgtcatgaaacttctgtcctaattcttcctgtaaaaactttcttgccgtggcatccacattaaacgttatagacatacacctttatttttttccatgatccccatgaacataagaaatatacctttaataaggatattccacttgagtttgcacaatggcaacacctgtgtcatagtaatagatgaattaaacctacgccatccaccttttgtaaagaatgtaattccatttgagctcttcctttgaggagtttaattttcttaaaaaaacttacttagagttaacagtttttcagctgttggcctagagattgatatattttttttcttttgagagtttgacatataattccaccaagctgggtatgagctacgcaatcgtgaaaaaagtatgtttctccagtctaataaattgctcacattttgtttttgagctcagataattttaaaactttttctgagagaaaagagggaaaccttgagatttttataacctacaacgattttaatgggaacagtttcactgatctaccatagaatttggcttttgaatgaataaattaaaaattatatgaatagtgtttatattactgacttcagcaggtgtgtttgaaataaagtaattgcagctacatttactgaacactgctatgtgctagttactctggtaggtgatgttcaggcatttttttcattgatccctacaagaattttattatacgtccatttatagaagaagcggctgaggcttcttctttaatgacttttccaatggtgcattgctaatcacaagagctcggatttgaacccaggccgtctatgttgtatcgtaaccataatgcatgtttggtactgcagaaaaagacatagatagttcctcatgaattcataagtatcatgtaatttaaatgatagcattgatcagaatgtacaattaaagttgtttttgtatgtatgcgatgttgccttggctttcgtgttatggatatatgcttttggtcaacctttctaggtggcttttagtttcatttgttgattataaggaaaaaaatcacaactgtatttcagaacaattttgttattatgtataaaagccacaaaatgatatgaaaagaagtaaaattatggttcccttcacaagcttaacttgggtattttatgccatatatattaaagcagaaatttaacatcacttagcattccagaaaatactagaaatgcataaaggaggactgtctttagttgctatgggaaccatttgctctaaaaaattttgagtacttaaaatcacatccattattgttttagtcagttaaatatctatatctatatttatataatatactgaacaatcagactgaagctactgaaaacctttaggcgtataccttatgttttaacttaatatgattttggattacctttatttaaaaataaacatttcttttatattgatgaaacagtataacatgtctagggatactctagaagaaattaattaataatttttcctttgtgatattatctaactcagccaaaaaaagatgtaagcaacaggtgctgtaggatgtggcaggaacaggtagggcagtagagagccccttcctccatagcaaccttgaggtctcctggcctcgacttgaaattggactttttatttttatttttttctttccagcttttattttaggtcagagggtacacatgcaggtttgttacatgggtagattttgtgttgctggggtttggtgtacaagtggttttgtcacccaggtggcgaacataatacctgttaggtagttttttgaccctcaccttcctcccaccctccaccctaaagtagaccctgtgtctgaaattgggcttttaaaactactggtcaggttgtgtcagtctggagggcagaagagaaggaagggcatcaccactaatcttaaggtctgcttcctttggccctacaaaccatacattctgggaaagccttctttcttcttttattatattcagcggaaggttcacttgctcttcttgcttccaagtatccgaggctatcccatgagaaaggaagacagagatggccatggttggggctgcctgcttcatggggctggcgggaactgggaacaggtagaagccccacccactgctgagctggcagggcaggaacctcatgctccctgagcacagctgcggctgcccagccatggctgcagacccagcatccctgtgctcttagaggctgggagcaggcaggagccctgccctcccaggtgcagctgcagctacccagccacggctgtggacctgggcatctttgcactctcagggacccaggaagacacccctgcacctgcaggcttcgaagtacctgcttccactgcctggcctctccctgttcccagtgcccgcttcaatcttggagcaaagttgaggctaaacccaggtgctgtcgcaacccagccaggtgtgtgtgcacccagggcagcacttacatgccagccccctgccgcctcagccccttcctgactttaggcactgacaagcatgggaggaaggctgagggggtgttgagggcagtttggcactggcctgcaggtgcccctcagcatgaacagcctgagtaccatgaacaggaggcagacaggctccagggcagatgggggagttccccggtgaagtcccaccttcaagccaaggaaggcctgaagcctgggagctgtcagtcctgcagttcgggagtgggaaattatcgtgcttttttgatgcccacccatggccacccatgaacctgtcagcacacacttcctcccctctgaagcccatgaaatccatggactcagccagactcgagcactcaggccgacctgcctggagagagaagctgcccactccagggtctcctctctgctgagagctgagcacttgactggatgacctgcctgcatacaggagctacccactcaagggtctcctctctgctgagtgctaaacacttgttgggacaccctcactgtggagcaaagctgaccactatgggtttcctttgcgctattctgtcattcagtaaagctcctgttcaccttactcaccctccacttgtctgcatacctcattcttcctagacacaggacaagaactcgggacccaccaaatggcagggctgcaagggctataacacaagcagggctgaaacatgctccttgctcaccacgttgtgggtgacaagaaagaaggagagaagacctacagcccttcagggagcccagacctagaagctccccgagccagggctgtgacaccctcttcgtggctctgcagttcctggtgtctgaagtttctgggtgccaccacgttccccattgccagccttggaagctgcttgcagggagctggtgcccatgccggcacctggagctgcccatcccaccacagccagtgtgcctggctgtgctcagtggccagatcccatgctcgctcactcacacacccgtcacctctcccaactcgcccttggcaggcatggaatccaggccggtagtgtcagccgagcgcagcctgccaagccaagtgggcccgctgggcccgagcaaaactcaggtaaaggtgccactggccacagaggtttctggctggcgaagcaacaccccaaggatcccataacattatcagccattgatgatcattgccttggttcattaattcattaggagttgcagaatggtctaggtctatcagtcacttactgtcatcacctaaaagtgaccaaggtagttataattattgttgtcatcatcagcattgtcgtcatcagcttgtgtgtttgaacacatttgatgtgtttcagtccattgcgcttaatatctttattgctgctcatgtcttccccagccttccagtggggcttactctgcatgggtgactcctgtcctggtccatttcagggagcttctttgctttctggtgtgatgacatattctaggtgtatattttccattttctacttcagacctagaattggccatttttccagggaatcctggttgtttttctgtgggaaatggccattagaacttacaatctgaacatagagatgctcattactactttatttattttattgtttattgtttttggatcttctcattggagagagctaagatatcttggtatgcacacatacacacatttaaagacaaactgtgccctgagtgcatactgacaattcctatgcaaattcaaaactgtagggattttaacctcctttatcttacatctttatcctctttcaactatgttttcagaagagttgtatattttaaggcatattgactaaggaaaagtgacgttattaaccagccgtgtgaatgactagcctggccttttagatcatgtttgagaggtagcacaagcactgccactctccccatactagagtgctataaatacagtttaaaagtgaactggcttgagacctagttttgcaaaggtttgaacctttaaatatatgaaaaaatgttcgtcagtgttgggctccttagtttgatttggccaagttaacccagttaacagttgggatatttgattttaagaccacagaacttctagttttgctggcatttctagttactgcatttattaggtatattctatattatttggattaacttctagataaaatttaaatacaggtttattaaatgatgttattcagctattatgaatatatcacaaaatgaactatgtctaaatagcaaaatgaagctctaaatttccataatcaaattcttcttgaatataccaataataataggatataactttggatatctgtatgttattttggctatctgtatattcattagccaacttaacgtgtgcttgtcaatatatattgctagcatatgatgatacaagtcagaatttttagttttagtacagtactccaaattgataaatatttgggttaacttggttgtggtctagaaatcaaaggtcaacactatgttaattattaaaatcaaacttatgggctatataaaggtagattcttctttgagatgttcgattaatacaggatttagcttgcataagatatttcaaacaaaattactccaggccctgctgatgttattagtgatgtcggtggtaagaatttcaatcaatatctcacaaatgggcacatttgaaagttggataatacagactattttcactattgaagaaatgaaagtgccgtttaatccccacctgtatgtctgaggaagggggactggctcagagctccctgcctgatgcctgcgtactcagagcagctccaaaatgcctgagattgattaatttgctgcaagtgctgctaacttcccagacctcaatttctttcaatcattgctctgattattgcaaaactatttctgaaagacttaatatgtatcttttgctggtaaattactgctcatttagaagtcctagagttagtccattgcatagagaaggttgtaagtctaatttaaataactatcagtacttttttctagcctgctcaaattgaaatacatgcacatttgaagatactcttgcttttataaagagctgtatttaacccggtcagatatctcctctcaggcatcatcattatggttatttcactaagtggacaaaagatgggtcagtgatttatttaacaacccaggacattcggtcactgtgctttgcatggtgtctgaggtttttgttcccaacaactgtgtcctaggctgtctctcccagtgaactctcatatggtaaagaacagtgcgatgcccatccttcatcattttttatggtccttctgtcacgctattaagaatgtagagtgccagtgcttgacggggctgcctgtttcttattctgaaaatggggcaaaatgtggctgacaattttgctgtgtccacctgatgtatattttcacaattttgttttgctgtgggtttctagatgctcagtggtacctgaggttctgaacacactgacctctccaggtgtcactgtcatggggaaaggacggtaggggcagactctcatgcctgtctgcacctgacttgcagcaaaggaattggggctggccatcactccccacacttcactgtttaattccagcctagggaatggaatctggggaccaaaagacatcttaaaatcaatttagtcacttgttcaatgcctgaatcacttttaatatcaccaccagtcctccctaggatgtacaaggcatggtttatatgttaaagttagagcaataaaaaccaggcaaggatccctgccttcatgggacttgtattctagtaggggagatagagagcaactatggtaagtaagagaattatgcagcatgttaggaaggggtcagtggcactcataaaggaacagctaggtggtgccaagtaggagcatgtttcagtttggaatttaggcgtcaggttaggcctcagtgaagtatttgagcagtccctggaaggagatggagttggctctgggggatgggtgggaagcattctaggaggaggaagaggtctcaaggaaggaggaagcctggtctggaaagaacagccaggagtccacatggtggggctgagtcagccggcacagtggtgcggccatggcacagtgggactgggagtgcctgaggatgggaggactgggtgtgtgccttctcggtggtcgttcttagtaccttagcctgtactccaaaatctataatcagaaagtttccatatctaatttggtagcaaaacctccccatttttgtaattcatttggtgaccaaacctgacctgaatggatgtgaagctatttagggtttctgttttttcctccttaaagtcaatattcctaggtttggatgcagaaatgtcaaaacctaggaattatggggtgctgtctcagactttccttggggtgtcaaagaatatgcagtgcagatgcctttatgaaataaaataaaaaatctgaattctgaaccacattttactgcgaggatttcaaataagtaagtactggtgacttttactagtatcctgtggcccagacattcacatcccattcctgttttacgtgcctgtccttttcatgctggaagatggttgtcctctccccctcattctcagccagctgcgttaatgactagcctggtctccagctcctccccttcttcagttccctaactgtgggccaggggatttattcactgtctagcccacagtcctctgaacaagtctgcttctcttatgctctgccgaaagcctgaggctccaaatggaatgctgtgtgctgggacagggacaagagggaccatctctccagatacttcattaatacaactgaaaattgaattaggattttagacaaaaacctgctccacaattgttatgtatgttttaatgatgaagatgatgctaaatcagaactctatccacttaacaaagtctgattttacagggaagcatcagatgcacatttatttttattgatgtttatcttgttttaatttattgtttggctttgtagatatctttttccatccctttttgttaatttatgtgctcatatattgtcacctgttcatttgagaagcacatctatgactatcaaaggcaggaataaacttgttgggagaagtcagggatgaggaaatagccttgtgccaaggcaccagaaacagacgtcagcgttggtgccaacgagcagctgcgactctggtcgcttgcatgtttctagtccacctgatcttcctggcagttagcccatcttgttctccttgtgtccacagagctatcataggagacattgtctggtgctttgccagtgactctgaacactgtgcttcctcatttcctcatgctccaagaaatatggttcgacactggaggaagaaaagtaatacctttcctcacccatcacaaggtttatggctgaaatccctataacaaaagacagattaacaagataaacacataaaaaattatttaatatggctgggtgcgatggctcacacctgtaatcccagcactttaggaggccaaggtgggcaattacaagttcaggatttcgagaccaggctggccaatatggtgaaaccctgtgtctactctaaatacaaaaattagctggttgtggtggcaggcacctgtagtcccagctaactgggaggctgaggcaggaaaattgcttgaacctgggaggcggaggttgaagtgagccaagatcgagctgctgcattccagcctgggtggcagagcaagactccgtctcaaaaaaaaaaaaaaaaatatttaatacaagttttacatggcacaggagccttcagaaaatgaagacccgaatactcagggaaaactgtgtttttatggacagtcgtgtagaagtgtgattgagggacaacagggcaggatctgatggtaataagcggggtgcactgaacaaggcctgtttgttcagattctctgtggcctgtgtgacattcctgccctccagatacagggcaggatacctgccacatgaaggcctttaggggaggatggagggagaagtcagagagtgacctctgagtttcctagcccatctcagggcagaaaggggcaagtggaatttcagtttctgtgtcctgcttggtgggggggcggggagggaatggtctgcatgatctttctgatgttgtggttttctcagcttctttcagcttaaatacttagtatgccaaggtgccatattttggggtaccatttcctgcactgcatcaacactaacaaagtggagggtgaggtctctctcctcccttctcctccccacccagtactttgaggacatcccctcatttctcctccattagtcccaaagtgcatttgctgccttacgcgtgtcttcttagaatggggctgatagagagcctgatgttgctcttgcacctgacacattttttgctttaagaaccaaggaggggtctctgaatgtgtgcatgtcaggatttcaaaggaaactaataacgtcattgaaggcttgtatctttttccctcgtggatcacatctttctgcgtgttgggtcatttggcctttcgtttctgtgcctctccccatccttgccctgcctggtcctttcttccccatgcttcctctcctgttgcctcacccagctttccccactcctttctgattttctgtcttcacactgtcattcccccgctcttctccagtgtagacggcatgttttcctgtttctttcttctgttttgttatcccactgcccctgtggctcttctgtctcttcatgccttcctggtctggcctctgctcatttcattcatcttatggggtgcctccatggttgctgtctttgggctgctattctagctcatgattccaaagtggggtactctacttcggtgacccaacatgaccttaaagacttgcttatgcacctctgacaaatcaagatgcacgacccctggacaccttcaaaaagccacagggcttttagtttctcagatgatcaccacattggcatcctattgctgctgtaacaaattcgaacctcgtggcttcatcatcttactgttttgcaggtcagaagccctaaaagaaggtgacggcagggttggttcctcccaaaagctctgggaagaatctggtccttgccttttccagattctagaaacctccctcatattttgcctcgtgatcccctcctcacacttcagagcccgtcggcacaacctctgcttctgttatctttccttcacattgacccttctgccttcctcataaatagaaccttgtgattacgtttggccaacccagataatccagtctatctttccatctctagacccttattttaatcatacctgcaaactcctttttgccatgtaaggtaacatagtcccagattctggggactgggatgtagacatctttggaggcccttattctgcctaccacagtcatgatgagttggggcaatgttgctgactgacgacacacagaacctctaaaacattcttttactttccctgttcgtctccattgtaaatagggattctttgtctagggtttggggtttaagcctgttaatttagtagaacctcatttttctcttctacccctggaagatttttttccactgaggctgtgattcctagagtcagccagtatttcttgagttctatttattgtgcacctgggtacacaaaatgagtaagatacgaccctggaccttatggactgctagaggagaaagatgttactgcagtagagtacatgttgtgttgatttcattttctagatatctttaggttccgtccctttgtttctgtcttctctcattgtgtcatttgttactatgatttctgaaaacaatttacccagtttcccttgacatcagttggactcacaccgtatctcctccagtccattactgtacacacagaggtgtttgtgttacctctttgcctaaggtccttccattcccagcatcagaatacactgaaatctttaacatgtcatacttcttgttgcagtctgtattgtgcttttccttctagcctttttacctgccataccaagaagcacttctgttcttgccatatgggataagttatacttcccttagagttcccctagagttctcctatactttccctatagtttttttatagttctcctaaagttcccccatagctaccctatatttcccctatagttctgtgctctctcttggctcctgactctgaagagcttctcttattcactagacttttcctctttattccctgcctaagaaacttctgtgcatcctgaagcctgggcttaagcagtgcttcctagaaagcttgcactgacaacatctccaggactatagtttgaatatttgtcccctccaaaactcatgttgaaatattaatcaccagtattaaatcagtatttaatctccagtgtcattattgagaggtggggcctttaagaggtgattgggtcatcataggagagccctcattaatggattaatacatgtgtggattagtggattaatgggttatcatgggagagggaccagtggctttatgagaagaggagagacttgaactagcacactcagccccctcaccatgtgatgccctatgctgcctcaggaatctgcagagtcccggccgggcgtggtggctcacgcctgtaatcccagcactttgggaggctgaggcgggcagatcatgaggtcaggagattgagaccatcctggtgaacacggtgaaaccccatctctactaaaaatacaaaaaaaaaaaaaaaaattatccaggcatggtggcgggcacgtgtagtcccagctatttgggaggcagaggcagggagaatggcgtgaacccgggaggcagagcttgcagtgagcagagatggcgccactgcactccagcctgggcagccaagtgagactccatctcaaaaaaaaaaagagaatatgcagagtccccaccagcaagaaggccctcaccagatgaggccatttgacctgggcttcttagcctccattactgaaagaaataaatttcttcataaattttagtttcagatattctgttataagcaacagaaaacagactaagacatccagtcaggtcttctcctctgtgctatgggaggcagttcattgctctgtattgtaattattgccttgtctgtttttttttctagccagacaataagctcaattaggtaaatgatggttcttttaattttatgctctcttatatgatatagtgtgtgccccataaaagactgtcactgaatattggttgaacgaatgcctgaatccatgcacacatgaatggtttaatacaaaatggcctgcagatttgagtaagatgtgtgatttgctattcctgtgtagattctaagctaaaacgattgctgcttggtttctcctccctatgtactatttctcttgaagctgaagctgacttttcatgtgattaagtacaggagttaaaaatttattaaaggctcattcctgagcattcatatgactcactagagtcacgcagggctcctagtccgaggctgtttattttatagggcccatctgtggcatgaagacagtgctactgtgagtcatactcctctcagcatatgcataaatccaaaaaggagggtttcttttacttgagtgccctcagtatagccttgaatagttgtgaggggtcagtaagtgcaaacttgaaattgtttttgaataaacattcttttgatagatgcttctgtttggaaaaatattaggagattattacaaaaggatattattacaggattcatgccgcaagtaaatagataaataaatggatagatagccctaaggcctctttggttgttgttagcaaacaaatacttacagatatgcaatctgcctttatggcttaatttcttttcccttcaaaaaccagagatgtggttctttttcagtttggaaagaagactagggagtagtatgtctaagattatccttagggctagaatttgcttatttcctggggtggggtgagaatcagagactgaatatctatggaaagcagagaggaacctttctcctgttgtattattaatgctaaatttggttttgtttcattttttaacttcttgatgctgtctatgagaacaaatttagggcatttagtgaaaaaaacacacacagacttatgtgggactttattttctgacttacggcattgtgtggtataaacaagactgttttacagataatactaaagataatgttgatggaactgttcttccccactcgtgatgtttccttccaagtggcaggaactgtactattgcagcactcctgtctgctttctcactgcccaagctgaagctgcctgggaggaagggctgagcatgcctagcccagccccttctttggggagctgactgcctatgggaaccctctccctccatcctgtgagttttacagcagcactgaacatatgggaggccttgtggttttctagggtggcctgggactgggttagtgagtctgtttattctgtgcttcaggattagcaagcccattgttcctgcactcttaagtcatattcctcagtctcaggtttatcagtaataaaggtggtactttgatagccgctctgcctttctccttgaattcatcactcaggtgttccggcgcttgggcggggctgcatggtggaattgttatggctgtgtccttgcgtatgcctgtgggttctcccagcagccctgacagtgggtggtatcatctcctctttacagattaggaagtgaggctctatgaaggttaaccactctggatgatcactataggtttggcatactggtcaggctaactcccaaacttgtgtcccttaggtgattcggccaatgaaaatatcacagataaaagcttttaaaggactttgcatagtataaatcactgggtaatacagatgagtttgattcctttgtaggctagcattttcatagctatgaatgtaaacattttaatatagcctgcaagtccctgagcacacaggtgcttgcccacctccctagctccactggctgccttaacttcatccaaagccttcatctctttctcaccatcttgagcttcctgtagcgtttcctataactagaatgctcttcccctctcacccttcccctttgcctggttagcttctgtttacccttcagatctcaactcacatgtcacttcctcagactagcctcccacagccactatatctgcagtttgtctgcaatggggtttctgctagccagctcatctttcctaaaccaccctggccatcgtttctgattatgtattcactctaaacctatacaccccaaacaactgcaggcccataagcccagccaccacttttcttttgggtaccattgtgatcatgctatcttgacatagtgatagctcctggttgggatgccaagagtggttgctgagtgaataacggacatagtgcttgggcattacgcttggcataatgatcatgtattagccttgaggtctttgtccattgttttttactaatacttataaataacatgttaaagatagcctctttcctgattataaaatacacacacacacacacacacacacacacacacacacacacacacacaggtttccgctttcagggctagatatttgtccatattcgtatttgtctatgggggactgttggtgtgagaaactttatatatatgtgtgtgtatatatattatatatagagagagagagaaagagagagagaagagagagcacaagagcaagagcacatacaagagagagaactaaaatctctaacctgcttttgagactttaaatctctaacctgcttttgaagccacgaggtttgaggctttaaactattggaagcatagaatggatttccaagtgtgcataactaaaagggttacttaatatatggggataataaaagaccatatatggggataataaaagaccaaactgccccagctgtggaactttgtttatgtggtcctggggatatgggatgtagagaggaacctctcttgttacgtatgaatgtcatttaatagttactaggcacctaattctgtttggttttgtatatccaggaagaacgtcaaaagggttgaactattcttttagtcctgttcaatagggagtactctaaaacctaacttatagttgaatgttattcttaatacagtgtttattacttcatttataaaatgaggtcagtaataggatagtgggtgagctacttttatttcctagtcaagcatacaaataagagaaagtgctataagaccaaatgtggatagtttgaaaacaaggtaacaagttttctgtatttttactcccctgttgcactaattaacataatattttgaagaggcaaaaacaaaaaatgtcttcacacttaattttgcatcgctcagtctttaaggtgttgatcatggcagaattttagtttcctgctcagctattctcctggtacaactgcccatgggtaataagcaactgcaccaaggtctgcatgaaaacagcatggataatataccattgggtgtctgactgttttgctctgacagcttatattgcttctttttgtcctccccaccccacttgatacagggcattgatgtgcgagatgctcctctgaaggaaatcaaggtgaccagctcccgacgcttcattgcttcatttaatgttgtgaataccaccaaacgagatgctggaaagtaccgctgcatgattcgcactgaaggaggtgttggaatatcaaactatgcagagttggtagttaaaggtatttaatgtgtttttataccagaatattcttctaaagtagatatgttaggtgttgttagttcattatccctttaaagctcaaacttacccttgtctgtttctgagcagtggtttgatgacaggctattttgatggattgcattttaagtacaaattttgcacgtgaacaatatttttgaaaaatgtgttttatctatgttgatttagttgcacaaaaaacaatgaatgtgctcttggcaaagtcttctgccaactctatatacagagattacaacttataaattttttttaaggaataaaattttttactgatgaaaaatcacttaaaatgcaaatattcatcagccagcgtgtttatgatagcagagtggttaataaaatgaagcagtgtcagtataaacatgctcagtcatatcacacaagccatattgataattctgtgttaacattcataatgttccagttaggttctattactatattttgcatgactgaaaaattgagtcattatatttaagaaggtgggggatgagggaaaatagaaaggggaaataagtttcctttagccggtttaatgggttttttgtaggctgaggaatttatagcattaagccaccaagacaatttttggtcccagacaggataatttggactttgaggtgtaccatgaggcatttttagacaacctgtggcaagccattgctgtttttcctaggagaacagaatgaggactgctttaagaaaagttttccctgcatttgttaaatatggcacataaaattgatctctctacatatataatcccagcactttgagaagctgaggccagaagttccagaccagcctgggcaacatattgagactccacctctacaaaaatttgtaaaaataaaaaaagctagccaggtgtggtggcagtgcctatactcccagctagtcaggaggctgaggtgggaggattacctgagtccaggagttctaggctgcagtgagctatgattgtgcccctgcattccagccaacctggacagagtgagaccctgtgtcttagacaaaaattgtctgtttcttatgtggtataaaagcaatagcttttatctgcacatttctcaagataggcagctttaaagattgctggattcaaatcccagaactaggtatgtggctatgggccagtggcttgccctgtatgtgctgctgtttccttgtgtgtaaggtagatatcagataataatgttatctaccttacagggccatgaggaagatcaaatgcaaagtgtatattatatataggacacttagtatacatagtgagcaatgggtgcttgaaaggcccttggtgggaagggagaggaggacagggataaacttctctctggtccagtctgtcagtggtcttcactggggaatggatgtctgaactacctttctgactttttaaaaatgtaaatacctgcccacctattgtctcctccctgtctggccacacccatattgagtcagaatatccagggacacagcctctgttataaaacctccaatgagtcagccatatgctctgttgtgagatcaccactgccagtgttagttagtcacacgtagcttatgggggacagtgcaccccagtgaggccacctcgagaatcgtctgcagcagtgactgatgttcggcgtaaggaagtgcacattaagatatctactcggataatgtatttgtcacagcagattcttaacatgtttttatttgtgatgagacttgaaccagcctaatatttaggtttaaagtctctaacaaaactaagattcttccctgctgtacacaccctaccctgttgaaagtgctctggcaagtgagacatcatgatgtacagaaaggacactagtttgcctacaaactgttttgtcattttagagttcatcattatcatcatcattattactaccattatttaattttcatcttggttcatttgtttttgattatttttccttttctttcagttgctatactgcttcactgtgacctgccactacccatgttattgattagtgggatgcaaatctagtagtatctctaaaaattcccttgtggaaaagttaatttgttggaagttataagtaaattataaatttctagtctacctgaacaaacataaatagaaagaatgaatagattcgtattcatatttgtgcaccacattttcctgtcttatggcagtgtagtagtatcttggctcactgtgataaaaattaccagggacttatttccatttccgcacactgccacagctcatgacaatttgcatgcagttaggactcaaatatgaaatttaactttttctccaattataattttatggccatattttgtatatagatatattttttaatgagataacatgctagatactactagttttataaggttattaccttgaggcaattactttaaaatatacactaacatttttaggccacttgtctataatttaacacttttttatataccatatcatatttggagtgctaaattttacaaatgggagaaactaaagtccatagagtttttaaccttttaaggtcacacactgatttgtggccagcctcccaaataaagaccaagtcctttaattgactaaccatcactctcatctttattcatgtctagccacttttgataaccaaggacataaaaatatttcatataatctccacaatgcatgtatatatgcatatatatatcaataccctatttagttacgtttctatatttcatatgtaaacatatttcatacagttaaatatgatactgacatatttattgatgtattaggcatttacatgtgcgtatccattagatatatgtctgtgtgtgtataaatactgccattactggcttgatttagaattagttttatggtgtcctttcacttgaattaagaaatattttaaattgcattttatcactttgtacagattaagattcttgccttctccttccttccttctttacctctttcatcctttccctttgggaaaatttgttgaaaatgcaaatgtggccgggcacagtggctcatgcctgtaatcccagcactttgggaggctgaggcgggtggatcacaaggtcaggagattgagaccatcctggctaacacggtgaaaccctgtctctactaaaaatacaaaattagccgggcatggtggcgggcgcctgtagtcccagctactcggaaggctgaggcaggagaatggtgtgaacctgggagacagagcttgcagtgagccaagatggcgacactgcactgggcgacagagcaagactccatctcaaaaaaaaaaaaaaagaaaagaaaatgtaaatgttggccgggcgtggtggctcatgcctataatcccagcactttgggaggccgaggctggcagatcacttgaggtcaggagttcgagaccagcccggccaacatggtgaaactccatttctagtagaaatacaaaaactaaccagctgtggtggcacacacctgtaatcccagctactcaggaggctggggctggagaatcacttgaacctgggaggcggaggctgcagtgagccacgatggtgccactgcactgcagcctcggtgacagagcaagattctgtctaaaaacgaaaatttaaatgttgccgtattcttgtgctgattcttctgtaaaccaaaagtccttttgaatgtctgtcccaattatttccaggttctagttgaatacttcatttgatttagcatatctggtacttttcttaatggagaattaaaacagaaaacattctcaggaaacaaatgcattaaagtcccatctattttaggatactagttacaatgtcttaaatgagtgagtgtactcatgaccctttgtgactttgcccctgagtttcattttgaatggcagttcaacaacccttgctagcatttgcaactcgaaagtaattaactgctctttcagtctggctacataaatgccttaggatgtaccataaaaggcccatttcatgtctcggttcaaggaatcgcctaatgatatgaattgatgttaaatcattgtgagttaaggcagagctgtttaaagaaatgaaaaaccagcacaaagtttcagtttataaacaacaggaacaatattttagtaaatttacattatgtttgtagtctctgaaggaaaattcattcacagttttgtgtcttattttgacttagtcgagtgagatttccccagcaattgtaaaaagtcagtatgacttatcccaccttgaatataaaaaagaactaagacaaccaactcaacaaagggaaccaatgttgctggtttttagctggtctaggagtttacccggtatcagctcaggtgcaaacctcatgtggtgctagcttctctgaggtcctctgcagcagggaacatggctgtgatcgattagctatgtctgccatgcaagaggatgcaagagggtagcagaaatttcagcaagcaagccagcattccagtaataggatatagcggattttatttttccgtgcatttgtatgagcaaaatgaggagttaaaaacagaacatgccaaaaaggcacaaaccacccatagatacagtcttgaaaaaaatcactagatttatgtttttctgagagggagatttatgccggtagaaatacgttgttttgtacaatgatctcatttatcatgtgtggtatcacccacagtggcatcggcatgtggaataccttcatttggtgcctagagagcctttcaacgggcatctaactaatatactgggagtactatttatgataagattgacaatgatataggaaagagtcggtctcagattttaaacaaagagagggactttcttgggttgtaaagtgtgtttgctagtgatttcttagttttatcaagctgtgcatggtatgttttttgcttcagagctttcctttctattcactgctttagtaagacttactactggaagttccctgaatggcagcagtggtggacttcattatccagaatgctcgattctcctgtagcaaaatgaatccattgtgatagttattttggaaaatgagtcatcctggaaatgtatttttgatgagataaactgtaatttcaggcatgtttttaaagtggtgatacctttggaatataaatataaggaaacaatttaatgatataagaactaatacctttgatgattttgaagacattctcaataaggagattaacaatgaatgcttcctagagcttaaatactactacttgagagaacttttaccagttaactttagtggaaaaaaaaaatcctttgatatctgtgtaactgactcactgtaatgagtgggcttactcattcaagatattgtaattagtatcctaaaacaggcatcactttaatgcatttttgtcttgagaatattttctgtattcaccattacaaaaagtatcagatatgctaatttgcatatgctatgcacggtggttggtgtcctaaaacaaattagggttatgcctacttgaataagcttatgtgtttaaagatggtttatttcacaactttgaatgctatgaaaatctttttcaacatactttttcttgttaacccaaacaaaatttttctcatcaatttattcctgaaattttattatcttctacattttaataattgatgcatgtttagctcttttaagactgaagacaaagcatctgaaagacagctttctggtttgtctttcagaaccacccgttcctattgccccacctcagctcgcctctgtaggagccacctacctgtggatacagctcaacgccaactccatcaatggggatgggcccattgtggcccgagaggtggagtactgcacggccagtgggagctggaatgaccggcagccagtcgattccacgagctataaaattggacaccttgacccagatacagaatatgagattagtgtgctcctgaccaggccaggggagggtggcactggctctcctggtccagctctcaggacaagaacaaagtgtgctggtgagtataaggaaccctgcaattaattgtcattgtctttcctggtgttgactggcagcactggggttgatcagatgcctagcacgcttcccctagctctatcaaaacctgcatatgaacagaaaatgcccttagcctgtgaatagtcagctaacagcttgtgaacttggggaccagtaacctccaggcttggtatttctcagcctgcccccaccctttttcctattgttaatttacttcttactctgagtaccacattgttcatataggaattgtctgtgaagtttacagaaactgtctactctaatgatgtcctctaataggtcagactctcttacttgggcccctttgttttatgttcatagttaatgtgccagcagcctggaggggctctggaataacagattccatcttagagatagccttaaagatgtgttttcattgatgagtgtttaatggagggtctgctggcgaatgacttgggcctgtttgtatcataagcaagagtgatttgtgtgctgggtgcagtctttagtttcttagattataaatttctaattgtgctaaacccattccgcaacttaagtaaaagtagggttaatggagagagaagtgtaaaatcttccaaaaatcaaaacctgaatgaagctccccaattagagattgtagtgttgtttccgtatggctactctgtggtaggaagcagagagaaacagtatattgggatatttaagtgctcttttgtcttgtaaatgaggaatttctgtgttgaattgtgtgctgagatgaggagattccataaattgttatggtgttagttaattattcagatagcattagataagaatacatttatcaatgtttcatttctttcttaagttttaaaaatgcttagcatagtcagattctatctggtaggagtaagagaaattattaaaccttaaccattgtagctggtttttaaattttttcttcataatttgtattatactgtttccacaagttcaatactcatggaaaattctgtattttaaaaaagacttttgttagaaaagggaacaggtacttttttcttctggggatacatgctattgagtacagggactggcctgggttagtagactgtgtactttgctgttttgtacatctttcatctgtttctcagaccccacatctgtatcctcgtggcacctttgtgcaggcagtctggtccctggaataagacctgctgttttgatttggtgattcccacagccctgagtggtggctctaaggagaaaggagaatttcccaatcctttctcttcctgtcttctttaaacctcgtcatctcctctatttagttgaataaattccatcattgttgtaaaagttttatcttaccatttgttgcaatgcaaacaatagctatggataatactgcctatatcatttgacaagataggcattgctttcaaatctgttattttaccactgccttatgaattctccagggcaggttctttgatccccataatacagatggtgaaagtgaagcccgtgtgagctcctttctacttctaagctcactctgtaagaagtaagtttagtgttatttcactttagtgttaagaattcctgttttgggcatggcaatatatggtttctctctctctccaaaagcaggttagaatttcattgtttagactggagagagactgtgatctgtttcaattctagtcactagcagccccacctacataatgtttccagtcctgttcttttttttttttttacacatttttgccttttcttttggttttgtgtctgtacatctcagctattgacacattgctgtatatatatccactgattataatgcatgtgtctgtgttttcaggaagccttttgatgctgctgcataatgtgtaaatggataatgctcaaagagacaaattaccttttaataatagattgacagttatttttaagaaatgaaaaccaattttgaattgatatttgtaggcccacactgtgcctcaatgtatgaaacctcacctaaaccaggaagcctaatgacgatgcgccctttcctcttaactgtttgcagcctgcagttggcactgttcgtgatgcatggtctggttgtgccctgtgctggcatggagtcacccttagaaaatggagagagatatgttaggtgaaagggtcaaagttagaaagaagaggggaaggcatgttaggtgggtgaggaaagtgaaaggtgaggaaagtgaagtcaaatgagactttttgctataggaagaaatatggttcaccctttcttgacctggggttttgagaaaatctgcaggtaatatcagtaatcactgattatgatcagtgtggaattttgggaagcaggagcaagttaaagggaaacgtgtgctgtaaattatagactgaaagtttggtatcagtcccaaagtattattcagatggtttgtgagcatttagagtacctaaagagcaaatcatggatttcataaacatgggagagactagaagcattctgcagcaataagtggaaaacatccttggccaggggcaaatggttgatgaatctaacagggtgataagtaataggaataaatctaaatccttcctgtatggttcaaaaaagccaagagtactggcttggaattagagtaatacaatttagcagcaatatgtatgaagaagagattgaggatttggcttcaatgcaaatgaatctacaatatcatccatcttgtataaattatccctgtgatgttagtgcctcaccatcccctgcaaaaaaaaaaaaaaaaaaatcctaaaataatcttaggttgcatcaggaaagcaaaatgcccatattgaaggaggtgatagccttactctaccagtgctgtttaggcttctcataattctcacatttatttctagttcctgctttttaagagagacagcacaaaatagattttgcccatggggagagcaatcaggataggaaaggatgtggaacctttcttaactaatgaggaatggtggaaagaactgagaaggggatggggaggaaagggcacctgtgtaaactcgacaagatctgagtgagtttcttgtggctgatttgttcaagcataacctgacatggtagaaattgatttctatattcagaagaggattgagctggttgaccttgaagatctcttcagtatgaaattctatgattcatttcttgtttgctttctgatgagatgatccaccggatatttctaccctgaaagcctttcagtttcatttttatttcatccttgtctaaatactccataatcatgcttatcaagtactattctttgggcagtgaaggtctgctattacatttccaaaaatccgagcaaagggggagaacgtataagtttttattacagtgaagtaaaataaatttgaaggactgactcactctgagatttcctgcctgggttttgtgctaaaacatcacttcagttcttgaaataatagtgcttttgggtgctagagccagagtcagcggttgagaacacaggctctgggagcagctacctgagttttagtgttggctctgcctggcactagacataggactagagaaaaactgctaaccctctctgggcctgagttgccttatctataaaacagaggtgatgataataataatatgtgtttcattgttttgttgtgagccttaatgagctactgaatatcagttgcctagaacaaactcttacatatagcatgtggtcaatcagagttaactaccatttaataaatttttgtcttttaatattttcattcagaagaattagacactggctacctcattacccaatgttttagaaatattgcttatctgggaaatctaaaatctgagaaccatgatttctattgtgggctcatagaattctttgcagttgtgcattatgttctcatctgttaaatctgtttattttggccaagctctgtgttttcgtttctgtgctgcatcagtgacacctgtcctatcattttttggtgacacccatgaaactgtatttagcttcttgtattaaaatggcaagatcactatttattacccatcattcctgtgtggcttgtagacacagtctcattacctggttggatttctgcaaggattgtattgtaacacacttccaaaactcttgcttcttatgcttctgaaaattatttccaaatatatgcacaagctctccatgcaagaccttgatccaatcacatagcttccctgattccacatcttcatctctaatttggggcagcaacacctgccctgactgtatcagtggtgtttttgaagatcagggtagattttatctgtaaagacatttttcaaagtgataaaatgccctgtcaatatgggttattgtaaaaagtgattatagtcaagctaccttcaagctttatatacatatccagttgttttccaactttgcagttcagctatagttgggtaacttcagagagttaaaattacttcagcatccagttaaacaaaatgcaatttagtttgtgatttctaatgtatcctatattctcaaattatgtgcagcctgtatatcataagccattgaatagtagctacttgaaacagagaaatgggtgatgttgttagattaattttcacagtgggcttttttatgtgttttatttggagatacttctttttatgtattctggttattggttattaactgtggttaagtgacttgccaataactggccccaggagctaacgaaggattattataaactaatgactaaacaattaagattggtgagagtgaagcaaagcttaattaaaatgtgtcctttagcattaatatacctaaaaatatttgaaacaataatgattgcaccttaaaaaattatccataagatgcatattgagcatccgtatttgccgggcactattccaagccctgccagtagagtgacaagatttctgtcttcagaacttatatattttggggtactggaggaagggagtatataggcaacatatatatatatatatatatatatatatatacacacacacacacacacacacacacacgtgtggccaaggcaggaggactgcttgatactaggagtttgaggacagccagggaaacatagcaagactccattgctacaaaaaattaaatgaagaataattagctgggcaccgtggcatacatctgtagtcccagctacttggaaggctgagataggaggataacttgagcccaggagttggagattgcagtgagctgtaatcacaccactgcactccatcatcgacagagtaaaaccctgtctctaatatatatatattactcacatacctacacacaacacatgtgtatacaatacagtgtcagataaatgataaatgttatgaagaaaaatagaagaagggatagagaatagagaggtaggagatgatattttttattattttactatgtttaaatacacataacaaaacttaccatcttaacgagttttaagtgtacagttaaatcatgttaagtatattcagccaatctccagaacctgtttctcgtgtgtgggtacatagtaggtgtatatatttatgaggtacacgaaatattttgatacaggcatgcaatatgtaataatcacatcggggtaaatggggtatccatcacctgaagcatttatcctttgtgttacaaacaatccagttacactctttgttatttttaaatgtacaattattattgactcttgtcaccctattgtgctatcaaatactagtttcattgagaatctttacatcttcccaaactgaaacactgcatccactaaacactaactctccactccccttccccataaccctggcaaccaccagtctcctttttgtctctatggatttaactatttaggtgtctcctataagtggaatcatgcagtatttgtctttctgtgactggcttattccacgtagcataatgttctccaggtttatccatgtcatcacgtgtgcgattgcacctttttaattatgctgataattgaattgtatatatttgtttcatataattctttgtgaactacttagagactataagcactgactttggcattcagtttaaaaatgcaccttctttatgacttagggaaatgtttactagtaaagcatgtactgctgggttcctgaggagtccaagtatgatcagttatcctagaaatgttctgtcctaatggcagagccatcccatccacagctagcctgctgcttgctgggaataggagtgatgtattagaagtctttaataaatgtgatgtgtaagaagtatacacatttttataaatgtgattttttataaaagcgatagtgtttttataacttccatttttttaaatgattgagtgagttttaatatctgtctgcgtagagctatatatttgtctgcctagtatctgcctagttagagctttttacataactataataaaaacttggaatatgtattacattaaaatgtattttgttgtacttagatgctttgataacatgcagtaatagctatcatatctgcagtattttcagtggcagaagatactggacataccttgccactatttggagtcatttcacctttcaatctttgttctgtgaaacgttcagtgtctgcttatcccatttgtgatatgcagttttgtgaatctcctatttttttgtgatgacagtcgtactgttgcacttgaacagatgtatttgtgtagctttcttgtatgcctgccttgttcttctgtgaacaaataacatacataaacaaacatatatttgggggtattggagggagggaatatataggcaacatatatatacatatggaggataaacaaaggattagtgttccttcacagtaaggacccaacattcccgactgtgggaattttgtactaaatacaaatttacggtgttgtgttttcttttatcttataccctgagaatatctctcagtgtgccttatgtagtagcacaccctgtctgtcatacccggtccagtctaaatgtcactagatttaggttcatattggttttgaaatattaattcgctgtgtttgcctagtggtaacactggagtgattcgttttaaatatatctgaatgagattctcatgttggaaatgagtagtgacaggttccttggcaagggggcattacatgaagcccaaactgcaccatgcctgcattcaaccgaaggctgacctcgctgctatttatttattatttttagtttgtttctgtgggaaaaaaggaaataattctggttgaaatgggaataatctgaaattaaaccctgccaaaacctgatgtattttctcttaaatcaaagatagtagtatttgtgttttctgtacagaattatcactggcattgcaataagtatctggacttacagggctgaccctcaggtacctggggccatgtgggagctaatctaacaatggctgttattcggaaggcataaaggccaaagacctaattgagtggagcataatttatttttgatttaagtttatttaccagggaagaaattaaaagtgttctaattctaaaacagttctgccacagggcaacatgttttaatgaattttcaatacatgaagccattaaaaacctttttaaattatgaacattaaaagggcatgaggagtaccttccctattatgctgcagatgtcagatactttgggtcacgtcaccgtgtacataggacaggggcatatcagcaatgcagtgtcttttttattataatatattcagtcccttccttacaggtgtttaggccccagagattctgtaattaatacctaaacctcaagttctgctgcccttaaacacggattcagcactttccctgtgcttgaaccctaaggcagcagcagaggggtatagaatagaactgctggagcaattctgcatgagaggttcagaagctcctctaaaaagtgtggacagatggaggtggttgttcatagagttatccagtgactcttaaggtgttgtgactctctggaaggtgtcaggcaggccctttggctgtgaaaaatgagcgtgctaacagtgctcctcaacttcctctaggcttgtttttgaaatctttgtaggtggcttcttgtgtagctttgaatacactgaggaggccaggaaaatcaagggaaagagctggagattgcagtcgggggcctgtggcctagtcctgctgtccctctaatgagccatctaacatggggaagaatcacagaaccgtttcaggctgtattttgtctgtctatctgtgaggggcttgaccagcttccttgttctagggatctgacaggtcatcagtcgctgtcagagggggtttgctatgggaaaaacatgattgttgttagtatgaggccttgtctgagcaccagctacagctgtgagcgtggtcctgcagcccctgacatgtttgaggatgcctctgcatcctgctgcaatatctcctaggaaaggaagacatctactaaatctgctttgaacaattcttaaagagaccccaggccatcttaatttcccccaaatctcttatatatttagtaagaaaaaaaattattgatgatgacatgattaattttttattagagcacatgccttaattctttatcacatttataatgtggagaggttatattttatgatctttatgttagcatttatactacactggggtcctatgcataatctgtatgtactgcatacgtatgtgttttaaaaggacttggagcataattgactgctttaaattatcatagaggcttatacttttgtgactgcctttgtgaacattcagaggaaacagtgttcccctgggaaacttctttcactttatagtctgactgacttgggtgggtgaatgttggttctggcacaaatagctaaaaactctcaacaaacgagttaaccttgctattcctagtttcttaatccttctggtcagtgtttttttgttgttgttgttgtttgtttgtttgttttaaacagtaccagcattgtcttcataatgctgctgggaaaattacatatgctaatgcaggaaaacttgttagcagagtactttggtcacctggtggctcccgaatgaatcctaagtaggtttactattaaatgctgatacaaaattatgttttgttaccacaagggaaacacactcctatggtgaaatctttcaataggacttttaagctgaatggattgggttgcatttgacacatatacaagttgcagtttaagcaaaacaaaaaatatgtatgtatcttcaaggtagtgccaagaaaaagaaatgatcacatgttcactggaacctgggaaaactttttgttttgcctccttaaggtgtggtcgggatagaaaatagcatagtgacccagggtccctgttctgcagggtggcaaaaaaatagaataactgcaaatacttcatttacatatgagacactgttatgctgtggttgtggatgtgttgcaattattagtgacatgataagtgtttttgacacttttaactttttggagggttctgcccccactctaacactttttttttttttttttttttgagacggagtttcgctcttgtgtacccaggctggagtgcaatgtgcaatggcatgatctcggctcactgcaacctccgcctcccagttacaagcgattcttctgtgtcagccccccaagtagctcggattacaggcacgcgccaccacgcccagctaatatttttgtatttagcagagatggggtttcaccatgttaatcaggctggtagtgaactcctgacctcaggtgatctacccgccttggcctcccaaagtactaggattacatgcatgtgccacctcacccagcccactctaacacttgtaagtttatccagaggactcaaagcttgatggcagtttgcttagagctagaaggctgaggtgcgctgggagacatgtttctcttttgctcatttgcacacataccccaggaaggtaggtgaacccttattgagtgagattggatggctggggtcttggtggtgtggatgtaaggaattaaagcacacaggtaagattgttcaccatagggctgcttgtgagccaggcttaccttgcatccagtgtcgctggcctcagagcgggcaaagccagtcttagcctttgtcttctgaacattttaggaaaagttcagtcactcttgacttaccaggtatgttatgtgttatgtctggaaccactgtcatgctttgggaagcaggtggattttatcttgacctcatatgtcctgtgtacttccttctatccatgctcctctcagcacatccagatgcattctcttcttattcacccagctctcagtttattcgtcctcattaacacgaaatgtgggctcactgggacatactcagtggcatctggcctccagttaggacttgccaacttcatctgtaaggataatgctgcttgtgcttttaaaagctaaataagaagtaagataaatgagagctaaaacttgtatagtcataacaacagattatgaaagattgataatatgtcaaaattttagtttatgagggttagccatgttcctttgtgtaacacttttataaattaattttaagaatataaataactggtaattacctattagaataaactgcaagtgaatagaatgctttaaaaatgaataacgcatataaatggaatttaaattataaatacaagaaattttattaggaagtatagttatacctgttattaaaatagaaaagataatagagctgtttgataccaaaattgctgatcctccatccatgttattaccattgtggaatgagtaatataagtaatgtaactattcaggtaaaatattcccattgaccaaatagcaatatttccttcttatccatctggacaagtgactgtaaacacatatttatagtcagcattgaaaccctttctagaaggaggagccaagatggccgaataggaacagctccggtctacagctcccagcgtgagcgacgcagaagacgggtgatttctgcatttccatctgaggtaccgggttcatctcactagggagtgccagacagtgggctcaggtcagtgggtgcgcgcaccgtgcgcgagccgaagcagggcgaggcattgcctcacctgggaagcgcaaggggtcagggagttccctttccgagtcaaagaaaggggtgacgggcgcacctggaaaatcgggtcactcccacccgaatactgcgcttttcagaccggcttaaaaaacggcgcaccacgagactatatcccacacctggctcggagggtcctacgcccacggagtctcgctgattgccagcacagcagtctgagatcaaaccgcaaggcggcagcgaggctgggggaggggcgcccaccattgcccaggcttgctgaggtaaacaaagcagcctggaagctcgaactgggtggagcccaccacagctctaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggcttgagaactacgtgaagaatgcagaagcctcaggagccgatgcgatcaactggaagaaagggtatcagcaatgcaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacacagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcagatctctcggcagaaaccctacaagccagaagagagtgggggccaatattcaacattcttaaagaaaagaattttcaacccagaatttcatatccagccaaactaagcttcataagtgaagaagaaataaaatactttacagacaagcaaatgctgagagattttgtcaccaccaggcctgccctaaaagagctcctgaaggaagcgctaaacatggaaaggaacaactggtaccagccgctgcgaaatcatgccaaaatgtaaagaccattgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaagagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacggaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacaaaatgaaggcagaaataaagatgttctttgaaaccaacgagaacaaagacaccacataccagaatctctgggacacattcaaagcagtgtgtagagggaaatttatagcactaaatgcctacaagagaaagcaggaaagatccaaaattgacaccctaacatctcaattaaaagaactagaaaagcaagagcaaacacattcaaaagctagcagaaggcaagaaataactaaaatcagagcagaactgaaggaaatagagacacaaaaaacccttcaaaaaatcaatgaatccaggagcttgttttttgaaaggttcaacaaaattgatagaccgctagcaagactaataaagaaaaaaagagagaagaatcaaatagacacaataaaaaatgataaaggggatatcaccaccaatcccacagaaatacaaactaccatcagagaatactacaaacacctctatgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagctcatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccattgtctcagcccaaaatctccttaagctgataagcaacttcagcaaagtctcaggatacaaaatcaatgtacaaaaatcacaatcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcatgaaaatggccatactgcccaaggtaatttacagattcaatgccatccccatcaagctaccaatgactttcgtcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatacctacaactatctgatctttgagaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacattagacctaaaaccataaaaaccctagaagaaaacctaggcattaccattcaggacataggcgtgggcaaggacttcatgtccaaaacaccaaaagcaatggcagcaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtcaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaacagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaagaaaaaaccaaacaccgcatattctcacgcataggtgggaattgaacaatgagatcacatggacacaggaaggggaatatcacactctggggactgtggtggggtagggggaggggggagggatagcattgggagatatacctaatgctagatgacgatttagtgggtgcagcgcaccagcatggcacatgtatacatatgtaactaacctgcacaatgtgcacatgtaccctaaaacttaaagtataattaaaaaaaaaaaaacattaaaaaaaaaaaaaaaggagagaaacatggaatagaaaaaaaaaaaagaaaccctttctaaagggctttttagaaatacattaacatttgaaaaaatatacatattaaaatatatttctgctaaatattatgtattgctattttgctattctttagctcagctataatgctcctaatttgagtaatgaattcatgataaataacattttacttgttaatgtttatatcttgttaatggcctttgaaaatcactgaagtcatagatgtgatataagaaggcaaaaaatatagaagtatatgatgaagaaggtaacagattccctcctctttcagtccctttgccagaaatcatcatcgttaatccttttgtgtttatccttcaacatctctatgtaagctcatttaggtgtgtaaatatcaatatatgtcctcagtcccttccttactaattctaacaaataggattatattgtacatgttattcatcagcttgatttcacatctgccagtattttctgaacagctctctagttgttagagtctagtacaatacatgttatataaacatatataacccacatataatatatataacccactcttattagcagctgtttattcttttgtaatatggatgacctaatttatttagcccctcctctcttgatggatagtcaggttttgttcattaataaagggaatatttcagtaaatatctataaatatatatagtatacaattatttcgatttctataagttaagtttacagttttaaggtagaattgcagggccaaagatatatgcatttaagactttagtaggtgctgtcagattactttctacaaggctctatcaagttatgctctaccagcaaggtgtcacaatgtcagggtcctcaaatgctttcgagcattgaatattaatgatcttttaaaacttaaaaaatcaatttattggtttttaaattatatgttcttgttttaattcgcatttcctcttttccatgcatgtattcagtatatttcttcctcagcaaattgtccatttctgtccttaggatgctttctaatcttttcctttttaaattgtagggatactttctatagtagggttatttaccatttgtcatatgttttcaaaatatttttcttattctaccatttgctgttgactttatttgtggtttattatagagaaatcttcacattttatgtagttaaatttatcaattatatcttttagggctacccatactcattaatacacacaataaatgtatcattggaatataaatcagtccaaatatatattaatttatcttggtagatgtctacatatgcaattatgtttgctaaatgacccattgtttcttcctaatggcttcttactttctagtcttgttttagaagatatttttctacatttttgttgaattttttttagaacttatttttatacttagagtatttagtcagtgagattctggtaaaaaaaaaaaaagacttgaggggaagactccagggctgaggagccttctggggacagttcctttgcacttcaatgatgcgcgaggagaatggtccattctcacctttgcattttgcttgacgtggagcctgagaatgtggcaggcagcatgtgaccacagggaaaccagctaaaaaggcagctgctatgaaagccgagtaggcacaactgagtcacagctcattttggtttgccccatttgtttattcatttattgatttagtctaatatttttgagcatctgctgagaggtattctcctaggctttgaggatacagttagtaggcaaaactaacaagtctcctgccctcctggacacagctttctagtttctaaagttctccattggtgtgcagtgtgtgcacacatttacatgaagcaaagcttacagagattcccagagcagttgtagagaagaggttctgaaagtcaacataaatattaggtcagacaggagcatcacaaataaatggttttaatccggacgttttgggctgcaagtaatataaatgcccctataggctaacaatgaggaaatttattaactcgcattaatgggaaatccataggtaaggcaccctttacagtttgttgttcagtgactcagtaatcttcccagggacatgggctctttccaaatctctgatctattggcctcaaccccaggctggctctctttgtggtgataaggtgacatttaaaagcaactggggaaacatgctgtgttcacatctaacgggcagagaagaatagttccccagtcatagaatgtaacttttttctttcaatcttttacgtcaattaaggaccgataataactagcagattttcatggattgattgccttagtgcacttattcttaaactttaacgtacttcagtaatgacagtgtatatcagaatcacctggaggacttgtgaaaagatcctgactggcttctatcccatgtttatcattcagttggtttagggttggatcaggaatctgcatttttaacaaattcctcagtgatgccgatattgaaaaccactgatttgcaatgatgaagatgcatccttgcaccacacacctattagaatggccaaaattcagaacactgccacacatcaaatgctgggaggatgtggagcaacaggaactcttatttgttgctggtgaaaatataaaaataggtgcagcctgtttggaaaacaggtgggcagtttcttgcaagagcaaacctactcttactgtacaatccagcagttgtgtcctttgacattcacccaaaggaacttcagacttatgtcaacacaaaaacttgcacaccagtgtttatagcagctttttattcataatttctaaaacttacaagcaacctagaggtcagtagatgactggataaactatggtacattgagacaattgaatatttttcagaaatgagctattaagccatgaagagacacagaggaaacttaagtgtatattaagaagtgaaagatgccaatatggtaatgctacatactgtataatttcaactacggtaaggttccacataacagtctttcagtctatgaggtctgcatataagatggtagtcctttaagattataacggagctgaaaatcacctagtaacattgtagccactgtaatttcatagctaatgcattaccttttctatgtttaaatatacaaatactctcattgtgttacagttgcctacagtattcagtacagtaacatggtgtatatgtctgtggccaaggaggagtggactacaacatatactctccgtgtatagtaagctatcccatctagatttgtctaagagcactctatgatgttcacacaatgatgaaatcacctaaagatgtttttcttagaatgtatctctgttggctgggctcagtggctcacacttgtaatcccagcactttgggagcccgaggcaggtggatcacgaggtcaggtgttcaagaccagcctgaccaacatggtgaaaccctgtctctactaaaaatacaaaaattagccaggcatggtggcatgtgcctttaatcccagctactcaggaggctgaggcaggaaaatatcttgaacctgggaggcagagattgcagtgagccaagatcgcgccattgcattccagccgggagacagagggagactccgtctcaaaaaaataaaaaataaaaaatgaaaaaaagaacgtttctctgtcattaggcaacccatgactatatatgacattctggaaaaggccaaactatggatacagtaaaaaatatcagtgtttgacagaagctgggagaggcagggataaataggtagatcatagaggactttttcaggtagtgaaattattctgtatgatactatagtagtggatatatgccattatatagtttccaaaatccatagaatataccacaccaagagtgaatcctgatatcaattctggactttgtgtggtgctgattgttcgttggtacgatgtgttgataatgtgggaggctacgcctaggcttgagggcaggggattgtggggaatcttcatatgcttcgtgccatgcaattttgctgttaacgtaaaactattctacaagataaagttttatttatgaaaaaaaaagagcctcacccttgagtctagggatggaatgagccatccctgagccacgaactgtggaagactaaatcactgaacaaaatcaagggtttggggaactactggaaaggaagagaggaaaatgaatgcggagtaagcaactgacagtggccagtataaaggttgatatgagttgaatataataattgtagtcaaatgactactgagaaattgggtaagatttatttcttttcttgagtaaatgtattcgtttgttaagtactatcagtcagaattgagatctgcaaagaaacttgctgtttttttttttttttaaagcttgattttaacaataaaaaaggttgattgtgacatggatattagaagatttaactatggggatcaattgtaaatccattcctcatatttagcatggatctcaccttagctccagttataatgaaataaattaataatacctgaattgtttttgttttgttttgttttgagacagagtttcgccctttttgcccaggctggagtgcaatggtgtgatcttggctcactgcaacctccacctcctgggatcaagtaattctcctgcctcagcctcctgagtagctggtattacaggcacctgccaccacgcccagctaatttttgtatttttgtagagacggagttttgccatgttggccaggctggtctcaaactcctgacctcaggtgatctgccttcctcggcctcccaaaatgctgggattacaggcgtgagtgaccgcacccagcttcctgagttgtttagaggatgttggcatgcacttcaccgtaggtccctcacacgtgcacaccttgcaagcagaggcaccgatggcctttgttctggtccagggaacagccttggaatatagagatagtgtctctctctggagcactggatgagctttctagttgtccaacataagaaagataatgtctctcttgagagcaaagggtaggcaggtttgcttactgcccataataagagatttggttttcctaactcagggctctttagctgtgatacaaactgacttcatgtgtagcatcaacttggattcctctgtattctcccttgagactttgggggcaaggggaaacaacaagaacacaaagctcatgttgctttgtgcatgctttgctttgttgttcataatacagttctatgtctctggcccaggagtctcctgtcttctgccagcatccatgaaacagtggcaggcaaactcgtaggcttgaaacttgattaagtctcagactcctcacagttctggacagaatatacttgaaagaaaaaaactgacttcttcataatttcctctaactcaaatcttgttgactgggaaactgaggctgggagtaaggaaacgacttgtgcagttttgcagtgcgtctgtttacagaagtgcctggcaaggccactgttaccaacaccctctgataactggtgcctgctcctctcagcgcactttgcttttagcctcactacaaagccagcctctgtgagtctgcccaatagctctggcttagggttgatttaaggatgggattggacagtaagaatctttcacttcaagacagagccagataaaactgacatgaaccaagtgaggtgactagtcgtatagaacatacagatataagctgacagggttattcaacaccgagagatatttatctgccagggtcatttagctgtaactctactaagaactagaatggaaaaccagctgaccatctccattgtttttctattttgtttgcatgttgctgtaaacagtttattttaaattataaaacgggactctatttgaccactaaatggactcaatttgaccattaaatatgcctcgtggcccaaaggatatctagacttagtgaagtggtcacgttaattattttgtctgcaagtaagctcttggtgagcctgccatgctaacttacgaggcgaatgttggtaacactttctctgtttgacacgttagcttggcatataactttttcttttataaagaatttctttgtagtactgtgaaatcataactcttattctatactttatcaatattatacgtggctcttactacataatgatcagtctcagctttaattcttaaaaaggtttatatcataatattaaggttaggatatgaaacattatgaagggtctgtgagcacgtgacagagtattctttcatataaattccaataatgttatatgatttttttttgaaaactcagacatttctttccaccctcagaattgcgtgtagcgacctttaaaaaacagtgcttcaccatggagctgacagaacttagctctgggctccccacctgtattttcactgagccataggcccgtggcaaagaaaattgaatgttgcctgggtgaccttatctataagctgggtctttaatttcattcctggctatattgaagctatagctgttgccaaagtgtctgaaaacaaaagggagggcagagagatgatttctgcagatgatctatgtccagccaactgaggaaatcactgacccgccactgtagagtcctttgttctggccacctttgtctgaccctgtctaagtatataaaaaacacagaagcattcccttctaggatagaatcctggagtttctaagattgacttccaaagacatcaacaatatgggtttctatgtacataaaactatttgggatttgggaggcagaaattacaatagttggcaatttgtaattcttaccgataggttcattggttggatacctttggaaacattttttgaaacgcagatctaagctaaacatctcttttgggcagattatgaatctaaggtgttttatttgagacaaatggttaacgtgttacatgacatatttattagtccaaatgaaaaatactcgttgaaattaaaccttcttttcccaaagatcgtgcagagctcataatatgtatttgcattacatatttttttccaggagtttattctcaggaaacgacatcgtttttaatataatagaagaaatgaaatacaaagtcgaaaaatgagactggaaaagcccaggcactggcattttgtgttgtgctaagtgttccctcgtcaccttgcagtccgctggcagaagtgtggagcggacacaggagaaggctgggatggtgcttggaggctggggaacaggctgcactggcatttccagtgaagtgacttgggacacacttcctctttctgcctgaaaaggactgagggtgaggggccaccttgtcccgccctgggttgatccctcccagatgcccacatctccagggctgtgtcttcagcccagctctcgctcctgcctctgggcatgctggctcctggacaccccacatggattccctggatatctccaactcctctgctctataatgcccctgagcgtcttactcctcccccttggccgtgcctgtcttcgcagccccacaaaatatttttttctaccagtgtctcttacctgaatcagtacttcaagctgcccactcattttggccagaaacctgaattgcccttgagtctttctactacctcacctctgcaccacatcaatcataaatctcatgtactctctttcctaggtgtcttggtgtttcggaggtttctctgcaatgctgcttgcctagcctcagccactactatggctccttattgcacccatgttcactctgctgccccctagagttgctctaccctacagccagatatctttttttttatttttagtatttttagagacagggtcttgctctgtcacccaggctggagtgcagtggtgatcacagctcactgcgcctcaacctcctgggctcaagtgatcctcccgcctcagcctcccaggtagctaggactacaggcacatgccaccacgcctggctaatttttaaaatttttgtagggactgggcctcactatgttgcccaggctggtcttgaactcctgggctcaaacagtcctcccacctcggcctctgaaagcactgggatcacaggtttgagccactgtgtccagccatcagaggtcttttataaatgcacattcagtcctaccatttctaagcaaaaatggacagtgagagactccttaacacacagctcccctatcctcctccccgttgcctgcttcccgtttctccataattcttctcacagccaggcatgctacatgctgagatttcatgtgttgatctgtctccctccactggagcatgagctggcctggcagggcttttgtctggcttgcttactgtgcctgagttgagccatcgaaggcactctgggaatggaaatgagtggttggcgcacattcccctatcatctggctttggccccctctccatcagttccccttgtttttccccactgctttcttagcttcagccttagcactttcattttcttgagatcaaggtgctcttcctgcttatgaagcaccatgaaggtagaatcacacctcctctcccgctggttttctactactcctacctctctgccccccgcccaccaaccccaccttcactctctacttaaatatcccctcctcagggaggctttccctaagcaatctctggacaatggagtcgtgcattcccttattattttttaaacatctaatatccctgctacactggaagcctgaaatcttcaggaaccatatctgcctgtctatgaatgcacacacagcacctagcctagtgtgggctttcaacagatattttggagactgagtccatgtgattcagtctgcattagtagtgcctaatcaacaatgaatgatcattatcttttcctccatggagccacttacatcaattaaagtgtgaggcagtctcccctccaccccaacccctatacttttcccacctgatcttccaactgaagttctctggctcccatacttgccccggaggaatgactgtgatgtgacaggacaaagtactgaaatatatatgagtatgaagtatatgcagtcatgcatccttaagcaatggggctgtattctgagaaatgcatctttaggtgatttggtcattctgtgaacatcatagagtgtacttacccaatcagaggtagcaaggccagctacacacccaggctatatggtatagccaaggctcctaggctgcaaaattgtagagcatgttactgtattgaatgctgtagactcttggaacacaatggtatttgtgtagctaaacattgaaacgtagaaaaggtacagtaaaaatatgatattgaagataaaaatggcacacctgtacaggacatccaccatgaatggagcttgcaggactagaagttgctctgggtgtcagggacctagtggtgagtgaatatgaaggcctaggacattactgtacaccactgtagactttacaaacactgtacacttaggttacattaaatttatttttttaaatttgtgtctttaataataaattaaccctagcttccttaaacttttgtaccttagaaacgtttcaatgcatttttcattgtttggctcttttgtaataacacttagcttaaaatacaaacacattgtacaactgtacaaaatattttcttttttatattcttattctataagctgttttctgtttttaagtttttactttttttttttttttttacttttaaaacttttttgatacctaaaacacaaacacacattagcctaggcctactctgggtcaggatcactgatagcactggccccacctccacatcctctcccactggaaggtcttcagggggcagtaacactcatggagctgtcatctcccagaataacaaggccttctgctgtctacctcctgaaggtcctgcctgaggctgcttcacagttaactttttttttttttagtataagtagaatgctgtaaaataagtattaaaaaagtatattatagtaaaaccataaaccagtaacatagttgtctattatcattagcaagtattaggtactgtacatgattgtatgtgcttgacttttatatgactggcagtgcagtagatttctttacagcaccatcaccacaaacacctcagtagtgtgttgtgctatgacgttaggacagctaggatgtcactaggcggctggaagttttcagctccagcatactcctatgggatgacagtgatatatgtggttcgttgttgatggaaatgttgttatgtggcgtgtgatggtgtatctttctctgaggtttattgaaagtcaggaagcttctacaaggattgtgaggcctcacattcatgactcagggccctgaccaggccctcctgatagctcctatttggcactatctgcattcgccacgattctggcattctcttccctatttccatgtctttttagtgctgttcactttctcagaaatgccttttcctcctcttttctgcttgtcaaacacatgtactttcatataaagtaggggtccccaaccccctgactgccaaccaggtacacctggctgcacagcaggaagtgagccagaggcgggcgagcatcaccacctgagttccacctcctgtcagatcagcagcggccattagattttcgtgggagtgcaaaccctattatgaactgtgcatgcgagggatctaagttgcaagctccttaggagaatctagtgcctgatgatctgagggggaacagtttcatcccgaagctatccccccaacctggttagtgggaaaattgtcttctacaacactggtccctggtgccaaaaagtttggggcctgttggtataaaggaacaggaatgcctgttttactcaccagacagagtctttgccctgcccctgtcctgccatggcactttcaatataggcatttgtctcataggctagaactatgctttttgtctctggctttctcatcattctgtgtaagacctaaatcttacctttttttctcttgtgcgctattgcctggcacactgtagaagcccaggaaagattttaaacatttaagtaactgctcctagttctgtctcaatcagaactaggagcagtcctactttctacttgcaacatatttgcctgtcttctttgccactaaccttcgttgagaaaataatctgtgaaaggtcattatcaagttatctcagcacttatttaatgtgtgtttagctgctttagctgctttactgtcacataaaaacgtgccatagtaaaataaagtaacaaagctgtcaataaaaaccccacttccactcaatatttaatgctaaagagccagagacatttgagattttcatccataatgctaaattgatgttatcaaggtcggtagctgatcaatttgccttgaaatactgttcacttgatgaatgaaactgtaacttgttagaatatggtgtgttctggaaaacaatgtgttttagtattctttacataatagtctccaaataaggtcaagataggaagcagcctcatgctatgaagcacctggtgtttctaacaaagcaagggcagtgatgactgctgatcagccaccatagtcaccaaagagtcaagaaaaatgcaaccaccttcttgagggcattagagtttataaggtaccaccacatccgttttcttacctaatcctcgtaatgattgcaagagagataacagtatcctcattttccaagtcaggaagcttgggttcaaagaggttaaatggtattcagaggtcacacaaagctcaatacaatcccaagtgtttcctgactcccaactgggttctttctgctatgatgtagctacttcattgctacaggactaaaaattgaaaatctgtacagctgtattaaatatttagaaaatctaccttcgtgattaatattttttaatttttttaatttttaatttttgtgggtagtatacatatatgccccatatatatatgccccatatatatatatatatatatatatatatatacacacacacacacacacacacacacaaacccccatatatgtatatgtggggtaaatatatatatacacacatatataattatatatatacatatataaaaatatataaatatatggggtaaatataaatatatacatataaaattatatacacatatataaatatatacacataaaattatatacacacatataaatatatacatataaaattatatacacatatataaatatatacatataaaattatatacacatatataaatatatacatataattatatatacatatataaatatatacatataattatatatacatatataaatatatacatatatatacatatataattatatacatataattatatatacatataattatatacatataattgtatatacatataattatatatacatatataaatatatacatataattatatatacatataattgtatatacatatataaatatatacatataattatatatacatataattgtatatacacatataaatatatacatataattgtatatacacatataaatatatacatataattgtatatacacatataaatatatacatataattgtatatacacatataaatatatacatataattgtatatacacatataaatatatacatataatagtatatacacataaatatatacatataatagtatatacacataaatatatacatataattgtatatacacataaatatatacatatactggtatatacgtatataaatatatacatatactggtatatacgtatataaatatatacatatactggtagatacgtatataaatatatacatatactggtagatacgtaaatatatacatatactggtagatacgtatataaatatatacatatactggtagatacgtatataaatatatacatatactggtagatacgtatataaatatatacatatactggtagatacgtatataaatatatacatatactggtagatacgtatataaatatatacatatatggggtaaatatatatatatgtatatgtatatatggggtaaatgagatgttttgatacaggcatgcaatgcagaataaccacatctcggagaatggagtttccatcccctcaagcatttatccattttaaaatgtacaattcagttattattgatgatagtcaccctgttgtgctatgaaatagtaggtcttattcattctttcatgattagtatttaaagagtaaactttaagtagtgtccaggggataggtggactctagaatagttgtagagtttgaatgtacacaaaccctaatgcaaatgagttatttcagagtcgggatacatttcaaaaaactccaactgactgtccctgacagtgtaaaactttcagaattcctcagaaaagtaaacctttgtctcaaaattatgctttgaagtttgaagataaaaggagagctgtctaaggcccaatgctcaaatagatggactaaaaacattttagaaaaattctggagaggttatcagaatttgaaatgaatgtgataacagatcccctatagttcaagtcctcagtagtgcgtaacaggatttaaagcagcttagctcagactaacgcatacaagaaattaaagccttttacagggttttgaaatgtgtttcattttctcaggaaagagaaaagcagattccttacttttatgtacctggtcacttaggaatattttgtactgtatggttctggtccgttcttagagcaatacagagaaacacagtagaacttattcaaatctgtgattgccagctgttgcctgggcagtgtttcccattgccttttggtgccagaatgagctagcattgttttggtgaggattggaagcctgtgccctgacatggagaacagtacatgcacatccccagccaaggccggtgaatgaaggtgtcatggtctgtgagaggttcagccatagcacctggtgctagagtaactcaacatccatatgcaagtgcagggcaaaattgtgaactaaaatggcctaaatttagcaaatgttttaaaaattggaaaatatctttatagacactcatttataatggaggtctgagttggtgttttggactgaatttgtgttcctcactgattcatgtgctgaagtcctaaccccagtattatagattgtgactatatttggatagggtctttaagaggataattaacttaaaatgtgataatccattatgaatggtgtctttgtaagaagaggagattaggatacaggcattgtacagagagaagaccatgggaggacacagggagaacacatcagcaagccaaggagacagatcccagtagaaagtaaccctgccaatgtcttgatcttgagcttccagcctccataactgtagaaaatgtgcttattgtttaagccactcagtctaaggtacttgtttatggcagccctggaaaatttattcagctggtaaccccaacatggggactgtcagttagacacagcgcttttgagctgtaactgtcctccaaaaatctgtctttaattctctactgcccacagtagatctcttgagaaacaagtgtaaaagtttatgtaaacccttggtcagttgtgtttaaatattgttttagaagaattattcttacagtcagaggaaagttgacttggttatgatgatgttagtgggttgaagctggctaagccaccagtaagggagcaagtggagaaacatttattatctataattgtttttaaattattaataacataagctcttgcttcagaatacttaacgtataacagacatgagaatcagtgactgggggaagattagtcatgaatgtttcttggcaggctccctgtcattccactaggtccatgatctgcggtgagtggagacaaacctacagcaaaccgatctctgttattctcacagggataaaggatggggaatggggacccctagactctccagggcacagctggggctgatggtgaaattaacctgggaggtgctttcatttctattttatctggtttagaaaactcataaaaagtaagtagatttaatatccattaaatcacatctaattttaaaaacctactaaagattaaaaccattttttcagagtcagcattatgattcacttttgttcacagtcctcatggatttattttgaaattttaagtaaacagaaacttttcattctttcttgatatcttcacaaacaaatatgtatttgaaaatgtaaatgatagcaggcacagtggctcatgcctgtaatcccagcactttgagaggggaggcaggggatcacttgagtccaggagttcaggaccagcctggacaacatagtgagaccctgtgtctacaaaaaaaaaaaaaaaaaaaaaattaaccaggcttagtggcatgtgcctgtcctcccagttactcaggatgctaaggcaggaggatcgcttgagtctgggaggttgaggctgcagtgagctgtgatcatgctactgcactccagcttgggtgacagacctaggggatctgttatcatgttcatttcaaattctgagctagaccttatctcaaaaaaaaaccaaacaaacaaaaaagaaaatgcaaatgatttagagatactttcaatgatctgaagtttttggtaaaattaacataatcctttcattagtttatggttttaaaattaggccctttctaattttgattaaaataaatgaaaagggctttaaaattttttattttttattgtaataaagtatacataaaaatatttatcagtttaaccattgtaaatgtacaattcagtgccattaaatgcattcataatattgtgtaactgtcaccacgatctatatccaaaacattggtatcatcccttactaaagccctgtacttaaaacgacaacctccactcctcccctccacctagtcccagacaacttttattctattttctttctctgtgaatatgcatattctgggtatctcataaaagtggaatcataccatggttttccacgtgtctgacttatttcaacaagcatgatattttcaagatctattcatgttggtagcatatattaaaatttccttacttttagtggctgagtcatattccattggatggatataccacattttgtttattctttcacctgttgatgggcattttggttgcttctaccttttgattattttgaataatgctactatgaacattaatgtacaatatctgtttgatttctaagggcttttgatacaagttagatttaggccccagaaaatgtcagattggagatcaagttcaacataagaatggggaaaatcatctatagagcaaataactattgctaaggttagagaatatagtacctttatttaagtacatattgcttattattattaatacatattcaattaatacttgttggtcataggtaagttgtaaattcactctatatttgtttttgtggctattacatttatcctaattaccactgacacaaacctgagagagcagcaatgttgatgggtgtggctaattttttttttttaatttcctagttacaggcaaagtaacaggaaaaactaaatgacttctagtaactggcattactgtaccaaaccatgggcagtatatcagaggcttgcaggttccactgaaatttatgctcaccttgcttccatattgctattattagccccaaaccaccatcttggttcatcttaacatagtgctttatttacagtgcatgttaatgtttatttcttaacactaattaagatttagccatgcctccttgagcaggacgtgtaagcataataagaagcacttctgtatgttcttacttataataagaagcacttctgtatgttcttacttccaaacaagaagctgcaggattcctgtccacccactatgcatatgggatttattcacttcatcctgctagataacctcctgtccccttgttgacttcagtttttctagcatagccaattcttcttggttaacatttttcttaaaacttctggttaacatttttaatgttgaattgatttacttcctcacactttctataagtttccagaataggaaaaccattcctatattattcactggccaccatctgctctcatactcctcacttcacctctcacgggcctcacctttgctcgcttcttttgtgaagctcttcaaagctttctcttttctcaggatgatgtttttgcctgacattttcttccttcttcttctttttattcttttgagacagtcttgctctgttgcccaagctggagtgcaatggcacgatttcggctcactgtaacctccgcctcccgggttcaagtgagtctcatgcctcagccttccaagtagctgggattacaggcatgcaccaccacgcctggctaatttttgtatttttagttgagatagagtttcaccatgttggccatgctggtcttgaactcctggcctcgtgtgattcactggcctcagcctcccaaagtgctgggattacaggcatgagccactgcaccctgaccactcctgatattttctgaacatttactctttccatctatcctaacactaactgtcatgcaaaatgcaccaatgtctttgtatttttgcagtgtgaagaatcgtgtgtgtttgtgtgtgtgcgctaagtgtgttctgtggtttgattctcctgttccttcactgtagctagtttattttaggttatattctcttaataagaagagactatgttgacttactttggataatgtcataaatagattgctgtgtactaaatggtttcaatgatagtatttttgagtgataactacttacaaatattaaaaatatgaatataaaaattattcaatattcagccaaaatcttttagggttaaaagcctcaaatgggttatttttatgattcaggagttcttcccaaaaggatggcaatgctgattggcattgattcatggagatgaagctcttagccttctgtccttcaggcttaaacagaggaggtatacatgtagacagtctacactgatcactgagacagagaagtgccttctccattcatgctgcctttttaaaagttgtttttttcttcaaggatagactctgtgttaatgtcagcccagttctctgtgtatacatgatggtggggcctgggggacgggggatgggtggattgcaggaagcttgtctcagtgtgccaggttttgtaggtgacagggtgtagtaatggtttcttacatgaatgattgctatagctaatggaggtcttgtgaaaatgattcagattaagcttctggtttgctttaagcttactgacccagtataattgagtgtaattcagtggaatcagtgaatttgtattcttacagttaatagcaatatattcttgagaatgaagaaaccatgaatgaggttcttaatttgcttttctgcatcttccatgaccttaagaaggatttcatgagagcattagggaaacttcaaaaaaattctctttacaaacactttacacctcactcactgttaaacatgatttatgttgataactgtgctaaagtgagaaataatgcaaaataggggatgtcatggttgttttatttaagggacaccatgcctttaaccacctgaggattgtagtgaccttaccagtaatgtcaatggaactattattatttgtgactagaaaatggcttatgactataaagaaaagaaaggagagagagaaggaaagctaaaagaagggaggaatggagggagatgaggtgacaaagaacagaggcaaatctaaggcaatcttcagaagtagtaaagtaaaacggaaatattggtttgcaaggcagtagcacataatagaatcgcagggtctaatttcattaacattcttgcagcaaataattttcctgaatgaaaggaaccagctgcaccaagcagatttatattttcagtagcaacccaatctagcaactttgtgagcatcttagatttggtttagttttaaactaataaaatcttagctgcctgacccaggagagctttttctcattagtaactgacacaaaggattttgttgattgtccacatggtttctgattcccagaaaaaaatgagcagtgaatgttataaaggcccataagttatgggatgtgagtaggaagccgaaaacttaataggaaaaccataggaaagaacccatcatgagatacatggatgatgtttcagattctcaggagattaacaaagtatctagaggtatttatccaatatgatgtttcttgggcataggaaaagctttttaaaccatcgaccagcctccagaaaaagatacatgataaggtaaagaaagttagtcaaaaagaaaaagaatctgtgactccattaaggaacaagagctactttgtgtaaaactgatgtgtattttcctcagtaccgtgccctgagtgggtaggagagggagttattataacctcattcctgcttccaccagagcacctgcactaaaaactgttttatcttttggggttctgggtatgatcctgtttaacaagatattttgactacaaaagtgtaatttttttttgaactatctgcctatatcattcacttctttgagcatggaggcaatggaaaatcttactacaatcaagtaattgcttcattagagaagatttatccacagaaattgatgagattaagtgtcaaagcattgttgtttcactcagtgcttctttgaggttcagaagtacttcctttgtacacttaaatggcagaagtgagaagccaaacttcacatttgctgatacctctaaatagctttcttgtcatcatcatcagtaaacacacacaggtaggtagacagtagatccagggaccaggggcaacaaagagttgtgcatgaatttgtagtttatttgagaaacaaaacgttaacacacagaaaactggtagtacggtacaggaagtcctaacttattgtcattgataggttctgggaaactatgactttaagaaaaacattgtatatcaaaaccaattttaccataggctaattaatataaatgagttaagttactatgtgatatttctggtcaagaaaacatcaccaaccttcaaaataaagacccaaaaaccttctaatgttaaatattgaaacaaatgtgagctatgtgtaaatgtaagaaagattaataaaaacaagtaagacaattatttattcaatttttggtgaatcagtgaatgatggcagtagtagtagtagtattggtgggttaaatcaaagaatacatatttacaaacaaagttataatgagcatctgttaccatcctaccaccacacaattaaaaaaacattaatgacatatcgtaaaaaaggattcctggcactgaaaaatttaatgaatgaaataacaatacagttgacaccttcagcagtggattaggtcaagcagaagaaagaatgactaaagttaaagataggtcttttgaaataacccagtcagacataaatgaatgaaaaaaataattttaaaaagaaagcctaaatggcatattggtcaccatcaagtgaacaagcattcaactattgtgaatgccagaggagaagagatagaaaaaagcattgaaaaacctattaaacctgaaataataaaaatttcttaaatcttaaaagagatatagacatccaaatataggaggcttaaagacttctgaatatacttaacacataagtctcctctttgaggcacattatagttaaactgtcaaaagttaaagagagaattctaaacaatagaaagagaaaagcatcaagtcacatgtaagagaattcccatcagattaacagcagatttctcagctgaaaccatataggtcaggagaaaatcgagtgatatattcaaagtactgaaagcaagaaaaagactcctggtgaagaatactatattcaccaaatgtgtccttcagaacgtaaggagatataaagtgtttcctagacaaacaaaaactgatgggatttgtcaccactagactgactatatgagaaatgcttaagaaagacctacatctggaagtgaaaggatgttctccatcaccgtgaaaacacactaaaatatataacttattgaaagagcagatacgtatatgagaaaccgaaaggaatgaaatgttattactacagaaagctaccaaatctcaaagataaacatcagagaggaagaaatgaataaaggatttacaaaacaaacaaaaaacaatgaagaaaatgacaggaataagttctcacctattaataaccttgcatataaacagtttaaatctcccagttaaaagatatggactcactgaatggataaaaatatataatatagcaagacccaaccatattctgcccacaagaaactgacctcacctataaagacatatagattgaaagtgaagagatgggaaaaaataatttatgcaaaaagaaaccaaaagtcttcagtagttactatacttagacaaactagaactttaagtcaaaaaacataaaaagagacaagatcagtacataattataaagggatcaattcagcaagaggatataaataacacacacacacacacacacacacacacacacctaacactggtgcacaagatatataaagcaaatatcattagcgctaatggaagagatagactccgttacaataacagatggggacttcaacaccaaacttgcttgcagcattagatagataacctagatagaaaatcaacaaagaaatattggacttaaactaccctacagaccacatggacctagcagacgttacagaacctttcatccgacaactgcagaatacaccttcttctcgtcagcacgtggaattttctccaggttacactatatgttaggcaacaaaacatacttccataaatataaaaaagtcaaaatcacttcaagtattttatcagaacacaatggaataaactacaaatcagtagcaagagaaatgttggaacctggaaaaaatatggaagttaaataatatgctcctgaatgataattgagttaatgaagaagtgaagaaggaaataaaaaaatggaaacaaatgaaaatggaaagacaacataccaaaacctataggatttcacaaaagcagttctaagagggaagtttatagtaataaatacctacatcaaaaagtagaaagatttcaaataatctaatgatgtacctcaagaaaccaagaaaagcaagaacaaaccaaataaaaaattagtagaagggaagaaataataaatatcagagcagaactaaatgaaatggagacaaaaatagagactaaaagagattaacaaaatgaaaactttggttttctgaaaagataaaatagataaacctttagctagaccaagagaaaaacagaaaagacccaaaaaaaattagaacaaaaaggagacattacaattgataccacagaaatagaatcattagagactattaggaacaactaacaacaacagattcctggacacatataatcaaccaagatagaatgaggaagaaatagaaaacctgtgcagaccaataattagcaatgagattgaatcagtaataaaaagcctcccaacaaagaaaagcccaggatcagatggctttaccactgaattctaccaaatttataaattagaattgagatggattcttctacaattattccaaaaattagaaaaggagagaattcttcctaactcattgtaatagacaagcataaccctgataccaaaaccagacaaggatgtaacaaataagacaactacaggcatcatcatgatgaacataagtgtaaaaatccccaacaaaatattaacatagtaaatccaacagcacattaaaaagttacaaagactatactttcagggatcatttctatagttcattactagagaagtttctctgaatgggtagagcactggaaaccatgaggaggaggcacagtgttctctcctgagcatgaagctgactcttggtgttgcttcactgcacctgccatgtgccactgatgattgttcttgtcttcctctgggagagtaagacggagagcatgcagtctgagtgcttcccattttattgttgtgtactaagaacagtgtttttgttgtacatgagggtgatagctttaacatttagcaggcaaattgttttgagaacatgtcaagtgagagcttttttcctttgttctttgcttgctgaagggatccttgtggggtgggctgcttggtctgtcacatggctctcaaaaatagtctttctaattccagtattccttggtttttctgggcttctgaaggtttttactatgtagtgatttcagaaagttcattattgcttagtctgctgtgtttagttcccttcaaggttttgtaaaagagacaaaagcttttatttcttggtaggtaaagcatgttgaagttatccatttactctttttttcctttttttctttcctttctttcttaaaaaaaaaaataaataaacaccatgatcaagtgagatttatcccaggggaaaatggatggttcaacatacgcaaatcgatgaatgtgatacactacatcaatagtataaaagacaaaagtcatatgatcatctctataggtgcagaaaaagcttttgataaaatttaatatctcctcatgataaagtctctcaatgaacttggacatacctcagaattttaaaggcaatatatgacatacagctaacatcataccaaacagaataatttgaagcttttcctctaaaatctggaacaagacaaggaagcccattttcaccactttcattcaacatagtaatggaagtcatggccagagaaatcaagctagagaaaaaaaataaaagtctccaaattggaaaggaagaagtcggattgtccttgtttgcagatgacatgatcttatatttagaaataccttaaaaactattaaaaagctattagaacatgtaatcaatttcaataatgatgcagggtacaatatcaacataacaaaagtcggtagcatttctatacctaaacagcaaacaatctgaaaatgaaatcaagaaagctatcgcatttacagtagttaccaaaaaaaaaaaaaaatacctagggataaatttaaataaatgaaagttttctacagtgaaacctctaaaacactaatgaaaggaattgaaaacaccaaaaatgaaaagatattacatgtgtatggattagaagaattattaaataatattcttaaaatacctgtattacctaaagcaatccatagattcattgcaatccctaacaaaatacaaatgacattgttcacagaaatagaaaaacaatcctgatattcgtatggaaccacagaaaatcctgaataaccagagcaatcttagcaaaaagaacaaggctagaggcatcccactacctgatttgacaatatgctacaaagctataataagcaaaacagcatggtgctgcataaaaacagacacatagaccaacggaacagaagagaacctgttaataaatctacatatttatagtcaactcgtttttgataaaggcttcaagagcatacgatagggagatgacagtctcttcaaaaaatagtgttaagaaaactggatctctgcatgcagaataataaaactagacccccatcaccaaatataaaactcaaataaaaatgatgtagacttaaatctaagactgaaactatgaaactgcttaaagaaaatgtaggagaattgatttggtacatcattggtctgggcaaatattttttgttaaaatattgaaaacacgtgggaaccaaagcaaaaaatagacaattcagattttttaaaaagctgcacagcaaaggagacaatcaagaaagtgaagagacaacctacagaatgggagaaattatttgcaatctatccattggataagtagggattaatagctagaatatatgaggaactcaaacaacccaacaacaataacaaaaatctgattgaaaaatgagccagtgacctaagtgaacatttctcaaaagcagacattcaaatggcctgcagctgtacgaaaaaaatgctcaacatcaccaatcattagagaagtgcagatcaaaaccacagtgagataacttttcatcacagttaatgtggctattatccaaagaaagttataacagatactggcaaggatgcagagaaaggagaactctcatgtcaatgttggtgggaatgtaaattagtgtagccattatggaaggcaatatagaggttcctctaaaactaaaaatagaactactgtataatacagcagtcccactgctgggtatttgggtatgttgcaaaagaaaggaaataagtatattgaagagagatttgcactctcatatttattgcagttctatttacaatagtgaagatacggagtcaacccagtgtccatcaatggatgaatggataagtaaaatatagtgtatacacaaaagaatattattctgccattaaaaaatgaagttttgtcatttgaagcaacatggatgagcctggaggacattatgttaaattaaacaaggcaggcacagaatcacaaatgttacaggttctactcatatgttggagctaaaaaagttgatctcatggagttagagagtagaatggtggttaccagagactgagaagggtaaggggttggaagccccaattaccctgatttgattattacacattgtatacatgcatcaaaatattacatgtactccacaattatgtgaaatttttatgtatcaatttttaaaaattaaaacatgacactattaaaagtactgcgtttattcctcatgaagatatttgtggactaataggaaaaaagcattaaatattttaaatatagaaagaatattcatatagtgaaaaaaattacaaatatggcaggctccccaagtacttttatacaacatttttttttatgtttttttgagacaatcttgctgtgttgcccaggctggagtgcagtggcacgatctcagctcactgcaacctccacctcccgggtttaagtgattctcatgcctcagcctgctgtgtagctagaattacaggcatgtgccaccacgcctggctaatttctgtatttttaatagagacaggattttgccatgctggtaaggctgatctcaaacttctggcctcaagtgatctacccgccttggcctcccaaactgctgggattacagatgtaagccactctccctggcctgtatagcattatttattgtgcatttggatgattattgtatactttatgaatttttataatttgtattcattccttttccaatctgcttattcctgcttagcatcacaagtagtcagagcctatattggcagctcaggacacaggtgggaaccgccctggacaggacgcctttccgctgcagagtgcactcacatagccccacactcacttacaatggaacacttgagagaatcccattaacctgtcatgcacatctttgggatgtgttaggaaaccaaggtacctggagaaaaccctcacagacatggggagaatgtacaaactccacacagacagtggcactggctagaaattgacatatttttctcatcggtgttataaccagatgacatggagtgagacagtgttattgagaacctggtatataaccagtatttaccataagagtcaagtcaatgatacagatgatagtatcagtataggctaggtgattggggtgagtcctttgagaaagcaagccttgagctgggctttctggaaagaaggtacaatccttctctgagcagaggcaagtgggatgggatgctaggcacagaagacagtactgatgacagtttgcaggagggactttcagttgtttaggagatagtggtaaggtattaggttggtgcaaaattgacaatggcaaaatacacaattttgcaccaacctaatataatgtgttgatgctaattgagcatttgttttgaaagagtagtaacagagaaggttccaagatagacagatgctcaaatgtgggaaaattattgtactagggttctccagagaaacagaaccaatatgatatgtgtgtgcacacacacaaagatttattataaggaattggcccacatgtatggaggctggcaagtcccaagatctgcagttggcaaagtggagaccagaagagcctgtgctggtgtggttccagttgtaaaggcagcaggctcaagacccaggaagagctgatatttcagttcatgtctgaaggccaggaaaacaaaaagaaaaacaaaaaacaatgtcccagttcagaagcggtcaggcaaggggaattaccagtctctttgttgtattcagccttcattctattggacaaggcccacctgcattagggagggcaatctgctttgctcagtaacgtgatgcaggtgttaaactcacccagaaacaccctcaccagaaacattcttcaccagatgtctaggctgcctctcaccttgtcaacctgacacataaaatcaaccatcagaatcatgaatgccaggaatttacatttaaattgtagatagttgaatatgatgctttatttaggcaaaagtccatagttagataaactgtcagcagatacatttattaaggtggcatgtgtctgttattaatcatatcaatttgtttattcccctcttttgatgtataatggtcttactgtgtgccaataagtgaatatataaaataatatgtttggatttctacaggtgtatttgaataacagaattctcacttgggggcccagcttcaattcatatttacatgccaagataattgttgatgttgtagagaggtgcttagttaagcaaagagatgagcacatctaaaatcaagctgggaataggatccttaggaataaatatttatgttcacggacattagtctaaagtggcatctttaaacctaccttttttgtgtgtgatagaaacatagagttacaccttatggtgaccgcctcatccatttcacaccatatatcatgaagtcacaagaaaagaagaaaatcagttctggatggcagtgcagactaaatgttctttcataggaagtcaagaaagtagcttttacaattgccaacgtttatgtgcttttccaaagacttgttcacattcttctccagcagtggcaggcacttgaataaactactcaatttggaacatagcaaatgacttcctggcctatgaagaatggtggtggcaataaatgggtggaacattgcaggcacctaggaaagagagcaccatttctaaaatgtttagtgaaaatagcattttcaagcaaactggaaatgtctgattgggggcagaagagtgagcaactgcagctttgaaggagagcagggtaacatgctacattcagcatgtgcctgaagtcatgggtccagcagctgtaccacctcttgctgtctctgacagcattggcgaggggtctgaattcgttgcaagtctctgctgagaagggctggcacatttctttcctgtgtcctctgttaggggatagcgatagactcctcgtaaactccaggatggagcctagttaggcctgtaagtgctagtgtctttgctgacagaattgctgagataattactgccacctcctcagttttgtgtgtcacaggccattgtccagttatggtttctctgaagtgaaatttggtgcatgcgaatgggtgtgtgtgtatctggctcgaaaggtggagctgctgagagattggactgccactcaggctaaaggttttctggtgctagacaactggatgaaaggtttgtttttttttttatttgcccctccaccagcctagatacacactggcttttgtgactttatagagttattctcaggtatgtattccaaaactagcaataattgtgaagtgattccaagaatccagtagttaagtctgtatggctcccaaaacccatgtccccttctctgcctaatcttccttaataaaaagccagttgatagtttttctttgctgagctctagcagccagttggcctggtgagattgaataacatcaggtagccatgtcaggcgtttggaaagcctacaggcagaaggcagtaagaatggtcttactgaacacatcatattctaccaatgttaagacatagatttatggcctctagcacaacattcactgtcagcacctgctgtgtgtcataattgatgtttcctttggtttccttgaacagttctgcctcagctaatgccattaagtttcagaacttaaaaagagttattgttaaatgtggaaaactgctcctgattattttggccattagaggaccacgtgagatgagatcatagaaaaattgccggtaatccatccactgacattcacactctatctagatttatgaagcactcccccaaggcagaaaatgcatctggaaagagtgcctaatagacatttaggtgtctggatgctgaatagatgcatatatgcatagtttctccattttgttatttcacttctgtttctaaaaaccttgataacatttagaagcaaatgttcagaagggaatgaaggtcctgccatcaggacaagacatttgggtagtagagcacataattccttaccaggtatgatttgacctgaatgcatgctagctcttgagtaggttagaagtaagcaagacttgaaacaaagcaaaagtcagaaccacaggcagaaaagacataatgtcacatccttggatgcctggtatgagaatgcagaatgttggcaagaaagatccatgactctgggagaagatggggaccctgttttctccaccattgtgagaaccagctctgcgtattctcctgtgtccgtgattgtcacagggtggtctccaaaccagcaagcatcagcatcctggagaatgcagacgcccaggctccaactcagatgtattgaatcagaaactcttgagtggcaagacccagcaatcttgttttaacaagtcttgctggtgattctgatgcattttaaagtttgagaaccaataaagtatcatccccaacagaggtggagtaaagtggatttcacagaacatttctccgtgattgcaattctcaggctgagatggacaagaaatgctgatacatctctgcccactgatttgacaacttgagagactaatgggttttaggagttcttattttttttaattccaaatgtttcgttttgattaaaaactgaaatatcaaagaattctctaaaaattctctattaggaccaaaaagatgaaatatacaaaacagtctggcatttgcttttgtgctgttacccagagtgtttctcattttgccatggctgagaaaaagtgttggtgatatagtttggcagtgtccccacccaaatctcaccttgacttgtaataatccccacatgtcaagggcggggccaggtggagataattgaatcgtggtggtttcccccatactgttcttgtggtagtgaataagtctcatgagatctgatgattttgtaaatggaggttcccctgcacaagctccctcttgcctacggcgacataagacaagaagtgcctttgcttcccaccatgattgtgaggcctccccagccatgtggaactgtcagtgcattaaacccctttcttttataaattacccagtcttgggtatatgtttattagcagcatgagaacagactaatacagttggcaaatttgggcatcccatttccagtatagacaacagaattattctccagatttagaaagagagaggaaggtgcctcagccagggcatctgatgactacacttgcagaagatggtctgagcaccgtatcacatctgctgaataaagtacggatcagttccggtcctcatgttaccttcaagattactaggcaaaaataaagtcatagctgtggcttaaagccttaaactaaattctgggagttaattacattatggacacgaatgcttttaagagattgtgtatttctttgcatctgtataattgcatcattagttcaacagcttcatttaatgcacatttgagggcctattacatacaagctggcattccttacctgctctcctagtgttgcctcttggccttctgtctgtgaccattctacttaaagaaacttagggaagaaggaagataaatattcgctttccttttcttggccatagaagcaccaagttcagtcattcatttcaatgggagctgagtgcattcttccagccctcaaaagcacttaaacttttctgatggcccagtgttgactatgtggaaattccacgtctctgaaaggaaatggaaatgcttcctttgtggactgacctattcaggaatttcatagggcctcagagaacatgacagagggggaatctcagctgtgcactgaatttctctactccaagtcactttctctgattgagagtgcgctgaaaattgttttgaaaaccaaactgaaagcaaccacttacttacagtaagggttgagaggggcatgttggataagacccttatgaaagggatccatagaatcactgtaattttgcaattcgtggatctagcctatgtttttatgtaaattgtgtgtgtgtgccatgtgagtaatgtctgccttatagggaattgcgtagaaaaattactcaggcaattcaaatggataacatttggcatgagttctcatattttgactggctgtttgcctgcctatctagtgaactttaaaaaaaaaaaaagaaaatgttctaacaggcttggaactgagtttgcaaagataggatgggcccaagttagtattacttgcagcccccagtaattcagttcagaagatgactgacctctggcatgagggatgaaagacataatgagggaaagccgatggcatcaggaaagggagcaatgtttcaacagctattaggctggtgcaaaagtaattggtaatggcaaaaaacacaattacttttgcaccaacctagtaattgctatagattgcacgaagccagaaggagccaggaggagagcttatggggggccctgtggctcgtgccacaagttggaataaacacagaatcagatcaaggcaatcgccgtttaccctacttttactgaaaatttgatttctttttttatttacttaaggattgaatttgttgctaactcttttccctcaaatggttccccctcacccatgcatttcagtgaagaatatgttttcagtgcatataagtgatgacaaaatttgcatttctgtagactccagctgtctggttatgtaaatgatgagcatacactatattgtattttccaaaagcacatgtgcagcttgtatagctaagtgttaaatttatttcagaacttatttaaagaatggtcctttgggcatggctggtgaatggttgcatggaaaaatatactcaaaggcagggcaacgaaactgtagaaaatgtctgtctcaattaaggaatgccctttgatattcaagtcaactgtgttacaaataaatcaaaaaaattcataaaccctctcaagtagagccatctgatttttatacgtatataactaaaatatcttcacatattacctcttgtctttatcctattaaaaaacaaacaggctctcttcaaagtcacatctctgggaagttcttattttctagttctagctttctaatgcagaaatattgcctcactttgatacacacctttatctttttcaaactacttttacataagtaatcccatctaattcccagatcagtggttgaggttgacatatgcccattttacagatgggtaaactgtgattcagaaaattgaaaactccttaaattgtatagcgagtgaatagcagggcccagattcatatccaagactcttggccccacctccagcagtatttttctttgtgcagtggtgccttttttatcacctcaggggtgacctcccctgtcccaggagcctaatgtccctcagggctgctcactctcttcccctcctctgattacagttctcaaaggtcattttattactattattacacagctgacactcattttatacttaaatattgcctcaatctgtcttttgtattttaagccttttaatttctaattgtggaataagtagtcttttttcctgattaaaaataattttaagtgctatattagagctggggacatccttcagaaaatcccctgaatcacagaggctctgtggagctccacgtgttaagcgggaacctaatttatttggcattacagtgacgtagcagagcaagaggtgaaaggattcatgggttgcctgatgctgctggagcccttgtgagggtttgtcggagcatatgaacttgagaccttccaactcgctgctgttaagcctgctgcctgtcagctcaggttgatctgtgttgtggttagtaattaagataaatctatttttgcatagctaatagctactgctctgtgattactagctcatatcttctgtcccaagtaaacatttataaatactttgaagacatctcagtgaaatttaaatttccttataaaacttcattttaagaataatgggcctgtatgctatgcatagccatgatcagtgtttccatgagtgagagccacatgagttacagtggccctgttcgcataataaatgtttagcaggaagcatttgcatattacattatgaggcttcctttctggccttcctgtgtaatttatcacaaactttgtgagaaaatacttgcaccaaaggcatccttgcacaaaacaacacaggtaaaggaggcttcctcctcctgcttctctcatcttttggcttttcccgggagtggaattggcatatttcttgccctttctccaggaaaccatgggtagaactgggaggatcttatattcccaaaaccatggcaaccccagacagattcaggattttagaactgctgtggtgtgctgggtccctgacactgaagcaccagtcacaccaaacactgccacagttctttgtcttccctggtgtcacccagaacactcgtgtgggtttgcaaaagatgcacaggcaaagtggccgcttgttgcatctaagtgtgggttttaatgtggattttctccaacaagtcatttgaatccattcgagattctctgaagtcttattttaggaaattacctcagttagataacaaatacatattattttgttctcaatattcctaagagtttaatttccatttcacttctctgtaggatacttgtcaactctgtccaaaaggtaagactagatctgtgctcctcccagtgttaaaccgcatcattccctctagataattatcctttgcatagcttatctaaaccaacctctcacttgctgattctgaatctcaggggtaggacctaggaatctgcagtttcacaagtgccagtggtttttatgatcagacaagttgggtaatggatctgtttcttgagcaaatatttgttagataaataccacctttagttttccctactaacatacgcttctcaaaacacttggtacctgcgttctatctctaatattggaacattctttattattattattattattttcctttttgcaggcaggtaagagaatcatgtggatcagattgtgtcccttccaaaaatccataaagcaatccagaggagcctcacttacttgctaaagccctttacaaattacaaagtgttgcaagttatttttatgattagggaacattctggaatcagtcacagtaaatagtttatctctttttcaaatgaaattaaagcacagcaaaatcaagtgacttgtctaacagtgcccagcaagccatcagtttgtaacagatctaaaaggagatgtctgaccactgttcatcccgatctaacaagcagtaagatactggaattgatcaaatgtctgagacaccgtggttgagacccactgttgtaaagcatggagatagctaacaggatgaatcagtggtgggggcctctaggttagagagtcagtactaaatccgctcttggccactgagggtctcattccaaacatgggaatgataacattggatagaaaactatatgttaaattatttcatacattgcaattgtttctggtggtagattcttatctaatagttaaaagacgttaggagaggaatcgatcttttttattcattgagttccccttggtaagtgcgttcctgcctgggctggaaggtgccttcccgcttgtggtgctgtctttatttttaaagtgacagcacatctttgcctattttttagggtacattgaagacctgggaaatatttctgtggaaattattcctgaaatccctttgaagtgtttgcactttggctattgtgtgaagaatggaaaatcgactgaagtggcattgggttggggttagtgcctgtgtaatcagatgctaatgtagctgccctgctaccagccccatatcacatcctcctcctaccacttaccataaaattgcagaggatcagctgtgtacagtaggaggtcggcagttcagttctgcacaatgcagaataaatcactgagaaatcaataaacagcagctgacaagaccaactataggaaaattaaaggctgacgaagaaggtcggggaaaagtttgatctttcagcttaaaaatcttaacagaaaaatccacttttttgttttatattttaaaataaaaggtctttacttattgtttttatgaatagataattaaagaatgaaaagaaaaaagcgttccccatcctagctcttgaatgccttagttcaaaacttaaataactagtgatgttatttatttgtactttgggtgatgtagggttcaataatgtggttggttgacagagacaaaataatgaattgttctctttgacttcctgtagctttggatgtgaatgttatttttccttttctctaaactttttggaggcttgcttaaagaaaagtgttgctgcaggaagccctgactccctggtgcttaactccatagaaacacgcacgtgcttagagatccacactgacctcgctccctccagacgccatcattttggtgcagacattattcagcagacactaggaatatgaaaagatacaagagctgagtcttgaccatttggagttcagagtctagaaagagaaatcctgagtaaatattaagtgcttaataacactgtaaggaggcttaaaatctggtggctgaaggtcctggcttgaagacagtttaatgctcaagcccctcaaaggagatgctgtagttatcggtggccacaggagaaggcatcacagagggttggaaacttaagctgagtttcgaagggcaggcagttcttaagtaagcgaggaggagagagcaaggacatttcaaacaaaggagcttctccgatatagcttcatcttgtgtgctgggtgagaattaacagtgctgtatgtaaggtgtggagtacgatgcctggtttgtgaggtgctcagttgatgttagctgtcattctgaaggatgtggctaaaagatgaagcttctggagacagtgaataaggcagttataccttattggcttccataactttttttttttttttaccctgaaagcctgaaagagcccattacctacttaacttggagtcctgatttttccagcaactagctaagaaactaaatgaatcactttggccgagcgcggtggcccatgcctgtaatcccagcactttgggaggccagggcagacagatcacgaggtcaggagttcaaggccagcctgaccaatgtggtgagaccccgtctctactaaaaatacaaaaattagccaggcatggtggcgcacgcctgtagtcccaactacttgggagtctgaggcaggagaatcgcttgaatccaggaggcggaggtcgcagtgagccaagatcgcaccactgcactccagcctgggggacagagcaagactctatctcaaaaaaataaataaataaaaaataaaaaaatcactttttgctttacacctcccttttcttccatgtaaaatgtgtcagttggactaaataatatctagtgtaccttccatttggaaatatagtaaatttactttgctataatgaatgaaagaaactagaactcgagataataaactatttccctctttttttcctgagtttcttttttaatgtgaactgtaatacctacctgaatataaacttactttacattcctactaatagtaaggcacaaaattatttgggaattaaaatttaagaacagacatttaggttagaatcagatgggtatttcttatatgtaagtatctgttccatcctgaaataaagtagaaaatcttagaatatctatttttagaagtgttttgtagtatttgtgatttctgtaatgggatgttatacagagacatgagtacatcctagactaggtgactttttagggttgctttgtgatttataagacaactccttgttgtcttcctttttcctaatatcattaccaaattaattttcctaaaatctctttggtcaaggcatttcccttttcaaaagccttcggtgactttttgtctcccaaggtaagtacaaaagtatcttctttgtccagattttcatcattatctcatactatttccatttatgaaatttctgtacccatcagtatggttgactgccagacctcagaaatgtcctgttccctaaaccactgagttttgttttcatggtctcacagcctgcccaaaccttgtccattctgaaagacccagttcaagaaagaggattcaccatgttgaaaacagcaagaattgagaaacaaatgttaaaatgttcatattgtgactgcccaggctgggtggcagcacaggaatgggggcaggtgggttaaggaggatggaagagcccatggacttggtgagatggagggagagacagccttgcacatgggaggctgaggtcagggagggtaggatctgaatttaaggaggtggcatactttgaggctgaaggtgtctttgaaaaccacaggtcagaagaagaggcagggaaaggaggtaaaattctttgagccagattcacttttaaagtggcttatagagatacaaagattatagactgcaggagatgaaagacaggagaaggaggtgagcttcagggtagattcattgggaatatgtttggatgtcatgaagataatttgacaacagaatctccttgaatgtggtgtaaaacaaaaataaagcaaaacatataagaggcattgatgaacccagcccaagatcctttcctgtaattcaggatatttaggatgaggaaagtattttgatttaagaaaatctagattggaataaatggagtgtctattccggacagaacaggctttcccaaaagagggactgttagggcctgaagagcagcaaaggatttgacttgggttgaaattatacaaggacagatagaagagagtagataaggtatactcaggttagagggtagattggagacaaatgttggcagtggaaaaccgcagctgaaatatcaatgtcccaaatctctgaaacaggacctgattgctgggagggtgcaggcaagcagggactctctcctggagagggaggactgatgggcacactttctgatgatcattcttcacagccatcaatctctagccctctgtgccagtcacagaggtttcactcttcatggtttcactacattcccgtttcttttaacccatatttaggctcatttaaatatttgatcatttttacttctgatacttattcattgctctgagtcaccctttgcccaaagcaaactgttgtagcctagaggggacttttgcagaaatatgagacttgttacaatgattccctactcctgtctttccagcctagctttccaatgcaaaggcagactttagagtttcacccttgcagctattaggaaataactgcccaagaaaattatcacaggtgacatgcagaatgcatggtggctaattagttcaactagaatatcaagaatgaagctcaaggtatcatgtttataacacagctaaggacaatttgatattacctgtgccttttagaagggatccctccttcaccttgaaaaggaaaaatacgaatttattagtacttaccttaaaatcatttctagtaacatgaccaaattatacgtatagaaataggtataagttgaaatgtttccttgcacattttttccttctcatagttcatccctcctttttgtagagaagaaaaccaggatttgttgccaccgtggtttccctttctgtgtttctggttactctctagtggacctatctgtgtggtcacggttctgcaagttggagagacgccactggggggcattgacctgtgctacttgagcactatagtgaattctcacctttttcaaagtagtaattagacctctggtagtttgtatttttagatacataatttcctttattgattccatacaactttgggaaatagtacatctgcttttattttaaactgaagagttactttagaaatgccattttttgtttccagaggctctaaaggattttcatttctgtgacagatcgacaggccatgaagattttctccagaatggtaacttggcatctgccaggaccttcctctggctttcttcagccttctaattacaatcatgcctcgatgaaggacagggtaccttgtgagaaatgtgttgctaggcgatttcatcattgcatgaacaccatagagtgcacatacacacacctacatggttgagcctactatgcacccaggctatgtggtgttgcctatggttcctaggctaccaagtcaataacatgtgactgtactgagtactgaaggcatttggaacacaatggtaagtatctgtgtatccaaacatatttaaacctagaacaggcgcaataaaaacaaggtgtaccatctcatttgagaccaccgtcatatgtgcggttcattattatacagcacatgtctgtatattatctttgtcattttgtgaaaacctgtcactttgaaatgctgtctcttagcaaaagggatcataattcattgaattttttatttttcaaatgaagtgtatttttttttcatccagaatgtagactagtgggaaacacatgaaagagctggactactcaagggtgattggcagtggcctcgtgctgcctcttgcactggggagggtggaggaggaagagtggtagcaaaaggccatttgctagcccaaccctgtcctgcagggctcctgtcaagaagggaggggaagatggaggaggacttcagttaagtaagtcccctatcttggtataaacactattcttagggacttcatgtttataaggacaggttcagtttcaccagcataaaaaccttcaaaaagcagtatgaaaatagtattaaataataaaaattttcaatttgtttgaaaataaaaattttcaaattggttcagaaaatattatgaaccaatctgttttagttaacccttgaacagtgtaggggctggggaaccacagttgaaaattcacgtctaacttgtggctccccaaaaacttctaatggcctactgttgaccagaagccttactgataacataaaccatcgattaacacatattttgtatgttatgtgtttcacatgctatattcttatgacaaagtaagctagagaagataaaatgttactgagaaagtcttaaggcagagaaaatatatttactattcatcaagtggaggtggatcttcatcctggttgtcttcaggttgagtgggcccaggagtgagtgggaagttggtttggctgtctcaggtgccagagatggaggaaaatccacatagaagtggactcgtacagttcaaatctgtgttgttcaagggtcagctgcacagcctcctggggtacataccatcccctctgttggccactgtgaaggaggaacgccattagttcaaggataacagggtcagtttgaaatgaccatgtactcattttggggagaaaaatctatttgagcttgtcaaagtttttctgtagcttcaaaaatatcaaactgtaggagttataaaactccacttttagataatatacttcttagcattaagaatttagaccttttaagaaaaaagtatgaatacatgttttaggtacagagctcttttacatccattagtgaaaattatatctaaacatatcatcccgaaactcaagatttcatcataaacaacaaattcaagttaaaatgaataaacctaaggtttttagcatgaattccagttttttctctcttttttaaaacagaggcagtataagaataatgagatcttattttggtttgcttcatttaattaggatttcaggaaattaggtaacttttttcatgacctttagaatacaaaaaattaatattcggtcaattttttgaaaaaaatttatcaccaggaatttaggcaattaaactttaaaaaataacatgcaaaagttaaagcaatttagaaagccctttttaagcaaattatttggtttttcatgataagtaatcttttgactgaaaatcttatttttcctgttttgttatttcaaaggtttttttgtttgtttttgaagaagtgacattttcctggattagtgaattgttaaaaagtacatcctttctgtctccattttttccctttcttaaacaaagcaaacatttgtatactcacacactgaaggaaaaaagtgcaagtgttataagataattagaacggttaggataattgccttttatggatacataatgcttcagttgtttactgctaaatgaaatgtaaaagtatatattagactaaggaatagtgtacaaaatagatctaaatacaaaggaaattgtgttctgtctgaaaatttgtagatgggtctaaattaacaagaataaattaagaaggatatatacacactcatttatacccttgtgcgtatctcacatatgtgaacacacacaccaaatacactgaaatgtccatatttagtgccaaaaattgtgatgaaaaaccagtgggattatcctttgtaatagctcattctttaagttgcatttcaataaggcattgctgtgaatccagaggagattgtcaattacagaatttttttcatgatctagtatttgcttggtgcctcagagaaaatggttgttcatctctgcccctcactgttcatgtttgggactattgtttggctgcgccagtagaacttattctgataagctcaccaaatttcaggagtagcctcctttcaataactccacacttgtgcatgtggcttagtgaacttactggtgactcagtcatagcaagaaagggcatctcatgtctatgtgactacaaatatcagggaacagattctccatcaccaaccccaacctctaccctaacacaaaggtgtatgacaaaatgagacaaaatgaaacaaaattgctccacatgctacagtggcctactgttgactagaagccttactgataacagaaacagttgattgacacatatttttaaataaatataatatttctctagttaggttttctatttcattttattttaaagatgacaaaaactaaatatgcttctcaaacctctacctttttcaaattaagtgaagtcttcttctcatttaaagctgtttatactcaatttgaaatatgaaacatagcttcaaatccaacaaagagaatgttgctaactctggataacacttggggacttgagtccctgaaaggctgattgacaaccagattgacaactctgattgacaaccttgcttactttgatagggcttactatacttagtatgatagtttttaaattaatttagagcagaacctttccaagggatctgtgacaagaatggttaaatactgaagtgttgaagaaagaaataatttatcctgaactttgaaagtgtattattactaatgaatttaaagataagtgtagaattgatcatttatcatttttaaaccttttaaattagaattataatgaaaaatgcactccccatcccacacacacaaaccccaacaactctttaggtgcctacaggtaggaaaaattgcatttatctgaattaatcttggagtgaatactaaagttagttggaaaagctcctgaaatgtatgagacctcgaaatatcaattaacaaaaaatagtacctaaaatgtcttctaagaagtgtagtcttttaactaggatccttcttcctgtgtaaacactgaaatgaaattttggaatgaacctaaggtggtcctgaagtgctgtgttactagaaaaagatataattggtggaaagggtggatggatacacaggaagaagcaagaacctgaactcctgctggctgatggaagaaaatgggtgatcaagtttttgcttctgaatatttgacataaacatcataattaacctcacctaaagaaaacttaaaaggccaggagtagtggctcacacctgtaattccagcactttgtgaggctgaggcgagtggatcacttgaggtcaggagttcgagaccagcctggccaacatggtgaaacctcgtctctactgaaaataaaaaagttagccaggtttggtggtgcatgcctgtaatcccagctactcgggagaccgaggcatgagagtcacttgaacctctcatggcggaggcggaggcggaggttgcagtgagccaagattgcatcactgcactccagcttgggtgacagagcaagagtctgtcaaaaaaaaaaaaaaaagaaaaaaaagaaaagaaaacacaagaaaaatatttgagagtcctcaaagctttgtataaacacattctttctggtacattcaaaaggaactgatttcagattggtgtagggcaaagcagaaagtaagtgtgtggtcacagaaatgaaaggacaagagagttgacaagagttacaaaagacagacaacagatcattaacattgctgttgatttaatttggtcactagaaatgcggcattcatttttaaaagaacgtctatctatccataccaataatctggagatgatcacactttccaagcagagagctgaagtgaaggcttgaggggatgcctctgcctctcttcattttctttcatctacatggctgaccaatattcacgcattaatagattttggtttctctctggttccaacatttacataatacagtaatagttataggaaagggtttgcatgttcattatataaacccataccgattttttttctacattcatctataaattacatacgagtggggtagctctatttcttgctaattcctgacagtatttattttaagcatgtctttaattcaaagggatcaaatatgttataaggaccacgtatttattatttcaggtgttttacacagtatatcacattttatccttaaacacatgcacatataggtatgacactttatacttgtatagtataaaaatattaggccaggcgtggtggctcatgcctgtagtcccagcactttgggagactgaggcaggcggatcacaaggtcaggagtttgggaccagcctgaccaacatggtgaaatatacaaaaatacaaaattatacaaaaaacatgcaaaaaatatacaaaaattttgtcctaaaaatacaaaaattagttgggtgcggtgacatgcacctgtaatcccacctactcaggaggctgaggcaagagaattgcttggacccgggaggcagaggttgcagtgagccgagatcgtgcaactgcactccaacctgggcaacagagtaagactccttctcaaaaaaaaaaaaaaaaaaaaaaaattagagcgtcctcagtgctttatataaacacactttttactaaaaaaatttacaaagcatatttccagttttgctttggagtgaggaaaacaagttcccaggagcaggtatcatgagtccactttacaagtgaaatagctgaggtaggtgatatcacaaaggccactgttgctttgactagacccaagaactttgtagctcaaaggtctctgcactacatccaccaagcattcatggaaaacctgggacgtaaatagggaactgtgcttgggaagtacagagataaaacaattctggccccacctcgcaaggagcttacagccttaaaaagaatgatcatagaaactgttaggtacaaatggaaacttcttgctaaatacaagaactactaaaatgttacatgacccaagagaatgggccaatgctgaagcccatgtcagctaaggctgaggtgaggaagtggtctttttgccaagccttgaaggacaggtaagactgcacttgataaaagaaggaaagtaggagagaattccaggctgaagtaacggcatttatggagactcaggaggctgaggcgggaagggaagattgctggagcccaggagttcaaggctggagtgtgccatgattgtgcctgtgaatagccacagcactccagcctgggcaacatagagttcatatctaaacaataatattaggtatttggggggaaccttaggaacctttttaaatgcagctgtatttgctgtgcatttgtaaaacgaagaagcagcatggtgaacccagtttgagcagagctgcaagttgcttgttacgcacccctcattgtcacagagcattcgatttatcctctgggcagaaggagcttctgctgctgatggacaggaaatgaaacatttatcacattgctgttattatttttaagaattctttaaggaaaggaaaaataatcaatccacaataatagagaatcaactccttaaagagaggaaaagtatctgagtgtaaattgatgggcaaattaatttccctttttttatgtaaaattgttgtgacatgttaataatttatgtaattttagaaagtaaattggattttctttcaacctttatatatgaatatgtggtcaacctaactatatactgaatattatactagaaactgaatgatgattcagaatagtataggtgacattcagtttcattaaagattaatagtagcatggccttgtgtgttttgccgtatcacaaaaagcaagatttagtgactagggccctggattatgtattaggtggcaagacttccagtccaagctgccacacacttgctgacatttgtgctcacgttaattttcccatccgtaataacgacagtaataacatccaaaaccagtatacccagataaatggtaaagattaataaggtaatatctgtgacaggctttgggcttcttagaaaagcactgaataaaaagagcagcagcaaaaccttctagatagatagtgtcatcagttcactgcactctgcacagaaggaccacgttgagattctgttgtgcagtgtcagtcccgtaggtcactgaaggaggaaggggtggctttgggagtgactttgtcactcattatttgaatgactttgggcaagttacctaatttgatgaatttgttttatctgtaagtactgataacatacattacttggactcataagaattaaatgaggtaaattaattcattcacaatcagaaaattctacctaaatttctctttttgttttggcccttgtgggaacatatgtaaaaagcagtgttcttctacacaattgacaaaatggcgtgatagaccttaggatttgttggtcatatttctgatttggtcattatttcttataatttcaccatctctctagtctttgttcagtattttttaaaactatgcagcagtggaaaagaaaacattttttattttcctcctacttcttttcttttcttttctttttttaatgtaaacccttcaattatatccacctcttatttcttatcctttgtttactatctggaattaaacaaggaggattaggggtggtgcttcacctttgtaaaatgcacttgaagttcattataaacataaatatataatttataaacatttatttttataatcattttaataattataaactaataatttataatataatataaataatatttatttataatatacttgtttaaatatataaatttaacttatttaatttataaatttaacccaacgctcttgggttctcatgcattaaatccctaccaacccagagtaacttaggaaaagatcctcctgagaaagttcatcattaaattttaaaaaggggacctttttacttctttttgataatcttaggatagcaagaattgacacttacaaagtcttattgccaaggagaaggcttgatgatgcctgttagtatatatgaatcagtcatttatcattaactgtttgcattaatgctccttagctatttttatcgaattagttgtgacaaaaagtatctgaagtttttgtgcttattactttttacttaaataaaactgcactctcactccaatctttttttcgtgcgtgtggcagaggtcatccgcagtgctctgtccaaataaccattcatttactttgaattatggcagtgggatgctcagtgtttgtggactcgcaggtcagtatgggtaaagaaggagagagagtccaggcacagccttttcagtatttctctacactgtgtctgaaggataatgcatgtggtcaagaagaattttcctagtcctgtgactgtttaaaatttgagaggggaaaaaaagtctaagacttctgtaatgctccaaattgtttttcaaatgaggttttagcaagatgaaaatacctttcaaaggatttatagacccatgagaatttttaaaaatctctttaaacataaaatattctcctagctactggaatgtttcgggtgtctctgcttaatcagctgcctcacttcctggtctctcagtactggcttggtgcctttacagcccaatcatggtttattgatattgtgctgcacactattctttccgagttttttctcccacaattgtttgacaattttgttcattggtgataatgaaagagaaaaaagaagtgccagccacccaacacagtcaacacccatttttgcatgtcgtttctgtgcagcagaggcaagcacagaacctgaacgtgctcagtgaggtactgtttagtgtcgttctgtgtgggactcggatttgtaaagcccctgcacttgtaattcaccaaagtttcccagacacagttccagtggcacattccaagccttttgtttccagtgcagtattgggacttggttgtaactacaaaaactctgatgataaatgcctgggattctggttggaaacacctgtcagaaggacttcaagaaaggttttagagcctagggtcttctgagtagcagtacctgttgactgacctgctgtgtgctctgttagaaaattatgttggaaaatactctgtgtacttggcgacaagcctttctgagccaggcatgtgttgatatgacatggcggcttcaaacagtcctgcaggtgctgtggtatattacttaagcttttttgattccaagtaacaaaaaccaagtgatttgtgcttaagcataaaagagacacacacacacacacacacacacacacacacacacacacacatataaattttactttaagttccaggatacgtgtgcagagtgtgcaagtatgttacctacatatacatgtgccatggtggtttgctgcacctatcaacccgtcatctagattttaagccccgcgtgcattaggtatttgtcctaagctctccctcctcttgccccccactcctcgaaaggccctggtgtgtgttgttcccctccctgtgtccatgtgttgtcattgttcaactcccacttatgagtttgaacatgctgtgtttggttttctgttcctgtgtgtgtttgctgaggttgctggcttccatcttcacactgcaaaggacatgatctcattcttttttatggctgcagagtattccatggtgtatttgtaccacattttctttatccagtctattttggtggagatgggatctcactgtgttgcctaggctggtcttgaactcctaggctcaagcaatcctcctgtctcagcctctcaaaatgctgggactacaggcatgagccaccatgcctggcctaattttgttctaacatctcagtaaatttagactaatcagtagatattttcagataaaatataaattctatcagttttatgagcacatacatttatagatttgtggaataaaatttgtattttgtggtgttatgtttgaaaataaaaataaaattcaataatgaaaaaaggaaaataagaatacaggcctgcctcatagggagaactggtctaggacttggaagcctatcttaagccagttctctctgcccctcacccccatgtctctgcctcccttcattttttcttctctctgagggctgtcccagggtcagggacactttaaataaagtaatctctgggatttacttctgtagaagagaggaccacttcaaaagactcactgtgaatttatgaaaaacacctgaagccatcatatggcgcttatgttgctcttgatacttctttcttttacctgctacaccccacatgagtaagagcacaagactgagctgtttagggtgctccaggcagagaaggcatggaagcttggaaagcgttttctaagtcttttctgctacacttaatttttgctcattactgtttgtatataatccttatcatttcatagctcctggcacagttgtgaatctgaatcttgaagggatctctgaagatcactcagacacagtcacctagacagaaaccataacaggtctccacccaccgttattaaatcatgcatatggttaggaagtgcttgccttgtaaagttagtgatggctgggcagctcctaactgcgctcctattgatctaggtccgtctgtaacttcctccaaggtgcacatgttccctttgcagcaatacagaataaggcctgtccttatcaatgacttcaaattcctgaatatgtaagaagtcactctgtcattcacttaaagatatttaaatgcctaacgtttactgggcagtgattaagtgctatggatgtcagattttaaaatgtttggcaaacatttggaatagcaactggacaagcttctgaggaagtgggagagggcagaagagaagtggaagctttccaaggacacctcagccccaggaagactgggtatcatcaatctgatgtagaaacgtcctctttattcagtcacccggtggtttacaaagtctttgacatgggagccagaagtcacaatgtaaggttagccctctaatataggaatgtgggtttcatgttgcggaggtgatggaaggacaagagccagggcattgtaagtgacagggaggatcgtggatgggataagccaggctaccccagctaggaaggaaaagagggaaaagtcaggaaggaaaagggctgatggctgggaagagatggacaaactaatgaaagagactaaaagttcagtcaaatgaatttagagaggacattaatccttggtaatataataataaagtacttgtataaagttcttgtatgttctcaggagtagggattgctgataccatgtaccaatatggaggagagatatataggctgattggtttcaaaaaaagaccatattggtcatcttatgtgtatttaacttaggataatactggatatagttttcattttaaatagtgtaagtttgcattcataacttggcataaagtgttttatctcaagaacttactaaacttgctctttaaagttcattgcagccaattggtacacaaatagttttagagtgttctattgttcttcctgagaattagactaagtaatgtgagaggagtcttaaaatgttaaatgaaaaggctcagttttaggcaatttttgagagctcatcattttcaagcacaggaaaacttttttaaaaaccttatagaagccaactggaattgaacattttaaaaattgctatggataatatacaatgtaaataataattctttgccaatttaaatggtaaattatcagaagacacacacacacacacacacacacacacacacacacacacgcacacccctcctatgaatgaaccattttctggctttggatttattctgtctttaatgagtcattttgaaatatgtgttttaatcaacagaaggagtgctaattactcacgtaactgcttcaaattattatgtacttattttttatgggctacatgtatgcctttaggttggtgtcataggtccataggggcagaaaacacggaaggtgctatactttctcttaggaaatctcacattggtctgtgtattatgaggacagaaatgatttttaatatctggtatgagttgagctctgtttttgttttatttctttaatttctgcttcttttagtatcagtagtcttatttattgatttaagcattgttagttgatttttttttcctttatttcaagtaactgaaaatttagatgtcacatttctgacagccatatcatttggttgatctccgtcattagtttctcttggggcctgatcgattgttcacagttttggctgtcattcttactgccccatggctgtgggtgtttctgtcaaagagaactgtgaattgagaatatagtggcagtttcatggcttgttggcaaggtgaccacgtaatttgtcatctgaacaaaagtgcttttggctaataacagtgatgccaggacaacatgcttaacccatttcaaaccaggacatatgggcactcaacttataggtgaccattttgcacttcagagccttaaattgtccatgtttctgcaaatctctctcttacataagactgtacttttcacaccaaattccaaagatttggaaacccaaatctttttttttttttttttactgagtcagggtcttgctttgtcacccaggctggagtacaatggcatgatcttggctcggtgcagccttgacttctgagacttaagcaatccttccacctcagccccccaagtagctggtactacagatgcatgccaccacttctggctaatttgtgttgttttaggagagacagtgtttcaccatgttgcccaggcttgtctggaactcctggactcaacccatcctcctgctttggcctcaagtgatcctcctgccttggcctcccaaagtgctgggattacaagcatgagtgaccgcacctggcccaaatcttactttatatgcagaactatgcggtagaagtggtgccttcctagaatagcagttttaatcagggctaaataatgtgcagtactctttttatattagacatattttaatggaacatgacccaaaatgtgcatttttttagatgaaagtttgggtcttcagagaaataccacgtttgcagcaagttgcttaatagagcatccccaggcctctctggtttctctccacttagaccaaagtggtactttggtctacatgtttgaaaagagctgacttaagtgaccatacattttgaagatgagaaaaactgattaactctggtctgaaaacgtttggacattcctgctgctcttcttttgtcaaatagagacataaaggttatgactggggggatggagaagaccactgaggcctcacatctctcttaaaaatctgcctgattaggtgccaggagaagtttcttctttgtgttactcaatgtcttgtctttaaaccttctggtaaaaggtgaatacactcaaggaaggtgtttgttgattcatttaacaattatgtttgatgtgtttattttttatatctgtattttatataacatgaagtatttacagtagcagaaacataagaaatgaattatttcaacagctggtacgatattagcgagagaactttgtttagaaaaatatcttgacctaaaacctgaggtcaaagattttcaagggaacaaaagtaattaaaccattccggataaaaacaaggatttgaagatgggaggagtgagaagagataggactgagctttaaggtaaaaactccaaggatttctttttaatatttagctgtctatcatgaagccctttctgtctactccctgagaacttcagttatgtgtgctgcacaggtaaacacctgtgtcagagattttccagggagagcagaaggagaaaggtgctttttcagtgaatgtgtgtgaagccccagtgtacttgagcattcacaagattcatcaagacaaagatttgagcaagagctcaaagcccaaagagtaaatgttttcccacctactcaaaactccttagacaaattgctaggctaaaatgcaaggcacctttagatcaaagtgcagggttgaagataattgcttttgtattcagaggcgggatttctcagcttacctctgggttgagttcataagacttttatgcctccatggaaagtctgagaacatcctggtaatcagggataaatttagagaagtggaagcaggtggtatcaaacaccagcttcttttccatttgcatagacatatccaaggccatgaatcctttgacatgggccagaagttctaagttgaatggtatgaaggaattaaaatgacacctgtagcaacagaagaatatgttaactacaagaaattgggatacaaaatcacagtattgagagtctcaagagaagtgtgttgaacaataatagcaattttgtttacttcatgctgaatcctagtatgtagtatattatttcaacagtatttcagttattatcatattttcaaacattaatatgcttaagccgggcacagtggctcacgcttgtaattccaacacttttggaggccaaagtgggtggatcacttgaggtcaggagttcaagaccagcctggccaacatggtgaaaccccatctctactaaaaatacaaaaaattagccaggtgtggtggtggacgcctgtagtcccagctactcgggaggctgaggcaggagaatcactttaacccagtaggtggaggttgcagtgagccaagattgtgccacggcactccagcctgggcaacagagtgaaactccatctcaaaaaaaaaaaatgcttaaaatagaacaaagcttgtcattttttaaaaacatgactcatttgatgtggtcttgtacaataaggcattgatttctggagctagtgatatattcataaacaaaccatttcctctgtcaaagaatctttttaaaatatagatattggatacccaagttattaatatttattaggacacaaatagatatccatttttactggcttatattcttctgtattgtgtgtatgaaataaagagcatttccccaagtttgaaaatactcattccttcatcataaaacaaaattcacttctaacaaagaactataaaatactgtaaaagttaattaagtcttgatttatgcacttaaggattagcctttcaggatttcagtgatatataattcaatctttttattatcttaatataaataagcttgacaattatttcgtgatcttagtttcattcaatttttacttagtgagatggcctgatattcaattcttattccagaatgagaaacatatcccttaaaataatagaagtctttgctgctttagcatatgagagtgattaggattttacattccttctagaatctattttatatggaaatgtgtacacttgtagggtaataaccttcataagtcatttgagatttctacttaatcagattctgcccatttctgctaacatattgcatagccaaatacatatgtgtataaaagtacttgtttatcagtcagatgttaaagagacttcccacgtggcaaaataacaaaccaacatagaacaggaagacccttagcctttaaaagttgattttaagagaagagcataatttctgaattagtatcaaagattagataaagaagatccaagtgaaaaactatcaatttactgcagttttagaaaaacgattgactagatacaaagacaagtcttatattttaaaaaaattgcaaataaagaagtagaatttatcactgggtcactttttatctgttagcgatttcttccatctctagccccagcccctgtcttctgtctcttctccacgcctctgtctaccccatcccttcactgttatctcctatcactgtcccctggttagttgtctttatgcacatggccgttcattgtttctttcttttttttgttttttgagacagggtctcaccctgtcacccaggctagagtgcaatgataacaatctgggttcacaacaacctccgcctcccgagctcaagccattctcctgcttcagcttcccaagtagctggaattactggcacgtgccaccacaccaggctaattttttacttttagtagagatggggtttcgccatgttggccagactggtctggaactcctggccacaagtgatcctcccaccttggtctcccaaagtgctgggaatacaggtgtgcaccaccgtgcccagcccactgttgctttctaaacaccttccagtctgattatccatcctgatgatcattcttaggtatgtagatccctaatctgataacctgatttttcaggttatcagaggcccataatgcttgggcccttagtctcactcccggaaaatttattaaataaatgtagatataatatgtgtgtttttgtatttagagatagcaccttcagcatgtttttaattcatgggcattttcaatatgaactgttgtccagaacttgcccattaaaaccatatgtgtaaaccatatgtgtaatactttctatgctgcctcccagagcccgacttagcagtggccttaatcaataaattattcattatttaagctaatatttattaaatacttactatatcagacactggagttagggggtcattgtactagtctgggtaaaagaagagcgtatttctgccttgctagtacatcagctggctgaataacaatagcatttaccaagagagcacgacgaggaagatgaagtgcaaaaaagatcatgaatgtagtcatgacagtgtctccttcaccactgtgccctttaatattggcaataacatctcaaatgctggcaaagtcaatgacttttaatttatactctttggtttttacttgtagagcattctaatcccactgaatccctcaggaaatgaatgtgtaggtctttcattctctttctcaccaacaccagggctgggccttccctatgcaatggcttactgcctgtatatcctacatggaggctgtggtaacttcctgtctggttcattcatatgggttctctcacctcaagatcagtttgaccaccctgacatacctgcctgcctggagttccctccctcatacctgtcctgcctggagtgcctctcctccacctgtcctgcctggagtgcccctcccccacctgtcctgcctggagtgcctcccccacacctgtcctgtctggagtgcctcccccacacctgtcctgtttggagtgcccctcctccacctgtcctgcctggagcacccctcccccacacctgtcctgccatcagtgcccctccctaacacttgtcctgcctggagtgcccctcccccacctgtcctacctggagtgtctcccccacacctgtcctgcctggagtgccctctcctcatgcttgcttggccactttctgtctactcttctagtcttagctggagtgtcacctcttttgggaaaccatcctgtgctggctccctgccaccatcctcccacatccccactaagaattccttccttccctctgtgtactcttttgtatcttgtatatgcctctatcactgtcctgataaacatctgtcattctcagcagtttacatgtcagtcttccccaccaatgtgagctcctcgagagtagagattgtgtcttatatacttattcagtttagtatctcctgcatcagtatagtgcctggcacacagtgagcctgcaggaaatactggctaaattgagtgttttcctcctgatgtcttcccaatgtccacaggatgagattgaaactttcctgccccctgtgtgatctgaccatccgtgtggctgaggtggcctgtctgcatgcctcggccctgtgatccagttgcattccgtgcaccgcagccttttgctactgatgttatccttgcccagatgtgttccttctttttccctgcgaagtaaacagcgcagaccaatccattcctttaagcaagagcacaggtgccaccatctttaaaaagcgcacacaagtcgatgccaatctgtgttatgtctctcttctcagaaccttcaaggaagatactgcatatgctttgtacaatacagtgtggacatcatatgccatctttattcacatagtccatgtagattacattcatgcctaccataaaagaagacactttttgagcataaaagttgtaccttatacgtctttaattttcccagcagcactgaacatagtttgaggtcttaagctgggtaacaagtaattgttgctgtaggcagaaaggagtggaaagtgatttgaaagcctaggccctgaaactggtttctcaacatgacttcaagggagtgtccaatagttcttccctcatcatggtccgtcagtgtgagaatttgctcaaaaccatgcataaggaatactatgtcaaagtgactgtgttagtggcatttcttagtgcgtgttccgatagtaatagcctgtggaccttgggcatattttgaagttcatctgtctattttagtataatacattttgaaatattaagttctttcaattccattattgaaaacgttttgtctgttctgtgtagagcacagatgggatccctcacatgaggtgtcttctctcaaaatgtatgtgaagtagcatcaactttacagataatccaatgacaacatgaggtggttcaactgagattcttaatacggtgacaggtacacagtaggtcctcaatatgttgattgatgaatgagatagttattaaacttttgaaagattctttatatatgttttatataaaaaatcacaaattctgtgtcataaaatctcacaaaagatgagtttctacgattaatggtagaataaaatgcctgtgtactacccaaaattttcctaaatttcaacgttgaatacttgtgttttctttatactttggatctttttctccatttttggaagagtgtgcgcttgtttgtattttactccctccttggaaaacggttgcccattcatttgatctttgagaaatttaagcaattacttaatatttatttttgtctttgcaattttggtgtaagtttcgtgttgtataggctattcggtagtaaacactttagttagcacatgctaatcacactcttaaatcttcacccacttgaagataactgatgtaacctactggaaattaaggctgtaaattttcgggtagagatttcagtgttgctgcaatcaatactttgcagatagtgctaacagctttttctatgaaatatgttggctagtgggtggaaaatcaatgtctgggaatgaaaaacaggtgtcaagtttgatagggacatcatgcgtttgatatttggaggccagaggggcctgtcaacaaacacggcaataattccgtcagatgcagtatgtgtggaattaataaaaatgccagaaacaaagcagtctggacagaaagctagttctgcaaaaaaactcagggcaaaaatgtatcttactcgtgcaccttaagtgaatgaattacagaaagacattgaggtagagttaaaatgaaggcacgtttgcagcactatagagtctgacaggagaaaacagtaggcagagcagtaagaggtagccacaccaccccactcaaagggactctgccaagtgtccagcagatgtgtggagatatgacggttgctgtaatagagtgctgtgatttaatttggaagtcactgaacccaagcaaatcagcagtcttttctaggccagtcaagcttggcctcattcaggagttggtgaaaatgatgaaggcctgagttagccaagaagagagaaggagcaagggataaacaactgaagacacattgatcacatgcaaaacacttgccaaatacagtgaccatcagtgtcttacaatagaaaggatgcacagttattcagtattagggaactatttgtctattcaataaattaggggaaaaataatgttgaaaaaaggggacaaaattattagtcatcgttgttcatagtattctcttcctggaaaatgtagaagaatccactgaaaatcaattaaaactgttacaagagtccagcaaatacatagttacaaagtaacatatgtaaaaaccagtaactctggagccacattgcttggattctaattctggccctactatcagttatgcaaacttgggcaagtctccttatatttgtgcctcaggttcctcatgtgtaaaaatggggattgttatgcatatgaaataaattattatatataaaacttcataatactccctgttacacagtccaacataacgtttcctcttattgttgtttccactgctattcctagctttcctataatcttcatagaaaatgtaattaagatttcatttacagcatcaataaagagtatacaatacctaggataaaatctaactagaaatactacaataaatggaggaagcctttatattttagagatgtcagttctcccaagagtaatctacaaatttaatataatttcaattaaaatcccaaaaagaattatgaagacttgcaaaatatttttaaagtttatttggagaattatgggcatgtgaaactaataaaaaataaattgaaacagaagcattcaggagaggatgatttgcccccatcatatatttaaatatgttatagctcagtaggataaaaatagaaaatacaagcatattaaatttagaaaagcggcatttcatacataggtaaccagaaatgagttatttactaactggtttggggcagcagagttatcatttggaaaaaaaatacagttagattaaccccctataggttaaggtttaaccccatagagattaaggtttaactgaaacagatgaagccttggaagtactaaaaaaaaggacaggcaaatattttttgtagttttgagcattgaaaagcctgagattcttctcagtatgatctcaaaattcaaaaccattaaataaaagattgatgaatttgactacatagttttacatctattcatataaaaaatatttttaaaagagaaggacaaatgacaacttagagaaaaaatttaaaatctgaagtaaaaataacttcagtctattatagggtcttaaaaatcaattaaaaaatgaatactataatataaaactgggcaaaggattataacaggcaatttgtgaaaacagagataaaaatacttattaaacatattttaaaagtcagtaccagctctaagcacagatgtaactatacatatgtactatacatacactgtatgtatcatgactatacactatatgtatagacactatacagtcatgtgtcactcaacaataaggatatactctgagaatgtgtctttcaccatttcatggttgtgcaaacatcgtagagtgcacagacacaaacctagatggtagagccaactacacacccagggtatatggtgtggcccattgctcctaggctacaaacctgcacagcatgtgactatactgaatactgaaggcaactgtaacacaatggtatctatttgtgtagaaaaggtacagtaaaaatgcggtattgtaatcttatgggaccactgtcttatacacagtttgtcattgaccaaaataccattctctggggcatcactgtatagatttgttaacgtctatcaaaccgaaaagtttgtttttaaatgatagtacctgaattatggactgataaccttttactagttattgtaacaaatttctaacttcctaacatgaactttataacttaaggcaacagaaatttattctcacacagcctgcagaagtctgaaatcaaggtgttggcagggccgtgctcctttcagaagctttaggggagattccattccttgcttcttctagcttctggtggttcttgccacgtgctggttcattggtttcatcactccagtctctgcctccatcttcatgtggccttcacttcatttggttttcaaatctcccttgtgtatctccagaaaggtacagattattggatttaaggtcaacccatgtaatctaggatgatctcttcatctctagatctttacattaattacctgtgtaaagttttttttttttccgaactaggtcacattcacaggttttgagacacagacttatcttttggggaaccactactcagccaaccctctgaccccaaaacatggtcctccagcccatgtgtaaaatacgttcaccctatcccaacatctaaaagtctcaacccactatagtgtcaaatctaagtccaaaatcccatttaaatatcttcaactcaaaagtaccaagtttcatcatctaaatcatctgaatcagatatgtctgagcctctgggtgtgatccatctgtgggcaaaatctccattcatctgtagacctgtgaaactaaaaaaaaagttatctgcttctaaaatacagtgatgggacaagcataggatagacattctcattccacaaaagagaaactggaaggaataaaggggccacaagacccaagctagtttgaaatccagcagatcaaactccattatatttcagagcctaagaataatactctgtggcccagtgctccactctgggctcacagttctgccggcttctgcttctgggctcaaggctctcccctagggattgttttccttttccttgaacaatagtatatattttcagccaagtggctctatcagcctgttttcttcctgtagaattccggaagtctaacagccttccttcatctcatcctgtctctgtcctcattctgtccaagctggtagtgtttgtgctgatacaacattttcataagcctagtgggtctcctgtgtatgttagaggatccaggtcattagacaagagaggcctccatggaattttcaaggataaccccattcttattcctggcttctgctgacatggctgattggatccatgagtcacacacataatccccttagcaaagggctgtccagccattcccttgaccctctctccagagcacctttccccacagtggacagcctaattttaatatcctttgcaatctggatagccgagaatcttccaaactatcaaatgctgatgtctttggcttaatagtttctcaattcgtctcttttccacttccattttattataagcagcaatgagaaaccaggctgcatcttcaaaatttggcttggaaatttcagctaaattgaataaaaagtttaattcttagatttattctatctgtgaagaaaaataacctgcaaatcatgcagaaaaaatataatcatccctcagtatccaggggggattagttccaagactgcccccctcctccccaccaggacaccaaaatctgcagctactcaagtccctgatataaagtggtgtgccatgtgcacaccctcccatagcctttaagccatctctagattgtatatattacccaatacaatgtaaatgctatgtaaatagttcttatactatattattttttatttgtattatttttattgtttttttcccccaatatttttggaccgaggttggttgaatccgcagatgcagaaattgcagatacggagggctgactgtacctataaaaagaggacagatcccatgttacgtgttctctccacaaaagaaataaacacaaactggaggggtacaaggaaacttttggagatgacagacatgtttattaccttgattgtggtacaggagcacatggatatatgcaaattcatcacattgtatacattaaatatgcacagtattttgtatctcgattattttttaacaaccctgttttttaaaaattgaggttcaaggtgaataaggaaataagctacttgaaatgattttataatactgacatatttattatgcctcagtgtatatcttactgagtatcttagagcacctatgcctcagtaagaatgaggtgtcaaaatggagtaaacactccaaatattattgaaatacaacaaagaaggatagtttcaggcggagtagccacatcatgctggaggttgcatcaactggtggtggttactgtgagaaaggaagacttggaggatcatgatagctcctcacatggcgtcggggtaactccggggaacagaaggataaaaattattgtgtttggtttcaaagtaaaaatgaattggttcaaggaggctgttctggcacaatagaaaatgttctacactctgatttgtcccaaacagcatctactgccccaaggcaatgcatgctgagacagaaggcaaagtaaccttttagagatttttatagaggtgcttatgcgttgggtaagtagttgtattaaattgtccttcattcctttttaacactaaaacagtgggaacccaggctgtaggtagaagacctctttttctactcagtttctctagctatataagttcctcaagggaggaggattggctaaggtgcaaaaatggtaaattgatagtactttgttcccaagtgactattattttgactgcagcacacaatgaatttttgtggacagaatgtaatgtgtgggcactcagctatacacagattaaaagttatgctttctcagagatgttgttaaccatggttagatttaagaccagtttgcagaaccaggcaaatctctcaggcactctctgacttctgcaccatttcctcccctgttacctgagctcctgcaacattgaagacttaatttgggcgcttcgcttgagtgcacatgtaatgtgggtatatccaaattggatatgtgttgttgtggctcaaagatggccttatttacaactgatgatgtaaatacagtttttctcatgtccacagtggcataaattttaaatgcaggaaagttgctgtttactgggtgtttatcggtcctaaggtttatgcttaatgaacttcctctgcttctgaactgggatcatgggctccttgttttatgaaagaaatcattccctaagcaaatgagtctctcagccagaaatgaatgatctggacagaatgatctggtgttgtttataagtaatatatgaagttgaataaaacatctaagataaggagaaaagtctatttttagggctgtcttctcagactaaaggtttcttcaaaatccctgtgctttttcttatagtagctttgtggcctctcctcacacttaataccttcattagttacaattagcacatctttttctcatccactttacaggaaataaatttcttatatctttactaaattccaggctctcagaaatgtgtttgtgaggaaaaatattttctgcttcagataatggcttctttagatgtttgaaaagtctccctttcctttttaaacgtgattttactatttaattaatgagacagtatactgtcctccttctgttgctgattcaacatcttaagtgtgagaagcctatattgagttaactgcagttattgaaaatacccatttctcttgaggtactaaattgctcattttgagaaatgagtcaaatgtatatatgaataaaacagtctgaattcctgtaaatatactttctctaatatcctagcttcacaaatcttttagtttccaatcctctgattatttttttttctcagtccaattctgatttgtaaaatcttaagtgagttaatttccttaattctggggtgctctctaaaggctgagtgtggattgggtggtagaactctgctaatctgcagaagacaaggtctgagatcgtgatggactagtaagaaatccacacacccaaaaagcatatggaagggtgcagaggtgcgagccatagtgttgtatgttagctcctgatcagtgatgtttatctaataattttggtgttttcctcctctttatgtgtcactctttgaccttgaacatggttctacttttgcagttcttatggtatattaaaattatttatgtttgactgctgtaatagactctgagcttcttgtcttttcatgtttatatcacctcttaacttatggtgcatattcaattattatttattgaatgaatgaagatgtctccccaaatactacttgtgaatcttttagaatagagacacgtggctatctctgtcttccactggactgtgctctaaccctggtatcttcagatttacccctgaaatggacttgatctctggaatttagaacaaaattaattgtcatattaatcatattttcattggttttagtgagaaacagttgagagggtaggaggaagacaggaacctgtgcagttttaaaaacccagctttctgggttttgtttttattttttcctcaattagcttttagatttttttttttttttttttggtgttatttgagacagagtctcactctgtcgcccaaactggagtgcagtggtgcaatctcagctcaatgcaacctccacttcctgggttcaagtgattcttgtgcctcagcctcccaagtagctggaattacaagcgtgtaccgccatgcctggctaatttttgtatttttagtagagacggggtttcaacttgttggccaggctcatctccaactcctagcctgaagtgactcacccacctcggactttcaaagtgctgggattacaggcgtgagccactgtgccttgccagctttttaggtttttaagcacatagccgtatttccaagcatcttatagtcacagtgttcatagtatttccagcagccctttagtcagcctcttgattgttattatgcaagtctctgtcttacccctaccccagttttaattctggaaactgcaacatgattgaagtacgcacatagccagaattgggatagttgttagagttagttctaggagcataatccatagtaaagcgtttggaacatcttgaattggtctgaatattagtaaataactggaactattttcaggggtttttttttgccagaattatattagagaaaacctgatacattttatgattttatgcaactcagaagtaattaccaaattcataattctgtaagagatttttaatacttgcattattagaatataccagatttattatctagaaaccagcctttgaaagttaataaaatgcagttgtcagaattgcaaatacctgttaaatcttatatattattttatatgcatataaaccatgcataagaaaatgaagcttcataaaaagttgtaggaacctttacagattactgtatttctctcctcaacaatataatacttgttcagatttgttttttaataaaaattaaaggagatccatcttaatcttaatatttccacaaagtttaaatgttgttttagaatcattgcttttatacttgtttttcttaaaaatacttaagtataccagtttagaatactgtttgattctataataagtattcaaaaaatggtagggattatctttattatttaaaatgtggtatttgatacctgctaagttccgtatttttcgttttaaacatttttaaattgacaaaaattacatatgtatggtataaaacatgctttgaaatgtgtgtaccttgtggaatggctacgttaagcaaaatgatatacatcacctctcatacatcatttttttgtagtgagaatacttaaaatctactctcccagcgattttcaagtatagaatacattgtcattaactacattcatcatgttgtacagtagatctcttgcagttatttcccatgtctaactaaaattatagatccctatttattattttccaggatagaagatttttagaggtgacaggccatgtagataaggctggagaagttcttgaacctttaaaattatgagaaggaccttttcatatgcatggatacctgggccctgctcagaaataattgaaaaccccaattaagaaaacaaaaaccttttcagatatattgcaaacagcatattgtaaaccaatagaacaagttacggttagacatttcaaatattttttgttcttggctttaccaaagaagtagtcattttatgagatggaagaaatgaagcctttcagggttgatttccccagaagtagatgattggatgcatcccatgtgaagacttctgggtgtgttgtgtttgagcatgtggagggtaaagaagttctggctggcatgctttcttagagtgtctaccacatatctatgcttgttatgtgcagccaagcatgaagcctgttgttctcactctcatcctagtcatcttcccattgagaattatttttctatttgggtgattacccaggtccaggggcactaatcctgcttcctgtaggatggttgggtatgacaaagtgtaaggttgcattgggctcatggtatgggtgcaattattaaagttatgtgtcaaatcgaagctgatttgaagttaaaggaataaggtatagttcaaggtcattgaaagcggtaagatttaaagaacagaatcacagatttgtttgtaaacagtgatatgtatttttatgtgaggaactagaaaaagaaggttcagtaaaaaactacaagtgagtttcttgtcgtttgctaccttttaatctcaagtttttaaattttcacttctgtgttctattgtgccttgttgtcagatatttaaaacagtaaacatataattgttcgatgagagagctatttctgttcattctggacctggatgcactgagcagttcaaagtttatttcaccagtttatctggagaatgttgttcatttatcagtttctgcatttgagagttaacttgctaaaattgatttcatcctatattccttggctcaagttgattacaccaatcagaatctctccatttttaaaaaattaactctgctatttagccatgcagcattagttgataacatttctttagcatatatttatgtgaccatgcagtcttgtcacttgggttcagtaaagtcttgtctcgcattctccatttagccaacattgttggtggtaatgacttggaattaatgcagtttgtcagcagctatagaatgcagtgatagcaggaacgtccttctacatcttcttcagactgatgtatgaaatagcatatcccatttatttctgtaccacattataaacaacatctatgcctggctttgctcaaggatggagctactaacatctgtgaagattgataccatggtttatcattttaccaggtgaaattcatggcaaccttaaaagcctaagccaagagcttaaagtattgctcaggtgtggatcatggattggattaaatagtgccgtgaaagccattttactctttcagctccttggtggtatatagacacacacttgacatttggtggggctttgaagttaattaaggcatcattaaaggcatgactttgagttagtctgcactgagatgcaccatgtgtgaccaaaagaaaaaaaaaaggccaagcatatttgtcatttctactacagtgtggttatatcttctttcttataagatgtgtaagcaatgtcctgcagtgtgtttgtgcagcatttatacccagaacttcttatgaaaagctggccatactatgattaagtccacttgtggttgggattcaaagtccccacagtagagcttgagttggcttaagcagatgaacaatcgtcagacttagttactctttgttgacttacatctgtattgtggcacctagggtgcagtggggcaaactgtcactgccacaagggtgaagtgaaaagtatatgtctatactcttttatctttcatttatcagctagacacatgtttccttcatgcaagggaaagaaaatcacaagggcccatgcttgtctctctttagaactctctagaattagcttgtcatgaaatgtaaaactaatgtgcagttgtaaaaactgctgccagctttttcctcactgcaggctgatggctaagtagatttggaaatgaaaggggttattataaagtgattactgaatagctaggtatgtcatcttaaacaagcagctaaaatctctgtgttagacattcaggctgtagtcttgttttgtatcattcatatttaagatgattttgattgtggaggagtaatcaagcactggggtaatttaagaaaaaatatatactgagtgatttttttcattgcttattaaaatacattagaatttaaatgaggcattctctaaaatgtgtaactattaagtatgtaccaaatataaaaatctgaatagcagttggctttagttcagagttaaaaattcttcacttgactaaaaacgtatttatcttcttttaaaatttaagtaaaacgtattgtaaaataatatattgaaaatggcatatatcaaagaatgaatggtttaaaaattataactcttaatatcttattactgtcagtttcatatgagagggcagatgccttgaagaatcttaaaagaaaaacaaaattaaaataaactgcactttattacagcaaatgcggtcattttcaatatccttctattctttttaaatgcttttcttggaattgccatctatgttgctggcttgaacaatcacataacctctgactccttctcccctacccttgagcttcagatctagtgtaagtgacatgctgggtgtcctttgaggatatctcaagcagcaagcagtgggaggcatctcagcctaggctcttgtcccattgtcccctgtcctggcaatactgccttcagtttgagctagctttttgggtgtctttttcctgtcccttttcccaccttcctgctgtacacctgcccagctaattgatcacagcccatggattgtttctcatgttgccattttcttggtccaggcctcatgtactcatcgccaagacagttccccctgtagaccctccaactcccccttttctgcaggcttcccctcttcactccgtctcaaccgcctacagctgcttattgtgtctgcttcccaggtcctcagccctctgttccccacagctgggcacactgggctcagtaggcataatcctgtactgtcttcaggccctttgctgacctcatgcaagggagatgtgaagagaacatacagctcagcacctagttcccttgcttctggttcctgtatagcctgttttatcttggtgatacatgaggagatcagatcctaacttattagccctaccaagcaacaaggtgcctgtctatggtggtacctggccctctttcttagtagtatgcctagtatgtgccgcagattctagtccctgcctgggagcttcttagtcactggtagaatttcttaatgttaacctgaagccgcagttttagtctgctgcccagacaggctgtgtgatcccctgacattatatcttcatcaatatggtccactctgcctggattgtttctgccctctttcaattatttggtcctatggtagtatctttattatatgcttgctattctaagtttacattagaaatgagacttgagtgtactgatgctgtttttttgaggtatgctagttaggtattttttttttcacttctttttcacgttgttctccatgttgggaggaatgtttatcctacaatcctgatgcttccatggagaagtcagggccacctccccaaccctcttccctctcctgcttcctatcaaacataaacaaagctggacactagttaaagtgataattattgaagtggggaaaagagtccagcatgatctaaggtcacccttgatctgtgcagagaggactgggcatttataaatgagaatgagggagtaggaaggggagggggcgagctgggtctcaggagagtcagggaaatgaaaaattataaaaagcagaaagggagggttaatccatgtgaaaccatctgggtttgttagctagtgcttatagaagttaagtttctactctttggcagagaccgggcttctgcaccctctaagactgggagtcagggagccctatcttcaagtgattgccacggaacaaacaacaaattctctgtctggagttttctcaggcaggcactctcagaggggctaggatcatcctacagatgaagcctcgagcttttagaaactgtgttagtgtttgttcaagtctttataggccagggttgaggcctagtcaacaagagagctcattggggcctgacaagagtttgttcaaggggagaatcttggtaagctctcacttcaccctatgagaaaaatgattcattgaatagatgacatttgaaaagggaaccgaagatattcagtctgtttcttctgggcattgtccacgggacacaaatgctcttttctgcaactagaggtaaattaaccatccctaggtgggagtgcagagtgcttggatcatctagtgaatggaggatgtgtaaatatgactcaagagtggattcactacgcagttgcagtaatcaagacatgcgggcacaatgataaacatgttgtgcctgtaatcactttgggaggccaaagcgggcggatcacctgaggtcaggagttccacaccaacctggctaacatggtgaaaccccatctctactaaaaatacaaaagttagctgggcatgatggtaggtgcctgtaatcccagctaatcgggaggctgaggcaggagaatcgcttgaacccaggaggcagaggttgcagtgagccaagattatgccactgtactccagcctgggtaacagagcaagactctgtctcaaaaaaaaaaaaaaaaagaaaaaacagaaaataaaaacaaaaaccatgagatacaactttatacccactaggatttctataaaaaaatatggaaaataataagtgttggccaggatgtggaaaaattgaatccctcgtatattgctggtgggaatgtaaaataatacacccacttcataaaacagtctgacagttcctcagatggttagacagaataccatctgacccagtaattctacttctagctaggtacccaagaatatacctagcacatgtgaaaacatatgtccacacaaaacttgtatgtaagcagggcatggtggctcacgcctgtcataccaacactttgggaggccaaggcaggctgattacttgagctgaggaatttaagaccagcctgggccacatggtgaaattccatctctaataaaaaatacaaaaattagctggacgtgatggcatgtacgtctggtcccagctactcaaaaggccaaggtgggaggatcacttgagcctgggaggcggaggttgcagtcagctgtgatcgcaccactgtactccagcctgagtgacaatgtgagactgtctcaaaacaaaacttaaacacgaatgttcacagcaacatttgtcataatggccaaaaagtggaaacaacatatagttctcatcaactgatgaatggcttaacaaaacgtcgtatgtctacccggtggaatattgcctggcaataaagaggagtgaagtctgctacatgctacaacatggatgaactttgggaacattgtgctgagtaaaaggaagccagttacaacagaccacattttgtatgattccagttatatgaaatacccagagtaggaaaatctgtagaggtgggaggtagattagttattgcaagggcacagggtggtgatggttgtgggaaatgggagtgactgctaatggatgtggaatctctttttggaaatgttccaaacatagattgtggtgatggtcacacaggtctgtgaatgtactaaaaaccattgaattgtacactttacatgggtggattttatgacatattaactatagctcaaaaagatgttgaaaaaagggacttaagtgaggaaaactaagaatgattgtaatagcagacttccacaaatcaagtcttttttcttcagtcgcatatgtcagtaattgatgtggtttggccgtgtctccacccaaaatctcatcttgaattgtaatccttacgtgtcaagggtagtgtcatggggaggtaatcggatcgtgggggcggtttcctccatgctgttctcatgatagtgagtgagtttcacgagatctgatggttttataagtgcttgtcatttcccttctggcacttattgtctctgctgccaccctgtgaagaggtaccttctgccatgactgtaagtttcctgagatctccccaaccgtccagccatgcagaattatgagtcaatgaaacctcttttctttataaattatccagtctcaggtatttcctcatagcagcatgagaacagactaatacagtaaaaaagtctgatattagtgaaatcttcacttgtctaaaatcagtaggtatatgtatctctcagttgagaacctgaaagagaagacagttatttattgaccttctaaaacctccacatattaatgcatagctgagtataccacttaccctctgtgtatcttgcatctattttctatcttgtatccatcctgtgtcagcactgttgcgttgatgtttttaaatcagttcccaacttgcagcaggggagggagggagcggtcagggacgaagtatgattccctatcccagcccctccccagggccccagtccgtgtgtctctgggtcctccttgatgtggtttccgtgcttgaatctattacatttttttccatgacatcatttattctccctgccttccccttcctcacaagaagatctagtttcaggggccagcattccccagtattcccagtgtggtcagattgactttgtgcagttgcatcattcatggcataaatgagatattaataatactatatggctgtcctccagacccatccatactcctggacctccaactcaaagctaagcatcaccacctccccacacttgctcagggagtgttccccgcaacatctgcccaccatgtactcttgcaacaaggtattaataagcgagaaggtgtctagaacttcaagtgaccactagaccaaataaaggttttttcttaatttgaaagatttgattcttccctgagaattcaacttcagaaagaatgaacgaaactaagactttttaagttatttatcatatctataacccattagaattaatagctgtagatcctcatgaaaatttttagttaattttcaacacggtaagaatcatgagcattttaaattaaatggaacactagatggcaaatgaatgctttaccttattaagatgattcaatgtattccatagtttttaggccacttctaagcagtatttcaaggaaacatacttggtagtaataaaaaaaatttttgtggcaaataaacaattaaaaatgaaagatatgcacatcaaactgtgattcatttttataagtttaatgaagaattagctatatgataattcttattttgtgacagttacattgttattgtattcaagaaagtaatacctacaaaaatagcaaattttgaaaaagaagatagcaccaaagaacaaaaatgtcttgttttatatcagtcacacaatgcactttctctaggtgttaaattagtaatacagtatatgtgtgtacatgtttcccattcagggatttgtgaccaggtggaatgagggtggtctctgagtcacctggagagctttataaaactccaccttaccctcatccccaatagtgctccccagcctcccaccaagatagctgaatgtcagaacctagagggaagagggtaagatgggtgtggtacgtggatgaattggccagggactcctggggctgtgcaacccacactctcctcatgttggtggactgtgaagatcaaggatgtctggaactttttccagttgagtgctatggacttgagaccaaagttaatttggaaaggaagtttggggtagccattcataaatacatgtaatagactcctcttgaaggactacggaacagatgataggcctccaagagtgttagagtaagtgagtatgaatccgtccattttcagtaaataaatgattgattccctggcttccaggaaaacaatgaaaaacatctacattgcctttgtattttttaaatcagcaaattgagcttactcagattaccttaggcttgagagagatagaaaagtattgcaaagtagtctgacattggtgggaaaatggagttgatcccacacaaaaactatgtttagggaaaaattgacattaaaatggaacaaatttggtagcaaaataaggagataattcagcagagaggtaaactgctctttattaaggagcaagcttttttttttcttaagttgttttatttgtaacagaaataatttcaagttagaacctgtattttccttctttctatctttttaaaataaaagtggcgggttcattttttccatagcatacctcctcctgccctgccattccagttgtcagtggggtgctgagaacacactcttctattgaaactgagttttctgtcatctcattccccaagcttccctggaagattagcaggatggaaaacctaggtttaaaataagaactaacttatcaatcataggctcttttaaattgaggaagtcttttttaaaaaaaaaaaaagttggtagtgaaaacacagaagaataattacagtatagccatcaatctagcagagttgagtgtggtcttttgtgaaaccatttgcgtagacttgtaaacaacttcaaatagaaaactatctaatcataagaagattgtaaataccaaaataggaggctctaaacaggtaaaaatattttaagtaacacttatctgcttagtattaactagaggtaatagttacatttgggcaaaactgaaattgtatttgattcacttttttcatcactaattacattacttctgtagcaaagagtgaatggtttgggttctcttttgccctgggtaaaatatcagttccgggtaaaatatcagttccaaacttccaaggctttttgtggatatcatagctttatgagggttacaaaaggtcaaaacccattccaaaccaatttttgacagttctgaaaaactctgtgaaaatcattttgcctcctcctgttttatatagtctgaaataaatatcaaggaagtctttcactgcagactcatatttgtttcatacaacagtttccttgtaaagttcatctataggatgaattgcagcctgtttgttccactgtatagaaacaattcaagattctaattttgagtgtagcagtggtgctccttctatagtgatgaactttacactttggaaatgtcaccaaggagctcaagcaaaaaccgaacagttccagtggtgagtgaaatccttgtttatagtgcctgtgtgacttccttaaaacagaaaagcacaacagagatgtgagtcacaacacagaaacttggaaaggcttttcacagaaaataggtaaatactgcagaaaaggagatatttctagagttgatttatgagacaaagagttgatttatgatctaaatgttcgctatatattatattgtgctagtatccttttaccaaatatgttgattaacaaatgtaggcattttccaggataaagattcatgttaatgggatgagatatgtaacttgatggttacagaatgcagtaagacatagagaaacataataaacatatatatatatatactgggatcttgaccatgtgagtccatgaaagtctgtgaggttttttttttttcttttttgagatgaaatcttgcactgtcgcctggcctggagtgcagtggcgcagtctcagctcactgcaacccccgcctctcaggttcatgtgattctcctgcctcagcctcccgagtagctgagactataggcacacaccgccacacccagctatttttttgtatttttagtagatacagggtttcactatgttggccagactggtctcaaactcctgaccttgtgatccacccacctcggcctcccaaagtgctgggattacaggcatgagccaccacgcccagccaagtctgtgagtttttattgcaactaagaaggaatagtcataaagggatttgattttgaaccaagactgaaaggaactgaaggctactttttggcagattaaaaggtggctgccactgtatgcatattggatcagtctgaacagagatattaattttggagggagaaccttatttgaagtacagcagatagatttgcttgactggtatggaaagcaagaagggttctgtgatctctttgatagttgtgacgtaataatggaaaggctttatttcggtcagacgataagagcatgaattagaagtcctttgattgttgcagatgaactgtcacatcaggaaggcattctggcagtggctggagggacagataagttagcggggagtaactagactatgaaccttggagaaaatgtagtttaagtatgaatatgaatatgaatattgaactctgattagtgaataagtggtattagtttcctgaaaaaaaaaaaccctccatacactcatacactcctgtcaacatgcatacctcatagtacattcactttcgtaggcttgattcatcataagttctgaaattgttaattataaatatattctctaaggactttcagtgtgcacagcatatacgtatatcaagtagaaagtgtatctttttatcatgaaacttacataaacataaacctcgtagatttgtgtatttttgtggcagttttccaacagatgaaaataagtgtcttgaggaaggaaggggcgggctctcttttctaattgcacagaggtacaatgtgggttagctgtggccttggatggtaacctgcctgactgctctcttcctcctgatgtgacagccctgagttccatttcatatctagcactaagtttccaagaatgagattcagaagtttgggtgaggggagggggagcaacaactgtacccaagtgtcagagccaggctgcactcaggcctgaggctcagcttttaggaaccaaggtctagtttcagggataagaatattactggtaggaagcctattactgtgtgttttgaaagagggggctttgtaattcttttcaagtcacaggactccatcccgtgggggtatctgtggaactgctgaatctttaatgacgtatgatcttgcttcctgtaagttaagtttgcctggtagtaaccattgtacctctctcagaagaaccaagatatactgttatccagaaaagaaatctcaaagagccaacaatctttctaggatattcatgcctttcctataataatgttttctgaagttatgtaatatttgatacaaacaaaaggacatacgtaacctacataaattgtgcagcataacaataatcaacttcccatcttaaaaacagaatacttctagaaccttttcccctaactgtagtcttctgctcattttatccctgtgtctccagaacagaggtagccaatatcttcatttttatgtaaatttttcctttgctcttctcttacattgttattaaaatagttttatcgcatacgtatgtattcttaaaccatttccttttgcatgtttttcaggtttataagattgcatcatagtagtcctgtgggacttgtttttttaattcaatataatgtgtttctgaaacacattatagctcatagccatagctaattctgtagtctaactttccattgtagggatatttatctgcttttggctcagtaaatatttggattgtttccttgcttttcttttttattcttttgacaataatgctggtaaagacatttctgcacatgtctcctggagcccagtgggaagaatttctctaggaatgcatttttcaaaccctttagatgcagcatgaaatgtattttcgttgttacatggttattacatgatacaatccatatcttttaaaatccattttcatgtttcttttctattctctttcattaaaacaaatgccactgtgatatgacctagggatacagcctgcactctgaaaaaacactcctccaagacagaacttctccaacttcagtgtgcaggtgaagattcagcttcaggaggtcagaagtagggcctgagtatctgcattcctagtaagcttccaggcgatgctgctgtgctggtgtgagaaccaacactattttgaatagcagggctctaggctctttctcaaatttctctgatgacaagaatcacccaggctgcttcttatgatacaaattctggggcttcatcacaggcccaacaaatctaagtctctggggatgaggcctagagagttttatagggtcatgtgttgcataatgacattttggtcaaccgcagaccacatataccactgtggtcccatatgattataataccatgttttcactgtaccgtttctatgtttagatacaaaaatagttaccactgtgtttctgttgcctacaacattcaatacagaaacatgctcttcaggtttgtaacctaggggcagtaggtggcaccctatagcctgggtgtggagtaggctctactgtgtaggtttgggtaagtgcactctatgatgttcacacaatgaaatcacctaacaatccatttctcagaatgtatctctgtttttgggagatgcatgactgtatttttgaaaatctgccaggttattcttctaagtgaaggaatactattctaggatttatgcctaagaatataacagctggattgtattctaaggttagctttacaagatgatgccaacttgtgttccatagtggctgtaccaatcccactctcattaatgatgtataacacattgcattgatctacattctgccaacaatcagtattaccagactttctaatttttgtgaatctgattggtatagaatggaatttactttgactctaatgtgcatttctcagattagtattaagcttgagcatattttcacgtttgtggtctataattttcctcttcttcaaaagtcctgttcttttaccaacttttcttttgagttgtcagctttttcttgtgattggtggaagttctgtatataatcaatatctctcgtttgtttagtggttgccaatgtcttctattctgtgctttgccttttacttttctactaaatacctctttatatcatttgtctttattgtgtttggttgttttcccttctttacaataataaggttttagcttaggttttcactttccttatgatacattttgataaatatgttcttaattttagtgtagcataaattatcaagcttttcattgatagttggtgcttaagaactatttctttgccctgtaatcagaaaaaataatcccctacattctttaatttaaaaaattaaatttgggtttttgtgcttctaattgagtcagaattgatttttgtatatgatacagagtaggaatccacttctcctagcaccacttgtgtttcccccaggaatcagaaacaccacctctatcatatagaacatcaggatttctgttgtgctccatgtctgttctttcagcaacaccacactgtgtagttactgtagcttttaaataactcttggcatctgatagaacaaattttcctacctcattcttcctacggagtgttctgtttggggacctttgcacgtctttatttactttagaatcaatttatcaagttccttaaaactctaattaggttttaattgaaattgtagtgattctatagattagcttggggagaactgacacctttaccacattgagtctgcccattcataaacatggtataactccaattattttggtcctcactaatgtctttcaatgaggttttggatttttatctgttattggtgtcttgtaagatttattcctgggctccttatatcatttgatcttgttgtaaatgaaaaaaattcagtaatgtttcagtttgataatatacaaaaaatgcagaggagttcaaaattaatcccctatttggtcaccttgctgacatttgctatttttgtataacttgtaggtcctgcttgtttgccaagcctgtcacattgtctgtgtataattaaagtgctgttttttcttgtttcattcttacacttttcatttcttactgtactgaatggaacctccaggaaaatgttatagtgaaacagcttagatttattttttgtaaacagattatggcacgatgttgattttacctttaattctctgggcattttaatagacaatattttatttacatgtattgtcattactagtatatactagtagtaatatatactagtagtagtaatatatatatatatatatatatattactactactagtggtagacttctgtgtaccacttttctgtttgctttctggtttttcctgtttttctacatttcccctcaccccttgccttttttcttttcttttgtttttttcccataattgactgaaataactttttttctttagatgagttacttgttactgaaggtattatcctatggctatctgtatagtgattaccctagagagtttgccttgcatacttaaagtttatagttgatatcttaaacttcccttcccagtgatggaaagatcttacaacactgtaactctgagcattgccctacctgtgtgtatgctcttgttgtcggcagtctaattctgtatatataaaaagctctaaaattagacagtattgttattttacaaacataagtttttatgtttttttgctcaccatttcttctagcatctcagaccttctttcaaaactcatttttctttttgaaggtgatcctttattgcaggttcattggtagtaagttcactcaggtacaattctttgaaattagctttattttgtcttgatccttgaatgatagttttgctacgtatatagttctaagttgacatattcatattttctctttgtactttgaatattttgttcccttgttttttgccttccactgttgttgtctagaactctttgttcaatctgccattactttgtaggtgatgtgctttttctctctagatgcttttgagatcatctctttgattattttggtgttggtggtttaactacattatgtctaaatgtggaatttaatttttctatcttttgtatatgttatactttctgtatcttttgactgatatctcttgtcaattctggaaatttctcagacattatgtcttcagttagtgcctctcctctattccctgtgttctacttctggaatgccaattagacatagatacaccctctaattttgccctccatcttcctttcttattttctattatgttcctatttctatttttctgtgctacattctagataatttcctctgatccatgcactacttcactaattctgtcttaagctgtgtccaatcttgctgtctagttttatacagtacataattaatgtcctatccattgaggtttttgttttatttcaacagtgtttttatttctaaaagttacgttagctgtttttaaaattggtcattttcagtgacgtattacatgttcatttttagaattacatttttaattttagaagtggcacgcaaattttatattctgaatctggtaatttgagtgatgtgaatctgttgtttcttatctcttttgactctgtcagggcatcttgttttctgttatttttgttaatctttactagtgagcttatatttgggtgggctttatttgtgaaagtaggaggcctatatttatgtatcagtgtgtttatagaagatttgtatttgtgtttgctggaatcaggagatggtactgactgcagatactttacacactgttattcgtatgagattaccttgagaacatcatatttggcttccctgcccctggcccatggcttaatctttggatgccggtgctgatatagacaactagagttccaccttaccctttgttttggataagggacatggtgtaaggtgttgctggagacacactacatcctacgcaattaaaaaaattgtcttataccggatctagttgttttcaaatgggagagtccttgagagtaaatgatatgccattctgttataatcagaaattgtaataattactttatggatgtattcttcatttattaatttatctaattatttgatgagtctgaatattttgctttcatacaaacacaataataatatgatataatgagtggttgttgagagaaattcttaacataaacctttgtcaaatacagttgctatagccaaagaaagaaatagttctatgtattgtaaatctctatttgaaatactatgccaaataaatgatgcaactcataatcgcacattagggctggttgcagtggctcatgcctgtaatctcatcactttgggaggccgaggcaggtggatcacgaggccaggagttcgagaccagcctagtcaacatggtgaaactccgactctaaactacaaaattagccaggcattgtggcaaacacctgttttccctgctactcaggaggctgaggcaggagaattgcttgaaaccagaaggtggaggttgtggttagctgagattgtgccaccacactccagcctgggcgaaagagtgaaactccatctcagaagaaaaaaaaaaaaagataaatgcacattagactttgcttatttacatttaactggaaccattactttaagatctgtccttcggagccagtataggcccatagccttgaaatgcagccttttttagcaaaaaaaaaaaaaatggaacatctgaacattgtttttcttttggagagaagtttgacattgtctgttgtacttagagatgtataacatctacaagtcagcagtcttacttttaacatgcactaagggaaactggccaggagggcgtatagacaaagatgctgctcatagcactgcttgtagtagagaaaaggtaaactcagctatcttttctgcagtaagggaatggataagtaaactgtattttatttatttaatgtaattctagacaccagttaaactaacatagcttcaactctgctatattgaatgaaatctcatgttgcaaaaaatagtagcatttttgaaaatttttaagcatcctagatatatataataaaagtacaaaaccatgtttgggaatgatagataataacctttgaataggaagtaggaaggtggcaaaattttatatcagtaatattttatttctttaataaaaagtgatctgaaacaaaacataaaatgttaacatttgatattagtggatacacagaatattgttttattttgtacttttcaatgtgttttaaaggttttattacttaaaacttcaaaaaccctaaacaccaacaaaaaattattctgtttaaaatgaaaacatatttcaaccattgttgtgatactgtgatacttcttttttttttttttttttttttagctattcttttttttttattatactttaagttttagggtacatgtgcacattgtgcaggttagttacatatgtatacatgtgccatgctggtgcgctgcacccactaaatcgtcatctagcattaggtatatctcccaatgctatccctcccccctccccccaccccaccacagtccccagagtgtgatattccccttcctgtgaccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagttgacagtcccaccaacagtgtaaaagtgttcctatttctccacatcctctccagcacctgttgtgtcctgactttttaatgattgccattctaactggtgtgagatggtatctcatagtggttttgatttgcatttctctgatggccagtgatgatgagcattttttcatgtattttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattaggtcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttctataaggtgtaaggaagggatccagtttcagctttctacatatggctagccagttttcccagcaccatttattaaatagggaatcctttccccattgcttgtttttctcaggtttgtcaaagatcagatagttgtaggtatgcagcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaatttaaagtagttttttccaattctgtgacgaaagtcattggtagcttgatggggatggcattgaatctgtaaattaccttgggcagtatggccattttcacgatattgattcttcctacccatgagcatggaatgttcttccatttgtttgtatcctcttttatttccttgagtagcggtttgcagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctgaccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcaaggaatgtatccatttcttctagattttctagtttatttgcatagaggtgtttgtagtattctctgatggtagtttgtatttctgtgggattggtggtgatatcccctttatcattttttattgtgtctatttgattctcctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaactgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagtggctttgagtgagattcttaatcctgagttctagtttgattgcactgtggtctgagagatagtttgttataatttgtgttcttttacatttgctgaggagagctttacttccaactatgtggtcaattttggaataggtgtggtgtggtgctgaaaaaaacgtatattctgttgatttggggtggagagttctgtagatgtctattaggtccacttggtgcagagatgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactcttagatccaacttgccagtgtgtgtcttttaattggagaatttagtccatttacatttaaagttaatattgttatgtgtgaatttcatcctgtcattatgatgttagctggttattttgctcgttagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggctcccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagactggggaagttctcctggataatatcctgcagagtgttttccaacttggttccattctccgcatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagtagatcgcatcggctcctgaggcttctgcattcttcacgtagttctcgagccttggttttcagctccatcagctcctttaaggacttctctgtattggttattctagttatacattcttctaaatttttttcaaagttttcaacttctttgcctttggtttgaatgtcctcccgtagctcagagtaatttgatcgtctgaaaccttcttctctcagctcgtcaaagtcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggagtaccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctcctagagctgtggtgggctccacccagttcgagcttcccggctgctttgtttacctaatcaagcctgggcaatggcgggcgcccctcccccagcctcgctgccgccttgcagtttgatctcagactgctgtgctggcaatcagcgagactccgtgggcgtaggaccctccgagccaggtgtgggatatagtctcgtggtgcgccgttttttaagccggtctgaaaagcgcagtattcgggtgggagtgacccgattttccaggtgcgcccgtcacccctttctttgactcggaaagggaactccctgaccccttgcgcttcccaggtgaggcaatgcctcgccctgcttcggcttgcgcacacccactggcctgcgcccactgtctggcactccctagtgagatgaacccggtacctcagatggaaatgcagaaatcacccgtcttctgcgtcgctcacgctgggagctgtagaccggagctgttcctattcggccatcttccattgtgacacttctaaccttatttttgtacagttcatcattcagggagaataaaatatgacatgttatcattattaagtgccttaccaatacccacatttctttattttggaaggtatcaacagtaaatttctacccctctttttccaacctctctattcaataacacttttattttttatggatttaggggtacaagtacagtcatgcaatatggatatatggcgtagtggtgaagtctgaactttcagcattcaacaagctttttacttaaaaatttaacttaaaaaaattctcaaaatatttatcctgaaagacttggtgaaattattctgaaaccagataccttgaatgactagcccagggtccagtatgtattcttttactttattttttaaatgtactagccaaaccaagaactaagcaaagcatttggacatactgcattacctaacattcaacattacctaacaccactagggagtgctccttctaggctgtcaattgtggcctatgtttagagtgttattttcccttacctgagatctgtgttcttactgtaagtgtatatcctagtcattttattatacaagataatcctgaatgtttgccataacatgtaaataagaattccagctttcaaatatgatggaagtttaaatgattagttttttaaattttaaatttaataatttaaattaaattatttagttgctatgtagataatctatttcccagcgagatggggcagtagtttacttacctttacaatttaagcggagttcaaaccagcatttggaatacaagaaagacatggtgagactatgtccatcttaaaccaagaaataaagtagaatgattttgtgtagactttggcattgttacactttccttcatttattctgtaagactatttttttttttgcttctcttaaacgagtactgtttttgaaatttggcctatttgttaggaagatactattctcccttatataggattgtatgattttttgaagaaaaacagattgtttccaagggcattttttgatttttgttatgataaaatgtgaaaactattaatgtgatatctatgaaaagtattctggaggaaaaatatattcaaatttatataatttttaggataagtttgaattcgttccattacatcaccagtacatagatgcctgtagggcagtgtaaattaaagattgttgtatcccagcaatttcagcttgactgacaaggtactttttaaactctggaaagcactgaccaattgaaagcctttaactacttcacctaaaaacaaggccatgtacccagaatcgttgctgcctaggaatactgaattttggggtaggccactataatattagttactcagacctttgctctgatttcactaaatagtaaagtaaagggagctattgctttattattttgtcaccctctagtgtgaccggtgaggcaggagtacagtagctggaggtcctgaaggggcccaccatgccattctggttgttattccctttattgtaatacacctccatagagttcattgagaggtagaaaagagaaacctgttagtgggagcattggttgtaatctatgtttttgattatcaatgacatgatcctaaaattatacccaaatatctctcacaggttctgaaattgagtttctgaaaaagcactgtagtagtaataaaaggtaaagtgcagagttccaaagaaatgagctgtgaattgaacctgcaatggaaattgatcctatcagtcagtttttgcccttgttcatagaaaaataggactgaatgtagaaggagccaggatcactgattaaataggatgctgaagtgctggaggctagaagtgggcttgctcgtcccttaggtcagacttctctgctggaaacctggctcaagctggcagaaaaagaacagaatgaaaaatgctgcaggcatcagtgggagagtcggtaagagctcactgactgagcttcctgcgtgacagccagtgcacttctccatagggaggccattctcatctcttatcatgagtcagtgggcccacagtggacccactggcctcatgattcatgccaacggggcctgtcatgataccctttcagggaagcagggaggcatcagtgtggccagagggtgtgagtgtgaagaaaaatggctttgctatcaattccattctcagtagcatcctcaggattgtgaggaaagaggacaaatttcctacaactagtggtcctatgaataccatttattacccttttatctaactgtaagagatctatattgtgcacatagaatgcttgtaatgctgtgccatgttttggggggacagtgtttgtattctactcccagaaatgcagtgtgagttgcaattagcctaccaaaattacacatttctggttatgaagttgccatttgtttcctacagtgtaatatatttctacagtgatgcccttcagagtgttcagtgatcatcagtataactcactagagtaaatgtccctgtggaatgcctcattcacagttagtagcacactaatggaaatcgctctgtagaaacattgaaaacaaaggtattataaaacactaacttgagatgtaattattataaatccatttctggatcagaatttaattttgcaaaatggcagaaaaaaaagtaaaaacaaagaagcattgaaatcaggcaatttgcttagtatgagaattgtaaaagaattgtatgagaattagtaaaagaattgtcagatttccttagtcattggtcatagcctatcaacactatcattaaagaaggctgctgtcataggtacatggtagcacatggcatttcctttatgttattgtatgtatctgcttttccagccatttccccatccctcttaactttgcgtttggaccctggtaagagaaaatgacagtactccatctgaagtggaccatgtccctgtgtcatggtattgatttaacttatcctgtaagcttttgacaaatgagaatcagagtcaaagaggccttcatccctatcctatgttgacgtgacccttcctacccccattgatattgaccctgccacgttgatagcaacacattagtaggcacagcagaactacagaccatagtcaaaggctcacagagggcacaaaggaaaatactctgcaaaagcttccgtaagatagttttgctttggttaactgtagttatgcttcaacgtaaagatgcaaaaaagtgagtgtcaccctcttttcatctaagatttagacctcatacagcctctgtctcctgtctgattaccactcatgacaataggcaatttagagcctttgtcatagaaatgattgttttgtgttaggcttagctgtagtacttggcaaatgtatgggaaatgtgagacataattttaccatgatggaattctaaaaggtgctcacagagaaagggagcatgcaaaaatacttgaccggtacacagacagaagcctttgttttcagtcctgaattttaatttaagtatatattttcttggataaggaatactgaatgatgcagacttatttatgcagtgaaaaatagttttccattgaaattaagttagaactgtacttcttgtttaaactaatatctgaagcctttagtcattttattagtcagtaaaattgatgaaaaccttaggaaaatgcgttagaacagtcctgtgatgaataggaggcctgggattaataaggaaaagggcaaagggacacatgttgatctgtgtatgtatagagatctggagcttattagaagtttttatgaacattcaactaatgaagcattatataaaattagacatttccgttaagttgtaaaagttactagtctagggaaaaaaaccttcaatgttatttctaaataatttatttatgacattttcccaacagtagtaatttaaatatgaaaaattaattttgtaatagggaacattccatgagaatgccactcacgatttcttggaggagttttcatctttggttcttagatttattacaggacagagtagcatgaatgatctttattaatcccattttatgattgcagcagatatctggtaaatgctacgttgcatatttaacattattccattttaaacattttcatttgtcagaggttgcaggtaaaaaggggggattttaagttctctctgtggcataattgatggagaaaacagacacaaagaatttatgcacaaataggaatcaagaagggaacttcaacaatagtctagacaagtttgcagcaccctgaaatgcaggccaggctctctggtacagctgaactggggaatgtggccttgaccctctcgtctatagaattagcaggaaaagggggaagaattcctctcagcacttttgtctcaagtttaaattcattggatctttattatattgtacattctttggtcatgttttaggtgaagtcttagtatctttaatatcctgatttcttcttatttgattctctttagtttggtagagaaaacagtggagtggggacagcatgatttgtagttgtcaggtctaaatttgaatgccacagcaaaccctgaccctgatcaagttattgagcctaccttggtcacaatttttatgtctatatattagaaataaaaatatttacaggattattttgaggaataggaaatttatagaaagcaactcacacatagtaagtgtgcaataaactgtagcttttatatctcaagtttattgtcccttctcaattgtagatctctttacattcatatttggtgagcacacttcagacaaacaaaaatcaaaattatgaatcaaatgacctatgggtgtataacacaaaacattttaggttaggcttttcctaaaaccctgaatgctgaattttttgtagtagtgcatggtacattataagtgcttggtaaatgttatttatgtagtagtatttattttcatcattatttcataaacaaatttaagctttctctgcatatattttgttttaaattatgcaaaaatgcttatattctctccatgtcatttagatttctaagcttgaaactgtacctggagcttgggctaaaataagattactaaaaaattgtcatgaacaggcaagaattactttagcattgattgtgtggaattctattcagattgaaatccaaaaatacctgctctgctcagaagtttatgttctcttactatattatttcatgtataattctcaagcttttactcttgttttccaattacatgattataaattaatgtttaaagataaaacacatgtatcagtattaagattggtttattttggccgggtgtggtggcacacgcctgtagtcccagcactttgggaggccaaggcaggcggatcacgaggtcaggagatcaagaccatcctgactaacatggtgaaaccctgtctcgactagaaatacacacacacacaaaaaaattagccagaggtggtgacaggtgcctgtagtcccagctacttgggaggctgaggcaggagaatggcatgaacccaggaggtggagcttgcagtgagccaagatcacaccactgcactccagcctgggtgacagtgtgagactccgtctcaaaaaaaaaaaaaaaaaaaaaaaaagcagattggtttattttatcagagacccagagaaaaagaggcttaagtaagatagcatttaatttttcctaatgacaagtttggaagtaggaaggtcagggctggtatggtagttcagtgatatcagagaccctggctcctccttcatcattgctttgaattcttaacatttaagtgtctcatggttcaccatggctgcctgagctccaaacatcatatcctccatccagctaataggaaataagaaggaccaaagatggtgagcccctgccttttaagaacacctctcagaaactattttggacatttcatcttatatgccattcatcagaacttaggcacatggccacatccatctgcagaaaataatggaaactttcatctttattctgggtagccaaatgcctagccaagatttagggatttattatccaggaagaagaggagaccaggtggtggggacaactgggaatatctgtgacctttgggattgacctgagcctttatctttcttctctctcatgttttcttttgtcttcttttctaaatagatcccatgcgaggcccaagaaaactagaagtagtggaggtcaaatctcggcaaatcactatccgctgggagccatttggatataatgtaactcgttgccacagttataatctcactgtccactactgttaccaagttggaggacaagaacaagtgcgagaagaagtaagctgggatacagaaaactcacaccctcaacacacgatcactaacctgtcaccatacaccaatgtcagtgtgaaactgatcctcatgaacccagagggccggaaggaaagccaagaactcatagtgcagacagatgaagaccgtgagtacctttgaatgatatgtttgtgtaaaacatgttctttcaaaaaacaacttttgtttcgagatctttgctgtgcagatggaagaaagaactacttattttgttgaacaacacaaatgtgtatctgtactctgtattcttaagcgctgattgaaagagggaaaagggagtagagatatagaaatgtcattctttattactcatacagttacttttctatatataatcattccatattgctctcaatagttcttcaagttttatttcattgggctgaaaaattgttgttttgggtattagattatttatataaaatcattggactgaaaaattgttgttttgggtattagattatttatataaaatgtttacctaaatatatttaaatggcattctgaaacatttttcatagttcagataaaatttcagcactaaataggggctgcccttgcttttcaacacagtcttgagaaactgtaagttggtggtcatgaaacaggtcatttttctccacaggaacaatgttgaaaccggatgttactttaataaacaactactttacaaataaaccatgcatgtcaccagtaacgcatcaaaaaagcaaatatacaggaaacctccatagtaatttaaaacagtaaaattatgccttgaatctcaatgcgtggatataaatgtttctttacacagatgacacagggaacccttgtgtgtaatgacatattcatatagtacataaaatacaatggtagtatatcataaatttgacctaaaaatcatttttccggcatcaaaatgaatgacaaagaatgtaggaagaccattaaacgaatgaactgactattcctaagaaaaatagttgtttagctttttgtttcttcatgtaactgataatgtaattttgaccattgattaaattgtgagttgaatgtttagactactttatcgtttcatttaaagagctaaaaaagtatttttgagtgtttctacctacccagcacctgcgtatttttgtagaagaaaaacatagaaatagctggagtagatgaggaactcactgcacatcctttctttcctcttttattgtccctcaagtcctgcttgtgttggttcctctcaagcagttgtttgagagggagtctaagtttgatggaagccactcaggcaaggctgagaccagaagctctatttctgtttcttccaactctctctcatctcccagaagaggagaagatggtgtccacattgtcatcaagttatggctggctccttcctgccttacatttctctattgactctggtcctaacatctgttgtttctacttccaaagttttagattgttcttttctgtcaatttccattggctgtattcaaatccttattattttatgctgaaatttctataattgtttctaccttttctttgtggttccagcctttttctattctaatgtccccctactcactcactcactaatcttaaaaatgtattttcatcttggctgtctctctacaaaagtcttgagtggctcttcacttaatcttcattccagtgccttggctgtcaaggtcttctgtattcttggctcatattctaggagtaataacttctccttcacagcatcttgttctgcaaagccatccctgagtgctggtccctgtgcctgctctgtgcatcctgggcttcccatcgttgcctgattgttctccttggccagtcggggcctctcctggccgcttctcaagctcgcctactctgctaccagctgaagctctcctcacatttcaggtccttcacatagctgtctccagctcttcagtctgtgttattcacatccctctgaccttaattgtacttcataagatccttaactctctgaccctcaatttcctgatctgagaagtgagaataataacaattcttagatacattagggatagaagaaatttatgtggagagctggttgtaggctgtcagaaaggggcctttcttagtattgtaatgattcatagccactcatgattcttctttgctccctcattatgttatttgtatgtatttttttctttttattgtaaactacttgacaagaagtactgtctgtttttcttctatagcaataggcgtgatattgagtaagtaataaacaccccaaaataccttaggtctttaaatgaaataataaagtattgttgataagcatttagttcatgttttaataaacaataatggttacatcaatgagagaaataaaatgcagtcacttccagatatatattgctaaagcatgaacctattgaacactatgggtttcaaattgagaactgtcatgagctaggaattctgttaaattccatcaaaacatgaggacagaattactttgtttgtttaaattatcttgctagtccctgaagctggagcatgcattacttccaaataaaaatctattgttttcctagcacactagcgtttcattaattagaaaaaactttaatttcaaattatattttgtaacccctccaaaaaaaatacttcagaaaaggcagagagaagaaagaaatagaataattgtcaaacagtatccagtttgaagagaaaagaattggggagtcactttgtttatccatcaacaaaagttataattcattgaacattgtgagttttattatagtataatacttttattgaaatacagtttttttcatcagaaattgtgtgggaaaaaatttacctttcattaatgttagtagaatcctatacagcccagggataagttgtacaaacttaggtattatggctttatatcccagatcctgaattcccagagcttctaaaaataggtactagacctaagttactatgaggtactatcttccgtaacttaattagtagtatattaattatttattcatattgttttaatttacattgtctttctctgaccttaaagtgattatctgaatccccattagggtttcctgtcaactattctactgccatttaccacagggtcaccaccagtacattctaataagtccatccttctgagatatcctcttcctaacatgattttgaatacctcctgtgtcatattactgttagtattttcttttatacgaattgaatgaaacaaatatttgttttgtctaactcttcaccttctttacatctgcacatggattaacacatattttcaaataagaaatatcactggctgctccgcctatggagtagccattcttttattcctttgctttcttaataatcttgctttcacttaaaaagaaaaagaaatattatcacaaaatagagtcactcatcttagttatcttgatggtgtgagaaaactgatgatgtcatcatcataaacactttcaaggttaagaggaagagacttagtcgagttttctcaggcatggcctgttttagttcaacttctaattatgatgaacattttagtctcagagcttggaattccagtgttcttagaactcaccagtgttgtcatttctaatgttttttgttgcttcaatgtagtcgtatataaatttcttcaacataggactaacaattattttcatatttatgtgctatttagggtttcaatgttaaaattaacttggctgggtatagtaactcatgcctataatcccagtactttgggaggccaacacaggaggggaccacttgagcccaggagattgagaccagcctgggaaacatagtgagaccctatcactacaaaaattaaaaataaattagctggcatgctggtgcatacctatggtcccagctactcagaaggttgaggtgagagatcacttaaacctgggaggttgaggctgcagtgtgcaatgctagccccactgcactccagcccggatgacagagcaagaccctatttccaaaaaacaaaaaatcaacttaatccaacttcattttaggaatgaggcaaatgtgacctaaagaggttcaatgatttgtccaaattgcacaatttaatcatttattagtcttaagtcagaacccgggcctcccatatgaatcagcattttttttgtgccaaacaacacttgactttaattggaataactgtaaatgttctacatttatatataagtagcctctaatctcaaaaaaataggcatactatctatgagtccttttgaaatcctaggcaggctttccaatctgtggtagtcttagcaatcattaaaaaactgctcatatcctctcacaatctaaaacattttttccaaccccttttaaaaaagtttattgagatatgtttgtccattcaccatttgataaatatttgggttgttttcactttttggctattatgaataatgctgctatgtatattcatgaacaagtttttgaattaacatttttttcacttttcctgagtacatacctaggagtgaaattgttgggttatgttgtaaatctaccagtgtttaaccaattgaggcactgccggagtgttttcaaagtagcggcatgactttaccttccctccagcagggtatggggtttccgattactcttccttcttgccagcacttgttatcatgtcttttcgttatagtaatgctagtgggtatgaggtgatatctcattatggtttcgatttacagcgcttgctagctaatgatactgagtatcttttcctgtgcttattgactatttgtttgtcttttttggagaactgtttattcaggtcctttgcccatttctaattgtactatttgttatcttattattgggttttaatattgttacttttacagtctagatacaaatctcttatatatatgatatgcagaagccttctcccattctgtgtcttgtcttaatagtgtcctttgatgcccaaaaggttttcattgtgataatgtacattttatctagattttctttcattgcttttgcttttggtgtcatgcctaagaaattgttgcctgatccaaggtcatgaagatttatttatatgtatgttttctttaagagttttatagttttggttcttacagttaagtctttaaactattcagatttaattgttatatatggtgtgagatagaaatccaacttcattcttgtgcatgtggatatccagttgtgccagtagcattggttgaaaagattaatctatcctcattaaatgttcccagtactcttactgaaaatcaatgtactgcaactgtaagggtttcttgagtactgggattctcagttcgattccatatctatatctatctatctatatatatatatctttatctatgtaaagatatatatgtctcctatgccaacaccacactgtcttgattactgtagctttgcagtcagttttgaaatcaggatgggtgagttctctccgactgcttattggtcattcacttcatcaccaaaaaatgtgatcatgtgccccaaaatatatgcatatttataaacaggatagctattttgtaaataagataggcatactagtacactaaattgtctataacatgaagcatactaaaaaactacatttaaaatgatgatgggataaataacattttataatgatattgaatattattttatagaaaactggcaaatgacatcttcacttttgttagtttttttgcaaacttataagaaggtgttatgtattttaagttttgaaaaatggcatcaaacttcccccaaatcacatatagtattaacaaataaaataatgtttaaagactatattgttatttcatctatatcaacttctactttgtatgtattttaatagatatattagtacagtagttcatatatatttttagcatggttttatcattcagtgttatggttataacttgaatccatgtgatatataactgttacttactttcaatcttttcagtattttataacataacttactaaaccatttgacttgtttctcatttattattattacaaaaatcactgctttgtgaacatttttgtatatgtctcctggtgcatatatgcgagaattttactagggaatatacctgcacgtgggaccattgggtcatatgttctgtgcatcttcagctttactaaatgctattaataattttccaaggtggctctaccagtttacacttccacaaggagtatgtgagaattctcatcacttgaaatccttcctcatttcttttggaagagtaaaaacgtttatttaatagatgggactgagctctgtctaattgattaaaacttttaagaaaaaaaatgataaagttattcttttaatcaagacagtgtagctaaaattgtttaagattccagatttttaaagaaaaattgagtatatgtgtggactattaaaatcttttctctcaatagaaggttaaaaccaagtctagaaaaatctactttttaattgtttattacttaaacatttatttcctcccaccctcctttagtcccaggtgctgttcccactgaatccatacaaggaagtacctttgaagagaagatatttcttcagtggagagaaccaactcaaacatatggtgtaatcactttatatgaggtaatatatatgtttgttagtaatttttaattagaaatactcatgatcatgataatgtaggctatctagtatttaaaaatgcatacttacataatatattttaagaagtttaatgctttcagtagttataatggttgttatatagaagaaaattgtaaaaataagtttttgaattatatataatttgaggatttagctttacaatgagttggacctttccagattatatgttattatatgttaagacacagcattacatttaaaaattacctttattaaaaacaataagtattttgaaacatgcattgattataagacaaacacagaattctattcttgcttagctattaaatattttactactgaattatagaaggacactgattatccagttagcaaagtcaataaatattgtctcaggactaacaatagaataatatcttttggtttcttagtattaccaaaacatcctttcgacttctgtgacatagttttgtctactgaggcatatcaaatggttgaatgatagatagcagagaagaatttgatgaattgttcaaggaaaaaagtaacagcaataacagggtgacattcatcatcacatctgtgcaagcatcatttcactatgcctattgtcatagaaacaagcaggtgtgtttttttaagctagcatttatttgaatgcaaattccacaaaattatatgttgtaaagtttctaaaaatcgtggcaaattctcatatggaacctctgcttgaatacctttcagaactactgacaaaagcctgtaaagatgagctgtcagacagtgatcaccagtaaaccccttccctgacccaactagcctcacatttatgtttccttgtaatttttgaaaattggtattgaaacacacacaaaaattaattcaaagctaagcgaagaaagataaaagaaaaaagttgatttttgtactgttattgatgctgttcattggctgcttcattgtaaaagaattgaatattatgaaaattcatggctcagcttttatagagctaagtgttataaacaaatcaaacaagttcatattattttttctcagtgatgagaatcttttagtttttatttttggccccattgccatttttaggtctcagttttgggggatttttacctagtaacaggattttaaactaggaaacatgcaatctttgaaatcaactttaatttccaagccgtaagttcacctgtcctaaaagccacatgttgctatctagacagacagaaaatatttaacagattctttctttttaatcctacaagagatatatctctgtgtggtaagtcactttaacatgaaaacaatgggaataataattcaaaggaaaaacccattagtctctctgattctgcagccaggactacccagttgaacactgatctaaatactactacaatggggatgcatgaatgtgtcataaatcagggttttaaaaatcagatatgtgtaagtagaacagattggttcagttttgtagggaccaaaggggaaatatgtgatccaggccaaagtgattaaatacaagctttctggccaacaagtctttctccctttcccatgttttctacaagtaggaaggaagggagtccccagctccctcgaggtaggtcttaggtggagtctcaggaggagctcttcttgagctgaaatgcacctgtgagctacgattcacccagcctatgccagagtttacaacaggcacatacagcttcctcccggagctgaagatacatgttgacccagattcagtacctctctggagaatcacagacttctgagacaaaatcacgctaaggaaatcaaacacttgccccaaaagaagcagggaccatggcaacattgttttctgtcatggagtcacatttgaatactggtaaaaatcagagggtgagataaattgccatggttggaaaaaagtttagtaaccaatgacacaggtgtttctttaagggaggcagcacacaggataatttttgaaggaaagaagaaagcacagatggaatattgttgatgtttgtattaggccgctcttgtttggctataaagaaatgccagaggcttggtaacttataaagaaaagaggtttaactggcttatgcttctgcagaccgtacaagcatggcacttgcatctgctccaggcgagggtctcaggaaccttatgaatgtggcagagggtgaagggcagcaggcacgtcacatggcgagagcaggagcaagagagagcaaagtagggggtgccacactctcctgtgaactcagagcaagaattcactcatcaccaagggggtggcccaaagccgttcacgaaggttctgcccacatgacccaaacacctccaacattgggaatctcatttcaacatgaaatttgaaggggacaaacatccagaccatatcagtgctggaaatgaatatgctgtagctttagattattctctgttctctctttgcttattatgaaagatacacaaaagcattaatgatcaaaaacggctgacagcattgttttttccaggagttatggcagttcacagccttacatcattcttctggttttcttccttgctttctccttttcactcctctgactccattctcagccttccagcactagccttgcctctctgaccttgtcttcgttctggctcaagtccttctcgtacgttaccctccacctcagtcatttaattttgtcaatcatcttcctacaacctgggtctgatcattacacctttactcagtagctatcaaaatctcttattttgtcgagttgtcaatttaatactgccctctgaaagaatacttgtaagtgcagaagtattcaaaataaaatatccttgcttccgaattttacttttcaaatgtaactactattaacagctagatacacatccttctaaaattttacaaggtagaaactgtagtgcaaattcattaatgaatataaaatggatgcagtttaataaatattatcaaacccagcattttattacaagaataaaataccatatgagactcccacctcacatcatacaaaaataaacaccagattcatgatctaaacacaaaagtttagaagaaccttctaagaaaaaggtaggaagacatttttgttatatatttttctaagcttgatataaaactcagcagtcattaaaaataaagattgacagatttggttatataaaattttaaacttctgaatgatgaaagataccatgaaggaggtctgagtacaaacagaagacttggagagattattttcagcacttacagcagtcaacaggctggtggctataatatatagagacctgctacgtagtaataagaaaaaaacaaaacactcttttaggaaataaaatggacaaagacacttcaaaaaaaaattcacccagcatgtaagtatatggtaaagtacctacccagccttactaatgattgagaaatggagtattacaagtgatacagaagtttaaatttctataatatcaagtgttaatcagtgatgtggagaaatgtgtacatgcatagtctgttgatgggaacacacattttgcagtctttttttttgtaggcaattagggagattctatcaaaatgtaaacatagtatgccaaacctatttctagaagtttattagtaatactccccaatgtacaaggatatttgcccaagtattttcattgtatcctactaactttacatatctctagtgagtaaataccagactcctggtcatgagactaacacatggattgttttaaaagctttagtatgtctgagatattggaaaaagacaaaagtagaaaaggtactgttccttttctgttgaagtaactaccccatcagcaaccaactatagaaagaatgaaatgagttccaaacttagggactcaatacatgagtgtgtgactagagtatcaagtgcagttttggttgggcactttaatcaagtagaatggtctagatttgccagctgattgggacattcaagagtctagagttgaagacaccttaatatccttagcctggataactgggctgttagtcaccatcagctgagataggtggttatgtagagggaatgagaatttaggggccatgttaagaagtttgttttcaatactcaagggcttctgtgatccaacccaaatctatatttataacgccatctcctactatttttcttctggaactcaatgagccatgtatatgaaattgtctcttcgccaagagccttctgagccatcacacaccctgcttttgcttagattcattctgcctgtgccatcccatcgctctcctcctatagcagctctgcctatctttcagtattttattcaagtactttacttttccttgaaatatcctaggtcctttcctcccctaaaatcagatttaattattcattcctttgttttctcagaataattgcttaaacctcaattagaggatggtgttttatgctggctggaattaccatcaactcacagtctagaagattttgattcccctcttctataacatgcaagtcaaagattgcatgttattctatcttggtttcccatgaatctctcagtttagaatttgaggctttaagtagagaaagggaagacaattttggaagatttcaggcacttacctgcaaatcagaaatcatccaatagaagcaacagtttactccatctcacccaaatctaaccctcacacatgatgttgagatctcagtttgcttttgacatggcacctcccataaaattacttacatccaacactgctgcagcaacgttttttacagaggcttcattacagtttcctggaccttcagccagggacagagtacaagtacagaagcttccagacttccttcttgtagtttgctgctgtactgaagtacttaacaggcacttaataagcatgtattgaatgaacaagtggaaaagtaaagctgaaaccatatggacatttgagtttgagcatgggagtatattttggtgccctttagagcagctgctgaggttggtgaatgtctaccatcagctctgtggcaggcagtggggttgtagagttagagtgcccctgctgccgagaagcttttctcattctgatattcagactccagggctctgtggatgggtctgagatggggaaacccatcacctttgtgacatttggtggacatatacatgcccaacatatttgtttgttaggcgtgagggagaggatctgtaatttttaggagtgcatgaattagtgtatacatgtgttttttagaagtaggaaagagaaggtgtctaatttttaccaaattgtcaaagggctatgactggaagccagctaagaaccccagtgttattttgcagccacaaggctttcagcaagtccaagcccatcagccctgctggaacaacaagtcccttagtaaagcgtttgcttgatagtctctgtgggtggagcaaagatcccacttgtcttgagtgtttacatgagcggatgcacacacccgctctccccaggagtagttttaggaaaatagatactgagtgccaaatatttactgatcacagtgggatcaggaaaagaataagacatcagtcactcctcagaaagaagatacaattacatgaaatgttccaattcctctggtatatttaaatcatgatttaagatcaaagaagagatttcacagtactccaagattcattgcccagtgaattgtatgaatagtcacaacacaggcattcagtggatctagtgattgttaggccaggtttaggaaggctttacagatacacagaatgagaactctggattgggacatggatgggtactttttttgtcccagtctcatctttggaaaccaaccctccctccctccctccttttctccctccttctctccctccctccctctcaccctccctccctctctccccttctctctctgcttttttttcatttggtttctgtgacagctttctctcctttggctctcttcttgcatttctggctcttctgttggcttctcctcctctatcctgtattaaatacctacattcattagggagtggtaccaggctcccttcttttttttctaaacttccttccctagtgaccccctccattccagaattgaatatcatctcaatgttcatcacccccagtcttcacttccagcccagtcctttcaaatcacagcttcatgtcatacatgtgtgtccacctgactgccgtgggcatttccaacttagtatgtccacctgtgtctgtaaatttctcctcatatgttccattcttttcgatacatgggaccgtcttctgatcaagcccaaaatggaacctatcctttattccatcctcttttttttatatccagtccttcactgagttctgtccattttatctctaaaagatgccaattcttttcatctcttgctgtctgtaccagccccaccttattccaagcccctgtattttctcccttgtgctatagctctaggccctggactctgctgtacttcctagtgccctccctactacttcaattgccccaccaatcaaatcaaccttccacctgcagtcagggtgaactctttataagggaaattagatcattttattttcatgcttaaaaacgttcaagggcttcctgttgtatgtatccaaactttttatcttggggtgcaaagcactgtacagtatggtcctacccacttctcaagcccccaaggaaccacaccgacctcctttctgttcatatactgtgcccactcactcccgcttcactgccttagttcctactgttcttccccaaactctcagcatgattaactccttgggaaagttcaaatctcttcagcttaactgacatctcagtgggcccttccccagccactctaagtggctgtgtaataacctctctcccctgacagttctccttattttagcaccctattcgtttcttccatggaacttggtgttttgaaagtattcatttacttactgtatgcctccccagctccatcccaccctgtccagattctcagttatctgaaacagggcgtgtatttacctgctggccatggtgcttgcagagtgtcagtgttcaatcaatgtttgaataaagtaaatgaatctgaataggtagaaaacatggaaacagagctaactgtctcatgttccaggcaggtgaaagcttacgagcaaaagcagtgtcagaaaagccccattagtgtttgtagggcagttagtctttatcctctgaccagaacagaaaggaatataatggtgtagtatcacagattcagaagtaagtttggagaaggtgagagcaaaactaaggagtttgggctttctctcgtatgcatttatgtttcattaaggtttctagacaggcaataaaatgaatgagaacactaagctagccacggtgggcagcgtcagtcctcattttaattatactttgtcatagttgttggatcacttctccccttcccctaccagactgatacctccttcggggaaggtacgattcctaaagcaccatgcaagaccccagctccgaacacagtgcttggcacatgagaggggctcaatgaatatgtttcaaatgtgtgggtgaattagtgagtaaacattggaagcaattatgcattcataatagaggtttagatccgtctcctccaaactgccttgttccctggaggtatccgaatggaggaccaagtaatcatacagcggttacatcgctgacgtccttcgctcagccactagggggtagattggctttgtctcttcttgacttccttaaccttgcagaggaagtctgttagaggattaacaatagatactctgcatgactccaatagtgtcatgcagtgcagtgattaatatatatagcaaacagttttcttgctaaagcttagttgattcaatctaaatattctttcagagaggtcttcctaattgtaatgacatggtataaatataagaagaaagaatgtcaattatcacttcgtataataacagtgttagtgttcatgcacataaattacaagtaagtttacctatttaaaagcaagaaaagtgctcagttttgcaatttaaaactttcgaatatgccacattttaaaattatgtcattacaaccagtagaagttagtaatcaccactaaagtgcatgttcttgaatagttgatgaactactcatagtgaaattctttaaaatatcatttgaaagggtaggatttaaaggcacctatgttatatttattttcaaacacttcagactcatccaacatgctttgaatatctgttatgtagctagtatcatgaaaacttctagaactgcactgtctcatatggcagctactaatcacacatggcaatttaaattcaaattttcagttcctcagtctcactaaccacatttcaaatgctcagtaaccagatgtggctagtggctacatttccatcatttcagaaagttctattggaagacattgctctaaagaaaagaaattaatatgacccataatgatcactctatttgtagcatcaggaatgactggaatctgtctaggattccagtcattggagcagatgtcctcacccacattgatgaaaacacttcagtgccctcgttcccaataggtaatgatcctaagtcaaattatggccactagattaaagatgaggccttatccttgtcagtatcttatctgtttgagctagttgtatattttcttattttgttctaaacccattgtaatgtagttttacaaaatgacattttgaaagcaaacaacttcaaagtattagcttaaccccgaactcatcctgtatattctaatctactggcttaagttcccctgtctataaaagtaataactcagcagctttggcggagttccttcatcccttcagtggattcaggatttcaagagtctgagtaggagcttatcataaagtgtctgacagtgcatacatcagaagggtttattggataaagatgcaatctgagtccatctgctccagatattttatcactttctcattcttttgcagatcacctacaaagcagtcagttcctttgacccagaaatagatttatccaatcagagtggaagagtttcaaagctgggaaatgaaacccattttctgttttttggactgtatccggggaccacatactcctttaccatccgagctagcacagctaagggttttgggcctccagcaacaaaccagttcaccaccaaaatatcaggtactctacattcgtgagttgtgtcttttatcagaagtaacatttttgtccgttttcattcccattgtcaagtatgccaagctcgcccacactaacattgtatccaaaggaatactcctggatgcctgaagctcagactcacagctttaaatgaagtactacaaatatttctcatttgggagcttaagatcctcacatgttaggaagtggctattgttttagcagggcgtcttggaggacttgggcatgaggcagaaggttctgttgagacactctcatccccttgtcaatcccaagttgccagagcagtactgttggaaaaatctctgtaatgaaccatgaaccatcgggagctctgcagaaagacagtcatatagagtctgcttcctgaaggatcagcctccttgggatctctaccataagaaacttctgtcctgaagagagaggcaaatacatgagggtaccaggaactgagggcctccagctttttgcttttagagacttaattatgccatctaacaaaagacgtaatttgagaaatatttctaggcatgttcaactgtgcagaaaatgtctttgtacttcagactagaggaaattaagctgccatctggtatgggatatacaacagcaataaaaaaattgcatgaatattttttcccattttttcccctttgggtatgagtgtggaagtgttgagttttggctttaactattttgtttggggtggagcaggtggggtggaagtagggaaaggagctaactcttgttatcagccatggttaggtcaataatatttagcctgacctttatatcttttatctctcattccttgttttgtattaataaaagttatcatttggagttgaaggaaaggaatattcacaactagagtattgtaagtgtttggctaggttttgagggagggtttagaattttctttttaagcaattataacaagggataattttttattgtgtaatattttatgagcacaaacttgacttgaaatttaatacacttgatattctgtgtatagaattaggttatagaaacagtatggagagttgagaaagagaaaataagtctttgggaagttagaataattagagattagaaaactgacacagattgaagaaaatgggttggtagaagaaagaccactggacttggaatcaaaaaatctaggttctagttatgattttgccaggcacttcctctctgattttgatcaaataaatttactcctacatacaaattaagataatattatctagcgcatgaatttatcatggggatttaaagatgaaataagtgccaatatatatacctcgaagcatgttttaagaaatttttcccatgtaagttacactacaaagattattgtcataatgagtgtattttttgaataaaataattcatttttgctatttttattagataagaattctgatcaacatggccgtattagtccgttctcacactgctaataaagacatacccgagactgggtaacttataaagaaaagaggtttaatttactcacagttcagcatggctgaggagacctcaggaaacacaatcatggtagattctaatcaatggttttgaccactttcagcatgccaagttcaaataattttattgaaaatcaagcaacctgacattttcattagcctatatggctcatcaagaataagtatttgatttttatagtcttaaaacagttacagtttacaggtcctgttttcaattttcatggacctaagagagggaaccactcttgttaattctatgttatgaattggagttaatttttaagagaattgaaataaattttaatgctgagatcattcaataaatggaactcagaagtaacccatatctgttataaacaaatctttttgtatatgtaagacaattttaaaaactgtatttgcaagaaaacgacctctagctttctcatcaggagtctctaccagtgggctgtgaaaatatggtatgccctcccacatcacagctccgtgtaatgatttgtcttgtccgtaattactgaagacctctgttgctatcataataagacttaacagtctagagaaggaagatgctggaaactggccttagaaataggatttacattgggaggagaactaacatttgtagaattatatttgcctgtctctctgttctctctttgaattacgataataaacgtagagggtagttccccccattttgagatgtatagaagctcttatgctaattaaaacaaaacacagcaaaaagtcaaacccaagcctttcttatttcagttcctatgtgttttccactgtcatgcttttctgagagcccacagattgtcactaattaattccaacaaatctctctgactcccactgtcctctttaaatccccaatgagtctggtacatgaaaaaccttgatttagatggaataactataaagtccaatgattatttcctaaatatgcctttagcataaacagtttatttgagaattcatatgtacagaaaagtgtaccaattgtaagtgtacagctcggtgatttttcacaagctatgctcatttagccagaatccaaatcaagaaacagaatattactcacaccttagaagccccctcataccatctcccaacttcaactcaagatcacagaggacagtatgggctgcttttagcagctgtccctgtgattctatgtagggaatatatgtgaagcttgctcgtggttgttgatagctgcaatgtaaagtaaatgcactgtgttcttaatgctctttgtaaaagaaagtggaaactaaactgagaagataaaccagaaataatgagtctcccattctacgcctttttccccagcaccctctatgccagcttatgaacttgagacacctttgaatcaaactgacaataccgtgacagtcatgctgaaacctgcccacagcagaggagcacctgtcaggtatggaacagagggttgggccggctctagatagaagaaaactaaatcaagttgattaattcctccaatgtgttttctagggatttgctgcaaatctcagccagcatgtaaatccatatgtttattagctctaattaaaagtaatgactgaggaaaatgaaagggctttgatgtaaggtgatcaagtattgtttaaagggttttattctgatgcaagtgagttgttcttttgaagataaggaacaaagcactagtctgttgaggaggtagttttaaattaaaaggtgactgcttgatgcaatttggttacccaagggcagatgacatttttgttctcagctctgttctttgaatggatgtttcgattttttcatttgtgtgtttactttgggttttatgtcatttattttttagtaaattggctaatttctcaataaaatatgagatgtatagttttttgaaaaaataacagattattggaaagaacattgtgaagtctttatctgaacagattagagttaattaccaacatctaggcccgcatcttattccatgatgatttatatagctaagcaattataaagtataacttgtatagtgactgaataaaataaattgattatttccacgacagagcaaaggatgcctgaatagctctggagtatcaacttgtcataaactcattaatctacataagtgaaatttctacttgattcagagggatttaaatgttttacctttgtattttggaatagtttcccttcagagtcatctattactttgaatagagtacttggaagaaagatttacattgacaattaaggcattatagggtttattttcatgtttcttttgtagaatttgatttcattaatgttttgacacctggctatatttgatcatgttttcactgcagtatcataaggcaatcagttagatttctttctattcagtaaaatatatatggaggtttcggttcataaagtcataagtaaaaccagaatagtattagtttttagtgaagtcagattagggaagagtcacagaaatttttatttgaaaaatctccaaaatgtttaaaacaatttttagtttatactgtagaataatgcaacacagtagctcatatgaggtttcatgcttgctgttcatagatgcagtttgtgagaatactatgaaatatataaaatctctattccaaattggagatagtgttactgctacctttcgagtgatgtgcttgacactccccaggccctctgggttgattcctgtgggtggcactgagaggttgcactaatccaatggacccaaggcacgcattagatgctatccaagactcaagtgtacccatgaccatggctcagtcttttttgactttaaaagctgaaatttattaaatgaaaatgtatgctctgaccatggccttgggagtgtcatttgtttctgacccacttaacagttgctcagactcagcaataaagggtcattgggacaggactcaatattttactgcaaagcatcatgatcatgtgaatagttagagttcactcagattcaatgcctccaaactgaaggaagctgaaagcttaatcatttttcaaaaacagccagttatcccatggtactttgttcttatatggataccttttgcacattttctatacttgtatcttactttcaaaccctttcagttggattttcattcgcatctttgtatagatctttccaagaccaagttttgttggtttgtttgtttttgagatggagtctcactctggtcgcccaggctggaatgcagtggccttatctcagctcactgcagcctctgcctcccaggttcaagcgatttcttctatctcagcctcccaagtagctgggattacagacgtgctactgcacccagctaatttttgtatttttagtagagacagggtttcatcatgttgaccaggctcgtcttgaactcctgacctcaggtgatctgcccatcttggcctcccaaagtgcagggattacaggtgtgagccaccatgcctggccaagactaaattttaaaataattgctctttgcgcaatatacctgcacccctttcccagtcctcttccctagtctttacaaggtgccaggcacactccaaactactgttcctatttctagcatatgcctcactaagacattattttgttgttgcttacttttacacatgtctagttgtttttcggagactttgggaccttactggtagttcttggtgtcctcaggcttcctattcttacatctataaaaatacagatccaaatgcttgtcagagtccaaaatacataactttcactgcagaccttacatcatttcatcactttgtattgcctcaccctcttttacagttgtcataacatcccggtttccaagttcaacactgctgtgcttttaggaagggtcatgtcagtattggtgaatatgctccttgaatttgccaggggcactttgcatccagtctctaataccttcttcccctgttagcatcttgaaattaataaatatatccatgttcattattcacatctgtaattttagaatcatgatcaatccttaaggggcatcattcagtaagcattatggggaaacctgctatagacatcatctttattggaaggatgcctatcttaaatgggtaaatcgtgttggcacaaatttgagagaggaaattatttcaacctcacctgtcgaaaagatttttttttttttttttgcagaaaagtgaatgttgtcttcaagggattcattatataggacaacataattggactgattatctgtagaatagatggaagaccaatatagcgagaaagactaggttggggaaaaaaatgtgtatagtaccctctaactaaatagggcatattaaaattctcaatttcatgtaatgtttagacaaataagaactctgattatggaatcgtatggacctaaatataaagccataatgtaaattaaaacatttgaacacatctggaaatctgcaaaatgcacatgtaatcaaactgcagtacaagaaagcttttcccaaatgataagataaatactagaaggaggagggaaatggaagcgaacatctgtttgctttcctggattttgcacagtattgtgtgttcaaaaatactgtcattgtgtgatttccaaaacccatttttttcaattgatttgattttttttttaatccgtattcattgatgttgaaaattcagtcgaatttcgtttatgcacttcactaagtaaggtggtcatgtattgatttccctacaaacactcagcttggttcatgtagattcttgaaattgcactaaactctcaatgtaaatgattgttgtctttttattgatcaacacatcagctctgtcacataaaattatttaaatcctgagatggccaagaagaacacaattccatcattccagccagtaaactagcatgtaggagagaattttaatgtctgttcatggattcaaagttttttcattaataagatatggaaaagtgtaactttctttcatttatttatgtatttattctttttttgagacaggttctcactctattgcccaggctagagtatagtggtgcaattgtagctcactgcagtcttgaccttctgaggctgaagcgatccccctgcctcagcctccagagtaggtattagagacaggatgcacagtgcccctggcaaattcaaggagcatattcaccaatactgacatgacccttcctaaaagcacagcagtgttcaatttggaaagcagggcacctcaaatgtggaactgaagccagagagagattattattgctaatgaaagtctgtcccagcactttgggaggcaaaggtggaaggatcacttgaggccaggagtttgagaccaccctgggcaatgtagcaagaccctgtctctacaaaaaagaaaattaaaaaacaaaaacaaacaaacaaaaaacatagcggagcatgggtatgtgcctgcagtcccaacctaggcatggttgtgtgtgcctatactcaggaggctgaggctggaggattgcttgaacacaggagttcaagatcagcctggacaacatagagaggcccaacatagaccctctaccaaaaaaattttttttaagaaagacaggagataatcatgcatttttgttttaaaacgtttctcagaaattatggttgttggcatacaaatggttatggtttagtagttcaaggttatgaagcataaagcatgtttttttttttctcaagcagcagcaacccatttgtttatctcactgtccgtaagtccaaggaaagagatgttcagtccattaacactaccttcctagacatcctattctcttctccacgctaggagcctttgagcatgccaacctcatggggttcttgtgaagactaaatgaggtgatattatttaacacttcaaaccatgctttgcacatactcagcaccatgtaagtgtttactcttgccttagcagtagttctcattacacgtttctattcataagaccagccctggtcctccagcatttccttttttcgtctcattttattcaaatctgatatcatgaaaaatctaattttacatgaaaaatataattatttcctctatcaacagaatcataaatagaattcatataaattcagatttctctgatgaatcttaagtttgattgcaaggagctaccagtttatttgtgcatttgcaagttttcaggaattgatcttataaataattagcaaactcccctgaccccaaatctatataataactcagaaaaaaaaatggatgtgtttccctattgatccctgaatcattatgtgattgtggttattatcagcttaactgaataaacttagccataaaacaagcaaaacggtcttctgtttataaccactctaaaaggaaataaacacttggcaacatagtaaatttcacaatgtgccatgggtatgaagaaccagtgagatgtattacttacgtaacttaacaaagcctaatgttctagtcaccctttaagtatatgaatctctttccactttattaaaaaaagatatttgtgatttacatgccattttataataattcagtccttataattatgttagaattcactccccagattccagaatttgttcttttaatcagaataggtttgttcaagagtttgatcctggcttagaggagccagctaaattctattatttattcaaaaaagtttatccctttatagtattttcctgctggaatgacaatattattttgagaaacaaaaaacttatagtgtaaaaccttgcaatgcaaagtttaccttaagatataaatattctggccaggtgcagtggcccatgactgtaatcctaacacttcgggaggccaaggtgggaggattgtttgagctcaggaagtcaaggcagcagtgagctgtgattatgcactccaacttgggcagctgagccagaccctgtctcaaaaaaaaaaaagatataaatgttttgtaatataaattttaaagtggctttattttaacttagcctattataaatcaatataggggctagacacggtggttcaaacctgtaatcccagcactttgggaggccaaggttggaggattgcttgagcctgggagtgcaagaccagcctgggcaacaaattgagaccctatctcaattataattaaattttaaaaatttaaaacaaaatataaataaaataaatcaatatatggtttccagatctaaataatgcttactctaaattaattagaaactactgaatccattaataattaatacaactattgcccctaagatacaagatcatatcaagtgtcgcacatagccttttagacagaatttttcattcttcctttggcaaatgttaaggaggaaacttctaatattcaaataatcactcactttatatatcacataaattatgggcctaatttttaaaacgagtgcatgacatagagaaggacacattttgaaattagataagcatagtttcaaatccaggctctctccacttgtagttacgccactgttaaaaattccatcttaaggtctctgagcctgggcttgcctgtctttccacagcaaggataataccccttatatcttacagctgtgctaggattggatttgttaaatactcatgaggttcaagcacaaggtggtgctaagcattggggatatggaggaggctgctaagggctctcttctccaggggctggcaatgtagattggaaagagagcaacatggaatctagtgtcctgtagtaagtagggatgaggatgggaaccagtggcctgaccagggagtggtcagtacagggaagagtcagctaagacttcagagaggaggtaaccctggggccaagtagctgaatcttgacagacggctgttgttcagagcatctgtgtgatgtggagtatgttgccagggaggttagatatgtggcaaggaataaaaaaatgagagagacaggttggctccatgaagacagggaggactgagtttggcctgatctgagaatgagaagtgtgttataatcagagagaggggtgggatgggagaagaagcaagggagatagaggatgaattggacaaccttgtactccataccaataagtagccattcaagggattcaggtcagggaaaaaatgtaaggaagagctgcagcagcaatggaggatgggttagagggcgtgcggcctcagaacaaactaataggagcggcataaaggctggaggatgtgctgggcccagttaagatagagctaaccctggcggcatggaggaagggggtttcataaatgccagatgctgattttcattagaaataggatttagagaaatcaaaaacacttagtcctttttagaaggaaaaaaagagaatatattgatgttaaaaatactgtctggggtattgttaaagtgaatactagaacgcttgaaattgaaaaactagcctagcaatgactttccaataattcattggaaatcactaattatataaatatttttaaaccccaattttcataagcagtaaaaagttgttcttagtgtctcttgtttggaagaaccttctggatctttcttttgttgcttctcctaccttccttatattgcaccttaacccctttgctgtgggcctgtgtccatcaattttgtgacaatgactgtacgtgttgaggtgttaccatgatgcctactcagtggatgtgggtggcacctctggttactaaaagctagagtgtgaaatgcttctctcggcttcagaaggcatgccagcagcacacttagtgggtgattgtggctcattcttggctagggccggggaagacctaagttttttatcatactgctttgctatccccaaaagaacccatgcctgtccctgaaaaggcaaatatttgagttggaactacagactccatgaaagctctcgaatgtccttcacagtggaggccacaccttgcacattcgtggaggcgagagccaggttgtgttatgcgttcccctcttattgaccagctgcacagaagccattcggcaggaaggagggagacattaaagtctacttcattttccattgaccgtagagaaagttacatgctgtttcttttccctcatctagatagaccgtctttaaatgttaatagtggaataaattagaaatagtttcaattataaactcagagcactaaaagattgcaaatgcctgcactgaacaatatattactttacgaattgtaaagctgctctgccatttgctctcgggaacccttgggtcttcttaatcacagttattgatttagggagtttaagggatgaacttctagaggtgttccaagctagggctgatagcctttcttggagaggatcttggacattttgagaaagattaactgatttgactatagatgcctcactttcacatatgtgaaatgtgaggaaaggttgcaaattccaagagactgataaagtcatgtgtgatcactaagccggtatgcttcttagagccctagacttttagaactgaggacgaccaactcagaagtcctgaccacattcctcatgttacatttctgcttcatcctattttggtggtggggagaggaatgagggcacagatacagaaggaattatgttttacatcattctcttcagcagggcattttatcaaccagcacttataagtatactcaatgtaactatttattataagaacaccagtgtacacaaaagtgctaatatgccttctatttccttaataactattttttaagtatattatattatgcttgtgaggcttacctgtatttcattgcaacttaattaaattaatattcagctcttcaatcagacagtagaaagattagggagtggttttggtgttttttcccatataattatgtcccttttgacatgtatgtatggcccagttccatctcatctctacttctacctgctaagtgttttcctgtcctgtatcaatgtattttccactcaatgagaagtagtaagagctctgtccagttattagtacctggttaaaatcctggcccttcatagcattgaaaagtgttgtaggaaatgttaggattgacacttggctactgttcagttattcttcattcattcaccagatatctactgaacacttattgtcttcatgtcattgtgctagggttgtgataaaagctgtctagaaaagtacagggtactctaagagtatgtgacagaaggatgaaatctcaacaggagaatcaggagtgtcttactgagaatgtgttacttaaactgaaacctgaggaggaggtaggtagataggttcaccaagtaggagagcaatcagtagaaaagcctaagataagagaagttaaagagacctaaacagtggtcatcctagtcaacaaaattaaaaacacacaaggtttgaccatcactcaggagcattaattagatttacatgcagttgtgcagagcataaggacatttcattcaacagactgcgtatacagcagtggtcctgaaatattataatactgtcttttcattgcaccttttctacatttagctttaggtttacagatactccccactgttttacagttgcctacagtattcagtagagtcacataccatatagctctgtagcctagcagcaataggctctaccatacagcctaggggtgtagtaggctgtaccatctagggttttgtaagtgcaccgtatgatgtttgcacaaagatggaatggcctaatgaggcacttctcagaatatatccccatcattaagtgactcatgaccatatttaatgttgagagtgagcatttccctaggctaaacattatgtaaaacatataaaaatataatcagaaatgcaaaatcatttgatcacaaaatgattttaataatttagtttttgaatatcatgcaatacctctaacctaattaagagtgcaataaatgtttattgaatgaacctcatctttttcttgccagcagtaataattatcacctgaaacatttattacagataagaagaccctagaccttcatttaactagtgggacataccaggaacaagtggagttttaaattatattttcatccctaaataaaagttaaatatcatgaaccttccatagaatgcagagctataaaagaacaccctgcctttacctttgaagcaatcttttttttttaataagaagagtaattgagaaagattgcttcaaataagccattgctataaattcagatccaatcaggaaggtcactccaatttgcaggcttatactgactcctgcaaaaacttgtcttctcacctcttgaggacagtgatgacaccccctcccctccttttcgctttaccttccatcccccacaatcactgtcttagttcatatttgtctttctcaggtctccaatccccattcaccctgtggctgcagggtctttcctcccagcttaataacccatcagtgtctccctattgccttcagcataaatccagacttcctctaatggggaagcctctggcttctactcacttcctggggcagcctcccttccacctgtaaatatttgcctgagaatatcctgggtggttccatgccattttgtgggtttattttgcagctgatgtttctttcatggaatcttctctcttttatcttccctctgtcctgcctgcacacacacacacagtctctccacagtctctttctctctctctctctctctttctctctctctttctctcacttatttccactcccctcctagctatggcccagatgtcacctccttggagagcccaccctggccccctgcccatctgtgtcctgcagctctcccagagagctcagccctagattcattcactgcactggctggtgaccgcttgtcctggccacctactagctccttcagggccaggcctgtcctctgattttacttctgtatttccaatcctggttctatgccagacacaggcttccatgagtatttgtttatttgttttgtttttattatttgtttctcatttttttaaactgtagaagaatttttactgaggcaaaaactatgactgggtttgcatattagatcaaccactggggccgggacattggggaagtaaacaggccaatgtgtcttccggatggaaaattaacagattaccgtggatggatgcatcaaaactgtcttttgccaaacacaaagattttgaatggagcaggctgtgctcaggggttccacctcccagttcccaccaaatgactgaagtttcatttggtagtataagtgacatctaatctctctgatgtaaacaattcatacaagttaatagtttagaaaggtagtatcacaaattaagagaacacgtggcacagacacaagaagacttgggtttgaatctcggctgggacatttactaattgtgtgacctgaagtcaccctgtgtgtgaggctcttcttgcattgctataaagatacccgagactcggtaatttataaagaaaagaggtttaattggctcagcattctgcaggctttacaggaagcatggtgttggcatctgcttggctgctggggaggcctcagaagcctccaatattccacttaagaccatggcggaagacaaagaggaagaaggcatgtcacatggtgaaagcaggagcaaggcagagagtgaggagggagatgccacacacttgtgtgtgtgtgtgtgtgtatgtgtggaaacggagtcttactctgtcacccaggctggagggcagtggcgtgatctcggctcactgcaacctctgcctccccggttcaagcagttcttcttctgcctcagcctcctgagtatctgggattataggcgcctaccaccatgcctggctaattttgtatttttagtagagacggggttttgctatgttggccaagctggttgtgaactcctgacctcaagtgatctacccaccttggcgtcccaaagtgctgagattacaggtgtgagccgccactcccagccagatgccacacgtttttaagagaccaaatctcgtgcaaactcagagtgagatatcacttatccccaaggagatggcccaagccactcatgaaggatctgctcccatgaccaaacatctctcacctggccccacctccagttcccaattgggaattacattcagtatgagatttgggcagggacaaatatccaaactatggcaccctgtaaattctctaagtctgttccttcatttgtaaaattcgcatcaagtatactacttgcctgtctcacagcctggtcagaaggattatgatcagtgaaaattatttgcaaaccgaattgctcaaagagaataaagctatgatatcatgatttgcttaaaaaatgttgactagattgctattcagtctttatgcccattatactccgcttttagtaatacacttaaaatttcctatcattactgccttttatcttctatgctgatattctgtggttatcacctatataggaactatgttttaacagtcactgatatttgacaatacttctatagaagttgtaagaaatatgtgtgtttggtattaatattgtgcattcatttggtaaaatcatcaatgttttagatctcttgttccatcaaaacatcccagcaataagagaaggcattgttggtaggactgtttatagataacagctcattccagggagtaaaagtgcaatgttgttaagaagcataaagaatgcaaccatagcatggagcttgatgcttctgggtttaaattcttatttgccaagatttatgtccacctcaaaggtaataataatatctacctcaaaggacagctgggagaattagtgacctgtaagcaaagcagtcaggacagcatcaaacacagatgttatctgttcagtacaggaagccttttcttattgttgatttctatagtgatagaaacaacttatagataacatggtagccccttttattctgcctatgtcttgggaaattttctgggtcctagcattgtattcctgagcctcagttatgttcttcttagcagcttgtgatagataaataataattacagcaatagaaaatgaataatcatggttacttggattgaggagctgtgatgtgccaagcccatgcttggtcccaaatgaaataatttatcatgattcagagcaggcttcctcgctagatgccagcatttccccattacagttgaaagcactgaggttcagggaggttaacagacttgtctactctaaccccaaagccatgagctttccgtgtaacacttaatcttgtgctcagagccacagggcacgtgagctgtcaggaccttgcctcctcctgggagctgtgctcattctcttgtcccccactttgcttgatcagaagacatctttcctcctgacccttcagaaccaagatggttacacctccctttgcagacgtggactattctgcaaattaatatcctttatttattgtcttttctagtacaggcatatcttggagttattgcaggctcagttccagatcactgcaataaagtgaatatcacaataaagcaagtcacacacattttttgtttcctagtgcatagaaaagttatgtttatattatactgtagtctgttaagtgagcaatagcattatgtcttaaaaaatgtatctaccttaattaaaaaatacattattgctaaaagtactgatgatcatctgagccttcaatgaggcataatctttttgctagtggagggtctttcctcaatatggatggttgctgactaatcagggtggtagtttctgaaggtttgggtgactgtggcaatttcctaaaataagacaatgaaatttgccacatcagttgactttgcttttcgcaaaagatttctctatagcatgggatgctgttggatagcattttacccatagtagaacttctttcaaaattggagtcaatcctctcaaaccttgtcagtgcgttatcaactatgttaatataatattctaaatcatttgttgtcatttcaacagtggtcacagcatcttcatcacaagtagatttcatctcaagaaaccactttctttgcttacccataggaagcaactgctcatccgttcaagtgtgatcatgagattgcagcaattcagtcatgtcctcaggctccacttctaattctagttgttctttccaccacatctgaggtgacttcttccattgaagtgttgaacccctcaaagtcacccttgaggtttagaaacaacttcttccaagctcctgttaatattaatactttcacttcctcccatgaatcacaaatgttcttaatggcatctggaatagtgacccctttccattgactttgaccagacccattagaggaataattatatatggcagctatagcatcacaaaatctattccgtgtataataagacatgaaagttaaaatgactccttgacccatgggctgcaaaatggatgtcatgttagaagatatgaaaacagcattcatcccatgtacgtctccatcagagctcatgggtgatcaagtgcattgtcaaatgagcagtaatatttagaaaggaatcctttttttctgagaagtaggtctcaacagtgggcttaaaatattcagtaaaccatactgtaaatagatgtggtatcatccaggctttgttgttccatttgtagagcacaggcagagtaggtttagcatgattcttaagggccctaggatggtaaatgagcattggctttaacttaaacttgctagcagcatgagcccgtaacacaagagtcagcctgtcctttgacaccagacattgacttctcctcttcagctatgaaagtcctagatggcatctgcttccaatagaaggccatttcatctacattgaaaatctgtggtttagtgttgtcaccctcatcaatgactttagctagatcttctggataatgtgctacagcttctacatcagcacttgctgcttcgctttgtacttttatgttatgaagatggctacttttcttaaacctcatgaaccaacctctgctagcttcagacttttcttctgcagcttcctcacctccctcagccttcatagaattgaagaaagttagggtcttgctctgcactaggcttggtttaagggaatatcatggctggtttgatcttctatccagaccactcaagttagtttaatattctatccagaccactaacactttctccatatcagcaataaagccgtttcactttcctatcattcatgtgttcactggagtagcacttttaatttccttcaataacttttcctttgcatttacaacttggctgtttggtataagaggcctagctttcgaactgtcttggcttttgacatgccttcctcactgtgcttaataatttccggcttttaatttaaggtgagaggcttgcaactcttcctttcacttgaatacttaaaggccattgtatggttatcatttgttctaatttcaatattgtgtgtcttagggagtagggaggcccagtgccagggagagagatggctgtcttatatggacacagttcatagcaccccaaaacaattacaagagtaacatcaaagatcactcatcacagatcaccataacggttgtaataataatgaaaaagtttgaaatgttgcaggaattaccaaaatggcacagagacatgaagtaagtgcatgctgtaagataaatggcactgacagacttgctgaagggagggttgccacaaaccttcaatttgtaaaactttagttcagtatctgtgaagcccaataatgtgaagtgccttattaagctgggtacgcctttattaagaaaatacgttacacctttgtttctatattatgatcattggaatctctggggtttatccctactgcttgcttaattcttaaatgcaatacttttgtattcttcattatttccttgttattatttttaagctgaaacattttggggttttgtttgttcgttttgttatgttttagtgggggaatcttgctccattgtccaggctggagtgcagtagcatgatcatagctcactgcagcctcaaattccttggctcaagcgatcctcccacctcagtctcctgagtagctgggacttagaggtggtgtgccaccacacgcagctgatttttttttattttctatagagcagggtctcactatcttgcacaagttggtctcaaactcctgggcccaagcagtcctcccaccttggcttcccaaagtgctagaactacaggcatgaggtaccacacccagcccttgttaattgtttagccatataattttgagaacttgaagaacttaaacgaaattgttttagaatattggattattttaatcaaattaatcagtgtttttctgctggtatgtatgttctttttcctttcaccatttttattagtctccaaagaatcaataaattaaggatcagtgcttttgaggtacttataagtggctttttaattgttccctttttatttattggagaaatgcagactgcaggagcatcttaaaccttcagggctaaatgcacttttgtcacagttttcaaaccttttgaaaaggctctatctgtggctaaaattgtttagggaaagcaactgacttctaataattttcctttattcattgaggtacacataggatcaaaatgtcattgagtggtaaaacttcagcctgctttttatagaatttgtttttattattacttactgttgctgaatcgctacagtgagtgttagcaaaaggtgccagatcccttactatcaccaccaccactacccccaccccacctgcttttaagtgagttttattgtattaaaaaataatactctggattcctttactgccagaaaacaaagatcatttttattaatgttgcttctaggatgacaatgtcagtcatctctttgaaaattcattttggaaactaagtttgttctttaagaacctttgaaaagaagctttaaaaatggcagaggaagataataataatagagtagatgtatttgagcttttatacaatgaaacttaatttaactttccctcaaactccatttcagacttgcttttgtgcatgaaaatatgctgcctagccttccctcccctacttttcacattttcttttcttcaaagtaatctcttctgaaggattctctgcatgggatcagacctccattctcattcccaggcccccagtgctgagggcggcaagcccagggcgcctgtgggagggtgtacagggaggctgctatagacagggaaggtcaggaatggctctcagagccaaattccactgccagtcaccccccagaaaaaccaacaaaatacttacgtaatattttgatataactttaaggattaaaatggatatccagtgaagtactgaaaacaaaaaattatggcctttgtagcctaaggagtgattatagactcgacagagagtagttccaagtttgcctgacagtgatttggaaagagagaggagaacaaagacgaagaccatgcatgccttcaagcttctttcccggcccaccctcaggtacctccttcttcatccttacctcaggccttgtgggcgcctagaggagtcaagactaggaagcctggttttcatgctctgcaggacaggaattgaatgaggaagaccctgccattcttgtgtagctcttggggccactctggggactcctgggggcatacctgctgggacctgggcagtatgtgaggtaggacccagctcattgtcttccatcttctgtgctgatgaagggtactcacaagcaattggagtgaatggagactgtattgggatctgttaataaacatgttggcttttttttttgttgctgttgtgttatctttaattcagggagaatgttggtgactgtagcattgcaggagcagttttagggtgagaacatttgggcacttggttcaggtcagatgccctcaatgtagtagatgctagaagagattttaacgtagagattgacacatccctgggtcctgttactttgtcctttgtacaaacccttatcagatccttggcatggtagttcttcattggtgtgatgtatttctgacactcttagcctgtgcttttcaaggacggggcagtctgtgcctaattcctctttttattcttcccctgtgcctggaacaaggcctgatacgtggtgaatattgtggaaagaaaggatggaggaaacatgaatgaaataattttcttctcatttgctgatgtcacaacttgcctgatcttgtgctgagagtcataaaatattagcgcctgaagggctttagtggtcagttggtgattcaggagcaaagcaggagccagtcacctgtggacggtgattcccaagtcaatgctctctcatcagcacccccttgggcacagctgcctttctctgatagttgcatttgtattccagcccatctggcccaaagcactggaacttttcgggactgaaagattttgaattggataaaatacaaactataaaatatcattcagacaaacatacaggaacaaagctatttggtgtggctttgatagtattctctttctatttttattcaaatcattaggactatttaagagaacatacttttcataatagtaactaattttggattatactttcataatcatgtgtttatgaaattgagatgattaaattgtgttaaatttatatgaaataggaaatgcaaaggaaattgtcttcacttgttaaaagcaggagacatcacccttaaagatgttccatctaggactaatttactcgaaatgtggtgcctgttgtgaagattaatgataggtggccttttacagagcttctcagcctgagcctaatgttctagttgttctttttattatcccaaacctccataactaaagaatttttttcaccctgccctttgttcataatatgggatggtaattgagttcatatttctcacccaacctttcatctgtaattaatattttattatatcagattttatcactaactagcagagcagcagggtattgaaccgagtatgggagcatgtgcacagacacacacccacagagcaatagtaacttactgatgccaggcaagctccttgttatgagttacggctgagagaacataaaaaatgcttgtggtgccccacaaatattccacagcaatttctggccagtcttgtctatatcagagcaggacaaagagaaattaaagttgctaatatagaatattcagccccacaggtctatttatcctgtgtgatgtgttacccattgccaattgtctgtataaaactaattaccatttatcattgataatttaatcaacaggtgtgtgtccagtcagttactctcagtgttacctgaaggactctaaggaatctgagcagtaataacaaacactgaattctgatttttttccagtaattgtaatttggtgacatattttttaaaactgagtttagttttatcaggttgtttagagtattagggtgtcatttcagtaaatgctgacagatttaggaaaagacaatgtcagagcaaagaacaagaggtaaataaattcagtgtggctgcatggcattaacccttagttacacatttatttttcatgctttgcatgtaattaatattttcattttctttcatctccccccatattaatcttcaggaagctatcaatactaatatctattctttttatacatatataatggatggtttttaccaaaaattacaaatcaagccaaaagtcactactagatatgataaaatgaacaatattctaagtccctgaaatgatcagaagtgcctgttttagaggattagcaaaaacaacaatgaaagcgttacaacttttctccttctctgttctcttccttacctccctaccttctattatccaattggtaaccctctgatatcttatggtgaaaagaaatacgataaatggataacaaaaatggatttacaactcatcttgaaatgaattaggacaaaacattttaagttaatttcacatatgtatgaggcttcctctccaggaactcgaaagttaggaaaaaactaaaaacattttatcacatttgaactttcaagtctaaaaaagtagatgaaagatgttcagatgttcttttctagattatacttcatgtgctattccatataaatgcagatttttcattctccttgtaaaggccttagaattttgttgtagaaatgcctagcataaattaaactttaaattaaatttccttccataggaaagttctgatataatgatgtcacagtgttggcagattcatcctcactgtggattgtgcttttaatatcgcacatgcagtaggaagatttgatgttactttaaattccagaataatggtaggacagggctagggtggtgcaactttaataaacaaaggcagcatgggcaactcattaaaaggataatagaatttaaattcagctcactaagctagaaatttctgatcagttttctattctcagaaatttgctttttaaaactctttctagaaacaccattccaacagtgagattttcaaagctagttttgagattatgattgtggatggaaaaattttatgaaactcattagtgaagtgatgttacttgtacagatgaaaaacacatcagctataaagttctgtcaaggtactattgacctaggtgctaataatgtgttaatttccatcagggaaacagcaaattatggcaattgggcagcagataggatttagctatttttcattagcacttgggctttgataaaggggactagaaaagagctgcttgacctttcagtgcttaaattattaaagagcaaatagatttgaggtctggatgcttgaaaatctaatttgtcttgtggagcaaggatgaaaagacattttgggtttgaaattgctccagtcaacttagttctttctttaatatatctgaagatgagtggatagtagccatttaaaaagcagtatgtctggagtagagtgtataatagaacccatgccaactggctaacatggaggcctgtccaatgattgtttaattcttaaattttcacctaatcctcattaaactactgcttgaaacaaatgatttttttcatgtttgcttagatgatatttatattacaaaacaaaattttgtatcattagagaatgtcaaacattgtgttgtttaaggcaaactagagcagtgcctgacacctattaggcactcaaaaaaatttgttgaaataataaatcagtgtacacactcacccatcacacctacgagccaggttaggagagaggaatgggaagtgagagatggaggtgtggggggcacatagagacacagcgtttgattcccttaggttcattatttaattgtgggttatccaggataaactaaaacataactagcatcctcttaccataaaaccttttccttggtcattgctttctctttggctcttgagtatttgggtaatgaatacaaaataaacttcacattaaattttaataaggcaaagcatcgttgtgactatcggtgtgcttcctccctcctggtacatagaatgtgtaatatacccccaaaccaaatagaagcaacttcaggattatagcatgctttcagaaatatgtacttcacagccgaagtgtcacgagacacaacagtgactaaacctttgcccttcttcttcagaagcttgtaggacttttgaaaatagtgataaaaggacacaaaatgactatgtgctcacagaaaacatgtttttgtgcatttggagcagagcaagagaacatgaaaatgagggaacagactataagcccttgagagagactcattgagggtctgtgttttaggacacagggcatctgagagtgacctagagttcattgccttgaggagaactacatttaagtggcaaacttgagtccaggccagggtgaaggaaaagaggcaaagatgtttgcagtaggagaatctaggatcttgggacatggaaagtctaggagcagctgtgctgcttttttgtctagctgggttgtaacaggagggagctccttgcaggttgagagaggtgggaagatcacagtgctccgaggacaccagcccggtgctaaagtcactgtggagcccaggagaacgtcctccctgaaagtaattaatgattcagatatagaattgaggaatgattctgtacataccttgattcctcattccagtgaatgattcctcaatcattcattgaggaatgattcagatacagaaggaattgaggtcaaagccaacattatcgtctataactcccttgatgtgataagtgtgaatctttacaatactcaaaagaagttgactgtggaaagtcagtggagactagcttatgtgttggttgtgtctacaggagcaagtgaaaattcccttcaggccagatggtttccatcagtgccttcactggacctgtgaatgaggaatgccagcacagcctggtctgatgattaggagaactggctctgctgtcagaccacctctgccacttctgtagaataccctggtagaatggcacttcacctctacacctcagttttcacattaggaaaatgggaaagataaactctgtgtgtgttgggcacctggcctagcacttccagtatggaatatctgcaacatttttttcttcacacatatccttattttcctgctttgtctagtatatggatttcccagaagttgtttttaagttgaagttttgaaaatcatgtcatacaggaaatgaactggaaaaacgatttgaaggaagtgatgttaaaaattattatattggccaggcgcagtggctcatgcctgtaatcccagaactttgggaggccgaggcgggcggatcacgatgtcaggagattgagatcctggctaacacggtgaaaccccgtctctactaaaaatacaaaaacaaaattagccgggtgtggtggcgggcgcctgtagttccagctacttgggaggctggggtgggagaatggcgtgaacccaggaggcagagcttgcagtgagccaagatcgtgccactgcactccagcctgggtgacagagggagactccatctcaaaaaaaaaaattattttattaaatggagaatcactttgcaaagaaaataattattcttacggtttctctattttgtgagatcagtccttgtaagttgaataaaaattctagatatatgaactccatgttagagattcacttaattctctcatttcgtaggagaaaaataaaactcaaataaattaattgaaatgcatttaaaacccaagcttttagcagaattagaattagagctcagaccagtgcattgtctttacccctccaaaagcgatttcaagagaatggtcacgcttccttaggcctgtttgtttttaatggtattccaggtgagacttctttcaccgctgtcaactgtggctgtgctacagaacaggtagtatttagtcttccactttgaccttgaccctttacctttactactgtatgaatgatccactaatgtggagcattttacgtgactcaatccgatagaaagtatctgctgtttaggaaataagagttgtactcctttttttaagtttacatcactggtaatattcactttatcattgccttataaacctgctggttacctgtctacagagaaatcagtctgatattctaaaacaattgatttttatttagacagaattaccaacgaaatggcagcacacattttgtttctgtaatagaaggtgctaagtggttgtgcccacagagataggtggttctatgagtgcagattcagaggtcacatagacgagagtgtagagacaaacctttctaggcattccccccatgggtggggatagcaggcagccctcttctgtgctttttccttggcattaatgggttcttgtactgggcagctcttggttcctgggaattctggtgcctttctgatactgtaagaaaaagatccctcttcctgccagaggacttaaaatctaatctggactcagttcagggaagctgttgtcaggctttagtttttctcagcatgagaaaggtttttttccaacaaaactgcaaacaacattcatcactctggcaaatgtattaaataaataccttaattttctaaaaatctatcagttcaaggtttctgccattctcctgaggttacttcagaattcaaagacattggaagaggatgagcgggtaccagagacctactccttagtggggctgtcatccttgcaggcgtcttcagagatacccagcccattcttatatgagattcgaggggccttgttcattagttagtcttactaatcacttggaactccaaggctttggcttttgaaactataatcccttatctctgcttttcttatgcatttctttccactgactgaatacggtgagtgcaaaggaacataagaaaacataggaagataaaccttagttaacatgaatcactacacattgtgttttgtgatttgttaaaactttacttgtgttgtcattaaagaaaataatgcattgctttttaaaataaacttacagttggtataatttaattgtatttatcaggtaaactgagttaattatctgtaaaatcatcgtcagttacatgtgagaaaaacattacttctgctcacataaacagtagagattatcatattaaaaatttaaaatgatggtgaattttgtttctctcactaaatagtgttgttttgggtgagagagttctgaagaagaactgaagaaccctccctgtctttcactgagcaagtgctgcatgagagtctgttatatatcaagcacttagtatggactgcgtccagtgtgttctttattttgcgtgtcctgtgggtccatgcagttgaaggcagagtggatcagttcagttatcataaaatatcattgatggtactcttgtttttctagtgtctatcaaatagttgttgaggaagaacgtcctcgaagaactaaaaagacgacagaaatcttaaagtgctacccagtgccaattcacttccagaatgcttctctgctgaactcacagtactactttgctgcagaatttcctgcagacagcctccaagctgcgcagccttttacaattggtgataataagacatataatggatactggaacactccccttctcccctataaaagctacagaatttatttccaagctgctagtagagccaatggggtaagttgtacagataactgtttacttaggctatttggggttgttaatgtgaacatagattaagtaaaatagtagtaaaatggaagtcatgcttttctgcatttctacttgtaaacaaatgtgattttcttctcttaaaattatttttgtctagagaaatttatggaaagaaacaaatatactcatcttttttttttttgattgggggagtttatcatcaacatgataggttttattttcagttttcctgttaccaaaagttggctggcaattctgcttagcttactattttacaggaagacagtatagctccaacacatacattcagctcatttaaaattttgtgagattcacagcatctgtcttttcagcatagtctgtcccattaaagaaatgggaactgaagaagttccacaagagtttctacttcctatactttgactaaatttggtatcttttttttttcctaagagaaaatagaaaaatgagacggaaacaaaataaaaagtgtcatttctgaatttgcttccccttcctgctcagaccaacccagaactctgataagattgtaaactctccttagacagaaggaaatgtttcgcagataccacagtgggtccctccttcgcagcataggtctaggtatcgtggtcaacttgacttttgccggtgtaaaggggggaaatctgagatgcatcatgcttctccaatactgtttgctcaggggcaaagtacagatctggtcctttactttacctccttactaaaggaggtccggggccaccaggcagagacattttatgtgtagctccttgctcatcacctggtctagaaatgcccagcactgcctgccactggagccagaaaatgtatctgagtatggttcaaagaataattgctgtgtgattaaagacacgctcagaacagtgagatccttccttatcagtgctatttaaatagaattacagatatttctatttgtcttaaagaaaacatgaataatgatttttccctctctttatttgacacaggaaaccaaaatagactgtgtccaagtggccacaaaaggtaggttgaaattgtgggatattctcctaattaatgttccttaaaagtttattttaacctatgtttcaaaactttttgaactggaacttaattgaaaataaaatgtgtgtattatatatacatatatatatatgcatgaatgcatgtatgtattaggatctgatggtaattaacattgactgactggaactcatatagatactttttaaaataagaagctatatttctgtgttccaagcagttttcaatagttacctttttcagattttttcaaatgactttaatttttatatgatctcagtacacgttttttaatccatagtgtcatgcctggtagtaccacatctagtgaatcttcatatgcaaaggaataaaatatcacccactatttttaagtagttctctagttataatagcagtagaaagtggagtctacgcgggcttttttcactggtggtgcgtgtctctctgaacctagtaaccaggttatgttgctgtggagcatctatttcccaagcctggttaaaactctctgagagaatgtgatagaggatgagctgcaaaagtgggtagggcgagttaccctgagctcccccagcatctcctgcagaagcaagtgcagacgtgtgtttgtgaacatgagctgtcatctggtcaacttgacagtgttgttttaaccgtcacatacagaaatgtataagaaatgctttgagaaatttaaaatgtcgtcttaaaatgaggcaatataaattaacactcaaagtcaaatacaatcatttagatcattggagtaaccatgaatacagtgggaagttctgtatgatttaatttagagacgatggtaaaaacacatcattaggtctgtagcagaagatttaatcaggtcatacttgatgagttgtgttggataaaataactttttgttgttgtttaactctcaggtgaacatagtttgaatataccatgatgtacatgtgcattttcaaaattctcactgaattcttattttgtgaacttacatgactcttttagtcagtgttagctcaacaaatatttcttggttgcatgttttgtgccaggcattgtgtgaggtactcacctcatttgtatcttgtttgtcctcataggcttgtagttctatatccaaaaatctatttatactaattttaaaacactcaatttttatatcatattgtacctaagtgactttatgtatagaaataaattgatatttactgaaattatagctgcttatgtgtttcataaactgccgtatgctatcagctattaattattacaggacgatgaagcccttgaaccaggtatccattgatgctcttagatctcaagattatggtccatactcaacaacaggaatttcaaaatactgctgtattacatttcacttacacttaaggtctgaaaaagtaaatcctgttccagggcccctagtttataatgcttaacgtttaacgtcacagctgaaagttttgaaatctctttcatgcgtgtgttctcatttatttcttcattactatgaaaagggaaacaggtactgctattcttatttttaagatgaggaaaaggtgtatttttggagacgaattgactcaccaaggtgactcagctgataatctgggggtcaaggcctgcactcctagccccagtgtttctttcaccattgctcatggctcgtcacccagcagcacctctggccagtgacagtattgtgtagtgtaagcatcagacctcctcttggtgaggattgagtcactgcccaatttactgtgaaaacaacaaaatatctgtcatcatgctcatttacatagttaaataattatataaataacacactagtaaatgtggaaacctgacaagtttgctgttttcacaatagattgaattagatagtgatttggatcattttcttccatcagctagatttcatcaatattgtaatttgtttttcaattcaccaaaggatgattaagcaatcagatgacctgattgactaaatattccccactcctattttctgagtcatttgcaaacatttacacagcaacaaactctatccaaagaacctcttttggggaaagagggacacattttaatatttcctgcataacattgtcattctgtttcataaaatcacagcacaagaggaaaccttggaagatattctccctccaggcaaaactacactgttttgtgctattttattaagttctacatggacggattcatcaaccctcctttcagcacagtgtaatgtttcaccaccttttagtcagaaaatgtgtccctattgatactagaaattctcttgcaacatgggaagccattccatcttgactacatagtcaaaacagagaaataggaagatctaataactgttgataccacagagtaaagatgtttaaaatgtagaagagttcaaacatcctgagtgtgtgttgccacatactgctcacagtgcgatggcttaattgagttttcagatacagaattgctttcctaagcaacattttgaatgtacaaagatttcaatgttctcctgaaacaactgttgacaagtatctttatagagaaagtatggaggtggatttgttttcactaagagctagcttataatttaaagtaagggtatgtctcttaaaaatatatttcatactatttataaatttaatgcagtgattattttaatcatattccaaagacatattttgacactcatcatcttaaatataaacttcataaaagttagacaggaaaaaacctaagctgtattattatatatctccatacgtgtgggggattgcctatatttttatgcatcctcttcgtttatgcacctagatgaatttcctataggtacaagttaactataggcaaactcatcacagaatattctctcttgagttaaaagataaagacaccataaaccagggtatacgtgatgtttatgtgttacctgcccaattcaagggattgtttttaattgtatagtggagtgaatagagtagcttttaaatatttcttaaaatctatgaaattgtatttttcattaacattcacatttttatagttggatttttttatgaccatttggtccaactgtgttttagtgattagtgtatgtgttttctttagcttttatattcaccatggtggtctcatggtaactagtagggtggaaactctttgcagctagttttagaaggcttcattgatgatcaattctaaacttgtagggtacactaaaaaatccaaatgtgttattagtaagttaatttcttatattgaatgaggtctattcattctaattgatgtaacaatcagtttaaagtatgcacattatattaatcttccataaaataagattttttcataatatgttagcaccgcatgtttgtccttggcagtatagccatttgggagctttcctgttgttcatttaaaaattatttgagtgcctccttgatttataaaagtgctttggggtttttttgggttttgatatatggggagcagtcatatatgttaatttgatcctctccttgctgttatttgactattgtctagctcaagcttgtacaacccatggcccttgggccacatgcagccccggatggctttgaatgcttcccagcacgaatttttaagctttcttaaatcattatgagatttggctgggcatggtggctcacgcctgtaatcccagcactttgggaggctgaaacaagaggaccacctgaggtcaggagttcaagaccagcctggccaacatggcgaaaccccgtctctactaaaaatacaaaaattagccgggcgcagtggtgggtgcctttaatcccagctactttcaaggctgaggcaggagaatcacttgaccccgggaggcagaggttgcagtgagctgagattgcaccattgcattccagaccagaagacagagtgacattccatctcaaaaaaaaaaaaatatatatatatatatatatatgagatttatacatgggcttttttttttaagctcatcagctgttgttagtgtattttacatgtggcccaagacacttcttcttcttccagggtggcccagggaagtcaaaagattggacacccctggtctagctagaagtcaaagcaaaaacttcacgtaaacacatgctgaattattttccaaaactattagaaaaatcagactgtaagccttaaacaaaaagaaaacaaagcatttttcaatgttatattttaagggactttttcatgaaaaagttattcatttcactgtttttgtaagtaacattttatttaagttaaatttgtaatggaatgtgaatatggcttattggaagaccttgaggaaactttgaaggatttccattgtcctgatataatttctagattcagaaatttgaatgtttctttttttaatcactaagctttttgagaagtttctacagactgtttttctgttcactgttttgttcaatgaaataccatcctttgtaggccataatggtacagaatgaaagagcgctgataaaagaactgaaaagaatgtctgttgagatgtaaagctaattaagattccgtttaatttctcatattctctacatgagaaaaccaattatatagcaagaccactcatatatgctaatctgctgttatttaggctttggattttgaaataggaacattaacattcatcgttcagcattttatagagaaaatgtacttttttcatgtctgaaatagtctttataatgtacatcatgagtatattaaggccccctgagaagttcctaaagaaaagaatccggaaaaaccctatgctttccaaatttatttgatccgaattcattttttaaggaacactggagtcatgcaaaatgcagttaggtaaatgctggctcaacaagcttccaggagatcccgctgcacgtaactgagatgaccatttagaagtctgatccacagggaccttacatttatcagcaccagatattgtcttcaaagtgtaggattggaatttctgtctttattccaattttatactttgaagacaatatctggagctgataaatcctttatcttttttcattataaaagagaatatcaccaaacttagtgataattctcttttataatgcatctttattgatattttaagttagaggtcagcaaactttttatgttaagggccagataataaatatttgaggccttgtgggccatatggtctctgtcacaactacgcaggtctgctcttgctgggcaagagcagccataggcaatacattaacaattaagcatgtgttccaataaaactttatttgcaaaagcaggtggtaggcctgctggcccatttgaagataaagtatagcataatcaaattttttcctcatgactaaaaataatagttacaaataaacactttacaaagcagaacatagagatcatataaaaatccttcctggtatttataatatactttttacatggtagacttagcttctgattatagtttgagttcctttttatttgtgaatacctggctgactgacatagctattttcgagtaactttttgttcatattgtttacctttttggatattaggtgctctgtttctctttttctttttctttctttctttctttttttttttttttcttgagacagtgtcttcctctgttgctcaggctggagtgtagtggcgcgatctctgctcactattgcaacctctgcctcctgtgttcaagcagtcctcctgcctcagcctcccaagtagctgggactacaggcgcaagctaccacgctagactaatttttgtaatttttttagagatggggtttcaccatgttattcatttgatcttaaactcctgagctcaagcgatccacccacctcagcctcccaaagtgctgggattactggtgtgaaccacggcacctggcctgctctgtttttctataaaacaatttcatttttctcaaaaggagaacaggtcagactctcctacagataatgcggaactgcataggagtattggttggagcaacagtagtctatgaccaaacaaaaatgttatgtgtataaaacttggaattggtaccaactttgtaaccatcttagaaataacattttactgtgtacagcttattataacagtattcaaaattgcataatacgtcatattaagaaaattatctctgtaatgcgttaatgcactgggagctgcctattctctgaccaaactgttagtttgttaatctcacttaacaaaactagaatatgttcattaataatgtgtgaaagactgttacaccatttttaactcagttgctgcagttgtctagttgtaagcagcactgcttgcatggtgcagagggatatttcaaaatattatgcagcagcagttttgggtttaattgtctgcagatggtagatgatctattttccttactcgctgccacatttctaatagtacccaggctgttccatgtaaattagtaatctttcatgtaagcctgtccttaattttccaatatttttttgcatcattttccagctgtatcatgttagaactgatgttttaattttctattttttttaaatatctgtgtgtcattaatgttaaccacttaaacacaactgctgagctgtgcaggcaaactaagaagccagcctggtctgcttcaagactcttaatcatttctttgttcacatgttaaccatgataactatagcaaaggcaattcgtagtttctattcttttccaaccaatacttggagatgcattttttattctcttaaagtgaaaaaataaagttcctgaatggaaagctgcatgaaatttagatatcagagaaatttttctacataaaaacgtttttagtgaaagagtgtaatattcttctttacaaaagggatttagtaagaagagaaaacattgtgatttcaacaatagaatgttgaaaaacctaatacgttctaaaagcctaaagtttggatcaccagaattaacaatgaatctttcagcaccacactcaatttcaattggaaacactgctcagtcttcacctttatttaggatgaatgtttttggttttgttttcctttttttcttcttcagttgatctatccaagatctcagccaaaccttgcaactgtgtcatagttagaaatccaactgcctgactagagcttgtttaagggaaaagaattcagaatattcagcaccttgctatgttttttttttctttttttccttttctttttgttgttgttagaacaaagttgagacaatttgatatactgatggggattcttcttgctagcctagcttcagtctggcttttttttccctcatgcatgctgacctggaaatcctcctttgccttagctgcgataatcgtgactcagcttacaacaccttacattcgcatcgcccccgctgcaggcgacggccaactaacaggtcagatgttcaagtatagacgagtcatcttgcccatttcccactcatttttctcagctctgtttcccctctacatttcctcctttgcttaaggcctgtttacaatgtttcagacccttggtacagacctttgctcgtattaaattaagtgacatgcttggcctcttctgtgtgcacatttatatccatgcattaagtacaactccactgcatgttttcattgtgtgtttggtctgttggtatgtttctttctagactaatgttatatagaaatgaaatttgctggacttgaaatagcaataacatcaaacagggtttccaacaaaatacataaagatatattcctagttttccaaattagtctaaaatggtattcagatttgagggtgcaagagatttattttttaccttgcctggtctagtttgcacatacatttagctatacacaatcttggctgccagtagtattaaacgaagccccccaaaggtgtttagggtggcagtgttctaacagctttgtgtgtatgtacaatagttgcagagctgattgcattccttatagatccttgtttcaaagcatagtgtttatataaatcatgcagtggcatatctgcaagtcaaatgctttgaataatttaggaaagtttagaaaaattgaatggcttagagtcatggagttgaactgtgcttccttataccaagagaagtgagcttgttcactcttccctctaaagccttatagacatctctatacattcatataggaaaagagtccagtaaattacttcagattgaaggtgagtagttagtgaactccaaaagacaaacttttttgcttcagcaaaggcaagtcattgtcaagatttctaacatgattacctgggcaggactcaaaattctggtttcagaagcacctgcttacagtctaggcctgatgaaagccaagtaagaagcagaaactactttctatatgattttcactccagcaattgttttttgtgtgtgaaactaggcaatgtcccctaacatttaagaaaatggtaaagcttaactcatggtagtaaattacaaatgtttaagttgttctgtgaacttattattttggacagtaaagaaaactaagcctcaggaaaattgtagactgatgttataaggtaaagaaatgtaaaataattctatttccttctccactggaattctgtacatattttcagttttaaagctatcaatttattgacagttctgttgcccttgcctgcaagtttcttttaagagtatttcttttcctgattgaagttctacttgttacagactcttcctgctcctgaacttctgaagtgttcttcccacaagtaaaagtatttgagggacagtgcctttcttaataagtcctcccctctaaaaccttgacctttcaggactggcctgtggcactctgtgtagggttaggagtccatcttgaaggttattgggatccttcagcaactctgaccacccattgtgtctgagctggccccagactcatcagtacattgttaaaaatgggttgttcccaccttcataaaacaagtacttacgaaatataattcagtagtccttttaccaagctttacctataatccactaacttcagatgaagcatgctgtttactaggaatgaagtaagcgaggcttctgaatatagttttcactctaaaactcgcctgattcagaagatacttcataaagcagcccccgtcgtaaggcatttagacacagtgagtgtcattattttggagctagtctgaaggacacacacacaactgcagtgcatggctgctattcctcctaagggctacaggtgatctacctcatttactttggtttattagggattaaaatgatggtgtatcagaataagcctcaaaaaccagtaaaaaactactcttgttctttcttcagtatttactgctggttttaatgatggttagtcttacccagataaattcacactcaaataatatttcttttgcattttccatttgcatcacccatcaacttcgatagcagtgacactgtcttttttaagggatttattcatgagtcatactgcaagcctgagacttaattcattcagtcatttatttgacatttattgagcaccttatgtgtgccaggtatgaatcgaccaactcttttcaggagttttactttgtatggttgcctagacaccttggcatcaagtacatttgcattagtaaccccaaaacctacataagtgcatactcagatgagtgaaaaattggtatcatacttatcatttagcaaagctaagaaaagacagcagttttataactgatgggaaccaaaggacctgtatttcaaaccgtttctcactgtggtaaacagcctaggaagtggtcggtgtgacagctctgaacattttctatctgtgacccattcaaccgttgtgtttaatagatcaatcctgtcccttccagaagccaatagaagatataggaggtatacattctgaagtcttcagccattttttgttcattttgttctaactgtgctgacatcttgcccctaaaaatcctatttgatgctatacttgcactgggaagcttttgtgagatgatgagtcctttgccttgctgtccctgttgtactggtacgtggtgcttgctggttaggtttcccttggtgtaggtgggccctcccctacttgtctaccaccaatgaaaacaagaaccttggtgatctgaccccagcacctaggactgtgccaggcatgatagccactcaggaggctgaggcaggagaattgcttgaacccgggaggcagaggttacagtgagctgagatcaagctactgcactccagcctgggtgacagagtgagactctgtctcaaaaaaaaaaaaaaaagtgctcataaatatttcttgactgagttcattgaacggcccagttgtcaggagggttccagagaaggaatttgtggaatgctaggacatttcatgagcagtcctgtcattgcactagggagtgttgcttaaacttcttgaccccaatcaatgataagaaatacataactacccagtactgtatatacacatatacatacatgtacatttaactgtaatgaaaacttttagaaccgtacttccaacactactcactgcaaacataagatataccctgatttttgtattctgttctacattattctttttcatttttttaaaaaaaattctggttgctgccttctaaattgatttcatttcccgttaatgagttgtcatccacaatttttaaaaaaatgctttgctaagttactaactagatttaggagatagtaaaggggagtggaatgtctgattggaatgaaggttctgtctacctcagaaatcctactctaaagagtacacacagagtaagttctagaaattggaaatgcccctagtctctttcttccttttatctcgcgattcactgttcataatacagaaatgatttgggaagaaagtagaaagctatacatggtaggaatttctctttaaaaactttttatttttcacatatatctaggctttttaaattaagatatctttgtttatgatttaataacccagccaaccctgacatgctgtggagaatgctatatgtgtgtgtatacatatatatatatatatatatatatatatatatatatatatatatatatatattttaaatcagtagacctttccattgcaaataaaacaaatcctaggtgtttcaactcacaaaagcatgaaacagcattgtctgtctgtcttgttcccagtgtagcccacaggcacccaggaagtgtttcaaattgtttgctgaatgactgaatgaataacagttgatgacctgtcttactaaatttattcctaggtattgtatagctttcatttattattgtgagtaaattttgattgaggggaggaatattttgaaattggtttattttgtcttcttttgactgattttatgttactttatgcaagattacaaaatatctctttttaatatgtatatatatataaatttaataagcttttccattgcaaataaaacaaaccaatggtttttcaacccacttacaaaagcataatttcgatcacccatttcttttggcaagagccataaaaaggttgaatgttaattgattttctaagagaatgacccagccactcccaccaacattatctgttttcctcctactctgctgactgtctgtccatttctctacttcccaccagtcagatcccatttcacatcctaagtcctctttatcttcagtaaaccgtggcagagctaagatgtaggtagataatgtctgtccttctggggacccaaggttctctatttgtaagatgaagatataactgattggatcttagccacactgagtagcaaggaggacagtatatggcttgaagatggtgggattgtttactgaacattagcttagttagtagcagtaacagcaggtacaaaggtccggtggtgtgatgaagcatggtcagatatgaagaattgcagaaaggtcatcatggctggagagcagagagcgaaaaggatgtgtggggtgagcagtaaggtgatacaggcagagcaaggccaactgtgaccgtgtaccttacattaaggactttggtcttgatcccaggaggagtgggaaacaattggagtgttttaggagagacagaaaggatcagttttgcactgtgtactccaagccacactagaaacattggagaagagatgaaaaaggccaaaagaccaaaagtaaaactataagaaatggaagactgtccaacacactggaaaaaaaagaacagagtaagtagatgtgaatagaagaggtaaaagccaggaattaatacagtaagtactggtcatggggaatggatcagctgcagccagcatggaggagcacatgctagggaacttaagggacagggtcagccatatcaaaggaatgcttagaatcccttccaggggccatattttatatatctttaaactttcctcagcctgccactcagtgcttggcacatgaacggcactcagagtccagctgtattgtttttttttttttttttgatgggatgaagttatttgtaaaagataaaattcccttgaagggtgaactaattttcacactgctttttaaaaaaaataacatccttgccacagtggcacttccacctgtgactgcagtcagggtgaatgtggtttcaggaggggcaactggaccaagagctacacagaccccctccagttagccttccttcagacggtgcatacagtttagctctgacagaaaccaaagttgcagctttctgtccctgaaatatgtagctttagggagctgtcctgtgagcactatcctctactactagagaagctatcattcattcattcattcattcactcattcattgtttccatcgatgcgctttcaccccctaggagagctggccctaccatgagctctacataagagaggaggaacattcatggaagtgtagggtatgctctttgctctgcaggaacttatatttagtgcctttgttaagaccaacataaacagttcaataaatgctccacttccataagcttaccaacaccttgaactatttgtaatagtggtaagtgggtaatgaactaagttaacatatactcagttgcactcgaaaacgtactatctctatgataccagagtcattttcagtgtcagaagcttcaatttaaccttttgagagaattttggataaaaattaagggaagaaaatgcctcctttagatttctttgtaaataaaagatggctaaactcttcatttaagcagataaccaactgattgaaagtagtggctaacttaaaactaccattttccaactaactaggtatcttactttttgtcaaatgtagtattctgtaaatataagatgattaacaattcacacacactgttgtgggcatttcatattaaatggcagagggggatatcagtgctatgtgtttcagctacggaagttaatatagagggttggtgtgaggagaatttgagatttttgagattttcagcatctctttcaagggctgcttgaggattctgaaatttcctttctggctagaaagaatgtaaaatgagggtaaaattttattctttctgcaataccagctgactgcattttaatgggctatagtgtcactgttgatttattgccctttttgttcttttatgtgttatatttgtcattttgctgtggcagtttcatctataaaacagtatagttacaagaaaatggtgagaggatacaggcatgccatgagggatgctgttgcttttttcttgtcattttttggaatggaatactgagtcaaatgtcaagtatttgatttcagaaacaatatattttaaaatctctatattgcactgaaatagtattattttccatttgtattatgtaaacttaagaatttctatgtaaaagattttcaatgtataaaaacaatttaattttttgataccattttgtggttttcttttctatcagcagtgtgatgaaggaaaccaaaacaatattttatactgtcttttgtttgcttaaggcatagagctttctggcttgaatggcatatattgaaatttcatattttaggaaacctaacttttaattttgacgttaatttggtgtattacgcatatccaaaaagaatactgaaaagaaagttttgagctcaaaattagccaagagtttggtaaaagatacgaaatactatgaaaaagaaagtactttcagtttaaaaaacacttgaagatttttgcatgaaagattttatattgatagtgaaattgttcttgcctttttgataaggaaatatattatttcaatttttaagtaaaattaaaccagttcattcttgatgttaataaaaatgagaaaggctgaatgttttttaagtatttatcaaagctgaataacaatatctgtgtcactagttctttatctttactctggtgactagcatggaactagacacatagttgctgttccctggctgtactgttgatagataccaattgtgatattttgattttcatccatttatttattttaggaaattattactacaatttaaagtataaggaatcaatattcagtctaacagttttcagtctaaagatcccagtgatgtcccttagcatctgtaggcaaatggctgtgttgtactgctgtgtgattaacgttgtggttgactttggatttaggctctcttgtacataaacacttttagattactattattataaaatacctagtatttgtgagagttctttgaaaatatttatggttgtgttccaatatattagatccattcagaatggaaaggaagtcagaatttccttcatcatcataagacagcaggatgtagaggaggcaacagatcaagaaaatatcaagaattaatttagaataaatgatacccctttttgaagaaaggattcttgttttaaatactttcaccaaccttgtcaaaaaatcaagggagaagtcaggctggtgaatggaaagagaaaaagcacagtccttagaggagatgcacctcatttgccctttcagcaatatcagtgtgaaacgtgttcttccatgtctccaatgggctgagagtgaggcccaaagtcttttaaaagttgtcttctaagattctatcatgttaaaaatatcacctacctccccattctgcaacatgcacatactacttttctacttttaggattgctgctgttgtttttaatgtgaaaggatcttggatttggcgttcatttctgattatttctcaagtcatggcttttccagcttagctaccctatattcttgaaataacctctctctgtctggggaggttgtccttaggaaaaggggaggagaggtcgctctccatggtggaactgttgagtgagagccgttgtccagctgctgtcccatctcaaatgcttgttgactggaaagcctgggctccatgaaaccgcaaggccaagcatggtgcatcttctgggagcatcactttccttgatgataaataatgcaaaaacgtttttgtcaaaaattgatgtattgtggaatgaaatgcaacatttgcatgctttattagaaagatcaaaagtcttaaaagaaagatcgacagtcttaataaaaatgtcaagcttgcagtgggccacctaagataaagctgagcttcctgctggaatttgttctctctccttcccttaatggtacagatgataggaaagtgtacctcaggggtagactccagatcattttcaaacccacatggcccacttcattggcagttttctaacatgttagataggaatctggacttaacagtcccctaactgtgattttaaaagggaaattcacacaggaactctggaacccaatgcacacagtttagaaagcatgtacacagcaagtagtgggttcaagtccaggcttcttggggaaatctcttgatctctcaacatctcagcttccatatctgtaaaacagggagaatactatttctttacctcatagttagtggtgagacatcgagtgcaaaaatgcacgtagagtagagcacaaacctggctccaagggaaggcagtggaaatagcagttgctggtgcttctcatgtggctttgttgttgttactctaatataggattgttttatggcccatgaggctttcaagatgactcagtaattaatccaggccactgccagtcccaagttgacactgcagctcttcagagacattcaaaattgaacttctgggaaaatgaatggatttcttgatagtatgtagggtattatttacttgaacaccatgtggatgctgtggtctccaggagcaccgaagcaagagagggacattattattctgtcacatgtgaagacctgtgatgagtctcccactgatgatattttccatttacctgtctttgggataaaagcagcatcagcatgacccaggctgttaccttgctgttggcaatgataagcaatgctggtgttggtgatgctgatgaataaagttactgcattttcaaatacagctattttatttcaagcagtaatagcccaaaacagagcataacctattttatacttccctgccacccagcacactgaatagaacaccaggctccctttcttggccatttgaggttcctttgtccctcagcgtccttagtttagatgaggatgcctttctttgtgtttatatttcaacagcatcagttctcaagagagcatgaggggatgcactttaatagaactctattatatggattatagatatcttatgtaataaccttttcagacactaagtatgaaagtagacaaatataaagctatttgtaagggaatgagaagtcttacttagaagcagggcttagccacgaattttcttcaacatgctgtttttctgtttagaggaataaataactgtctctgagaaacaatgtttgaaaataaacttggcacctgcctaggagttaataaatggcatctgcttagtatatcgatcagtatctctgatgagcttttccatttgctctagtaaatatccaagcaatgcatcactttagcagtgtaactgatgttcagtttaatatgtgtaatttacttattggtgttgctaatgatgcagttattaattatggcttattattaattataacatagtttattcaagttggagctcttagtcaaaacacatactggcataccaacttttgtctgagattttgtgtaggtgttgtccttacagtgatttaatttggtattttttactcaggattttatgtaatacctcttcacagtaaacatgataaacaaaagtctttgtgattgtagtaccaattcagtgggttctccttatatgtctttgaataatttctttagatattggtatatgtttatgtacaaatgcacacacgtgcacataggtaaagacagcatcaaagtgagttgcatgtgtcttttagccagtttagggacttaataaagggaattatttatatttctgccttacttctatgagtaacaaagtccgaaaatgctcccatggtaggatcataggactgcaatagccattttgttaaataaaattacttttaatagtttgaatcctactaattatcttattagacatttctctgttttttactttctgaagagccccagaccattgtaattaatatacagcagaaattttggctagtttaaagacttctaaaacaaactccatatacaatcatgacaaattacctatatctatttaatcattgcaagtattgagtttataacactttattcttgacagatactcactttgtgtctctctgatatgtacctagttaacgttctagtcattgttggatatatatttcacagcgttgagtgctgaagatataacgttttgccactagtatttatttccatgctcttacttcctgttagtctctttttatcattgatgaaagtttggccagcaaattttctggtaaggattttgtcttagtctgttttctgcagctgtaacagaataccacaaatcaggtcatttataaacaataaaaatttatttgactcatggttctggaggctgggcaatccaagagcattttgctggtatctggtagggtcatctcatgacagaaggcagaagcaagcaagagagacagagaggagaaatcagaccaaactcatccttttatcagaaacccacttccacaataatgacattaatccattcatgagaactctgacctcatgacttaatcatctcttaaggactccacctcttaatactgactcttacaatggcaactaaatttgcaacatgaattttgcagaggacattcaaaccacagtagactctcatctgtcatcaccatactaagaaaaacccttcttttcttcctggccatctcttggcatcctcagtggagctcatgttcaaacatcttccttctttcttagcatgtgagggccacaaagatgagtaagactacttttgtctcaaggaatttatgtttagtgtatgacataaagatttaccaaaataactgaacttgagtttgaaaatagttaagttctgtgcaagaggggacaagcaaggtgctctaggagttcagcaggagagagaatacttttctgcaaagcaattaggagcagtagttggaatgtgtggcctttgaagatggataggatttgaacctacacaaattgagtagggaaagctcctatgcagcaggagcaaaggccttgggaagggaaatattgagggtttggggaaactgggcatttccgtttggtgtatttcagaaaggagggtggcataatattaggaaagggggttggagttagctcatggaaggccttttgaaataatcatttagaagctcttggatttgattttgtttttttaaatgaaagagtgacttgattggagctattatttaggaagatccatacggctgcactatgtcaaagacactggctaaggtatctacttgggagtcaggcataaaaatccagaagagaaatagatggcagtgagaataaagaaaaaaatatgtagcatttttagacttgttagagattgggaaggacagtaataactgacctctctagtgtcagatgacaattctttaacccaagggcggaataaacctcctttgtaatttattccagtttcatggactgaatacaaccaaaattcatttacttgctcttttactgaatactgactacattgtgcatagacaggggaaagcctctctcagcctttctctgtacaaacttgaactcctgcttttacacttatatgttcaaaaatatttttctccatctatacacagaccactcatggttattgttctctttacaaatgcttcttgtgtcttttacaatatccgttcagtaaaggcttgtcaaatgcccaccgtgttaaagagactgttaatcactagacagcaaaggtggtaagaaatgatctttactcttgggaagctccgatggcaggtcacctgcttgccttctcctgcattagataaatgaccctagttccttttatccttcttcgtagtccttcttttttacctcgttgatcatttgtgcttcttttctttgattccttttcctcatccacatgatgactagtatatcatgctccaggattatgtgcatgccattactctcatacatttcagaattgtattgatcatattaccagatctttcttttctgcactttggccaggaagtcctttctcctcttgtttttctttcggaattattagttccttattgaattgttcattctttcctttttcattctttcctttttcattcttttgttaggccctcctctttacaactgaccaagatcacttttaacttgagtcttgtattccatagcatgagcaataaccacttgagttttctgtattatattggggaatgctgtagtgcaatgaaataggagtcagcttcacagtcagacaccctgggttcagagtatagcaccattccttctctttcactgacttaggacaagctgtttatcttgatggcttctgttgcttcagtttcctcatttgtaaactggtattaattatacttcatggtataatattaaataaaaattatataagttacccagcatataaagtaggtcttcaaaaagattagttttcttccttcctatcttatttagtagcacccaggcagttgatcaatatactttaaattcctttacaattcagagtgtcttccaatctctacatactggggctagtcataaatgaggatttgattccaccacgtttgcctcttcattgtataaaaggatcttttcaaatagtgcaatcaatgatggaaattggatcgctgagaaagtaagatattattatattaggagatgttttaaggataacaacacaattacattttttttctcattttgccatagtctgaaaaacttccccactcatactttggagccatagttctagagttggttttttctccatgttgtgtagggaatccccaaaagtgttacatagattcctgggtcctacctcagacctttgatccagaatccacggggaacccagccatctgcatgtttcaaagctctccaaatgattcttcacccagcctgagttttaaacttcctataattggagaccctctgttttagaatatattaaacacaacgccacaataaatataagccatatttattaaagccatttattgtttgaggaactattgtgtgtttactaaatgagagtctggagagtacatgacttccactctctcctaagaccgtgtgagtcctcatcacaattctaaaaggccatcttttgtgtgtgtagttcttaggccctgtgaaagtcatgtcacacatctcatgcaatttgctaggctctacattttttgagcctcagaaatactgatacttctagcaagcatacagaatagactaggtatacttactttttgatgagatggtgaatgacaaatttcagacagcaggaaaagctctaagtggtttttgcaaacaacaactactttgtgtaggaagctgtggtgatcctttctcccacaggaaaaaatgttaagaggtaaacacgaggtctagaccatgacctaaaatacaaatctggaagaaattttgagagacagtaggtttccattttaatgccttcaaagtttagtttcaagcaaatggttggaaacttccattctgaactacatcaccttcaagaatcatctgttttggaagcagccacccccacttcctttcttgattattcacttatgtgaaagttgcacacagttgataacttattattgacagtttgtttccctattttattacttgataatgatttgagaaattcaaatggaaaaaataaaactatttcatcaaaatagtaagagcagtaataattctcttggacttttagtgtccagatgataagtgataaggctttgatagatcatcttctccacagggcgtcagccacatcaataaatgaggcagtaactgtcatgaaattagaacaaaaataaaaaaaagattgatttttttagagaagatatatatcaaacaatccattatctcagtcttatatgaaaaattatgtttctgattattacttgtacattgtatatgctctgtttgccctacactggaaattagggacagaagaagagttataaattcaaaagcataatcaggttacaaagaatacacaaaatgtgactgtagattattccaggaatagtgattgacttcgcattcccaggaagaaaaacaataatatgtaatttaaatgaaaaatctaggaggtgttttgtgattatgtataatgtgaagaaggaacagctggaaaaaactaaacaagactgcaaaggattttaattctctgggcaacaagacctgaatgaactgtctcacaatgatctttaaaacaaggatgttgctgtttttaagaaaaagtatagaaatttacctctgcatatgttcacacacacacaaaaggaaaattaattaaaatagagtattccatgaaagtcattaaaatgctagcacaaagtgatggagtactgaatttaaattttagattatcttttgggaccagtgctctttgaaacgcacttgaaggaacaatatttttacatatttccactgcttccattttattttctacttttagctcttctccctgtcgcatctcttaaggtttttcagcctcctcagcttttcttttcagcagttcccattgttactgtccttagccccttttttcttcctttctccccaaaataccaagagtggctttgtggtatttggtttgccaccgaaaccttttgcatgtggtgtgaatggggtagtttgttgctcaggttcaattcagacattgaacccaacacacagccccagctggccatgtagtcccagagccattgtgggtgttgtcacctgtacacagctgactgtgcctctgtgagtctcttgtgtcctgctcgttccagccacccttgcaattcaggcaggggaggctccaggcctgggtggggcagtagccttcccatggctccccaacttccttcccttcccttcttcagtgagcctgcgtattgctgcccagttgttctcaaggtactgttctgttattttctgtggttccttatttactaaatttaatctgggctgtcctacccagtgagcaacacccatcccaccataaagcctcagttccaaatcctcttcccaatcacccccagcccctgctccagaccctgcccttgaagctagtatgtgactccagaggcccctttgttctggcttatgaggcactcttcccacccagcgttgaagccttcccggtccttccagcccattcattatcgcagcctctgacaaggagccctccctcatcccctccactcttccccagctggactctgtagcttacctgtgacacttaaggcttctggccttatttactgtggtcaactccctgaaggaagaggcacatactcaactctaattcccctgcagagccttgttccagtaccttgagcacaaaacgtactaaataaggggctgctaattcggaggctgtggaagccaacatgagccacacatatgaacaggacagtgctggcccacgttcacggcttcatcccttatatttagagggaacgtcaagtgtcacagggatgcttctgtatctctgatctgaacactggtcacacccctccccaatgtaagtctgagtggggatcaccccctacctttttttttttccctcctcttccccttcttcatcctaactaggaggagtgaagagacggcccagggctctgcatgctcttggatacagccacagccccacttcccaccctcactgttggctcgtggccatcaggattgctctcactggcccaccttccccttctctctcacgccttagcccccttccaaccctgtcttctgtgtccttggaactcctggttggctaccagcagatcccacccatgcccagcctgggacatccctcccttccctcttctagacaacttcaaaactttttggcctgagatttctcacacctccgttctggtcctcagtctcccctcatcttcttggttcctttttccctgggaaaatgaagccatcaaaagagacctttcaaatgctctgctcccagaccagcgcatctgccaagagcctgtgcattgctgcgtgtgtggctttctgctgttcctctgggtgaaacatcagccctcgtggttctgcgcgctggtctcacctcccgcctctgcaagggcttccctccagcaggcagctcctttccctcccgcatcatcaacttgccctctctatggtatcattagcattcgcattcagagatgctgtcatttctcccatcttaagaaaaaaagactgtttcgtgatccctttcttcctctctggctgctccgtgcggatgctccctgtgtctgtattcgcctggacatccgcctccatgtggctgagttccatcctccttgacccgccattgtttcccttgttcacttcctaagtgtcccccggccgactcatgactgtaatcaccatcttttttatgacaacctcaaatttatcttctacacccagatctctcccctgtatatccatccaactgcctacttgctatctcttttgtatgtcaaatatctcaaacctcattggtccaaaactaaactcttggtctgcccacccacccctccaaacctgctcctcctgcagttctcgccctgtcagttagtagcagctgtgtctgtccagtgactcctgccagaaatctggttgttatcctaacacactcgacatccagttcatcggcaaaactgatggctggactgtcacagcgtgtctcaagtttgatggcatcttgccacctgcactgctaccttctcactccaagccatgagtgtcttccctgcatcttcgtaatagcctcgtaactgaggtccctgcctccaccgtggcccgctacagcctgcagtacacacggctgccgggatagtgttgttgaatataagccagatcaagttcctcctctgctcagaatcctcccaaggcttctcaagcagagagagtccttccagctatctaaggaggtgtccccaccctaaaattatgcttcaccttctccgcagttcaccgcactccagtcacactcagtatttcagtctcatttgcaccttttccctttttctcctccctggatgtcactctcccactccctttcctctttcaggtctctgctcgaatgttattttctcagtaattccttctccaatcccccatcctaatagctgccttgccttcaccccccagcccactccccttgatttttctctacagctagcctggccagacactgcctacaatattggtttaccttggtgtctgtcttccccacaaggatttaagttccatgaggtcagaagtttttgttttgtccatctgctcaccactgtattccttaaacagtgcttggcaagcagttagctactcaataaatgcttgttgaataaatgaagaatattgctggatttttttcctccacattcaaggtcaacctcgtactagtcaccaccgtgcaaagttctgcagctgagctgtccctgcggctcttcctaaccctgccactcccctccctttgggaaagcttcccgttcactcggggtgaaagcagcccgtgctgtgggcagcatggtcagtagctctgggcaccactgacagccttcatggccttctgggcttgtacccttggatcttctgggaaaatttgtgcagccagttcagtagtcaaaattgggcccagacctcaagccagtggctgagtacatcgtgttctcagcctggcttgctgctgttatttaatttaatgttgaacactgggccaaagtggaattgttttctgccaagttgaaaaccagctaaatactgcattggttaatcattccatttgttttgagtttttttgtttgtttgtttgtttgtttgttttacatactagatgttataactgaaatcttaatgcaatttgactggaataccactcttttttattttcttggccattataaaaataataaccagcgttatcactaggagtcagtagactgggcatctgtgaggattatgctctatgattttagcagtctcttaatctccctgtaatatttagcttattcaccagtgcaatgaatacgatacagtagcaggcctagataatatccactgataaatggacacatgcaagtttattctcttcaaaaggaactaaatgcacactgctgtcctaacagaatacacacaagaagagaaaatgccttttaataagcaattaaaatttatacgaaaaaaaggaaaagtttataccatgagaaacctggcaagaaaataacaagaccgagggggaaatagaatgaaaacaactcttttgccaagcagtttagaaattatactgttaaattcatagatttgggtgaggaaaaataaacaaccatcagttgcaaccatgttctgtcaaaaatatcccctgtccaaggcccgctgacaggtcataaccagaaccacatgttcccaaagcaataaaagaggagagaggagcatcctatttaaggagagcctaaagatgttcatttcaggcagggatagagggacagggcacaggcaggaaagcaggaacttcctgggcaaggggtctggagtcagtgacacccacccatcaggttatccgagggctgtttgtgtttacactgatgcttctgcagagtcctaaacccaaacacccgactcaaccggatggccactcccaggcagccctcccaccttttctgagtcactgtcccatttagcgtggttgctaccgtcatcacgttgcaactgtgtcaggccaagatagaacatttcattcccttgacctgcaatgtgaaatgagttaaaagtcagtgctaagaaatgataatactgagcttccacaggctgcatagcaatgtgcatgctgcttcctaaaggggatgaaaggctgcaggtaaccacccctccttggcccaaagcagaatagtcattcatcagttcccacagagccagaccctcctctactgagtgttcacaatgtatgcattacatgtgtgctatttttatattaaaatgtcttaaggtaaataagtttttctaaacattttttcccaagtgttgcatttagtgacataacttagttacaaaacataccttaactcatctatttaggaaatatacatggagagccagctatctataactagtgagataaatggaatggctttccagtatgtcaacatttggaagaataaaaccaatttgattttattttaaaaatttgttttaattggacacaaaatcaaaatggaaaaacagacttttttcagtttcgtgaatttcaaatgttacttctttttgtatagattgcttatttaacttaaaaaaattttgtttatccacatacacattttatctttaggtttttcttagcaatttgtttaatgtgacaatttcctcccagtcagccacctggtgatatgttccaatagaatattggagtggtgtatttcagatgtaattaccataaaggataattaacattaataccttaaagatttaactgaacaactagtttgagggatattcattgaatcaaaatagcaggacttattctcgacattgtcagaaataaaattgacctgtagaggcttcttcagaagggtttttatttcataaggtgtgttttttgcatcatggctgctgctgttgcggctctcaaatgattggaatatgctttgtcatggaaacactgacgagcttccaatttgcttcttccctgaccttgactcacttcctggggtcagtctaatgactacagccatgttcagaatgcagggcctcatgtataaaatctcaccaggaataactttggaaagaaacatcatttacgtgttcccaaaggacacaaaaaaacagatggaaggtgatatctggcactccctctttctcagtgataactcattttagagtttgtcctcctggtcttgggggctcagacacagtgacaactaaggttttcgtgagtcaggtgacgtaggagtggaaaacctcatgacagagtggaaagagctggtttacaaacactccgatttaattacatttttaccaacacaaaaagaaaattctaaggaggaaaatttggacataaaattcctccattcggaatgacctgtcacctagtaagggtggtgtggctcagagcatcatcacattctgattttaaaagtacaagcccttttacaaaggagtctttttagggaattgaacattgcattcctaatatttttcatcctgaatgcacttagcagaggaaacgtatatttcatcagacatggatttgacattccattacattgtagtaaacgggacaaacatgtctcatgttttagacatgagaaaggggagctaagacagccaccaccactgtaagaccctggttatctcatttaaacagattttaaatgtgggtgccagtggtgtgatcatcagccgcttccactttgtgaataaattgcttagaaggagtcttttgcctaccagatgtgacctagatttagatttccaaaggcagggggaaaaaactctattgtgttaaaaaacaattgctggtaaaaatgcatggtaaatgagcttatctcagttttccaggtgtttggactaatatgttatggaattactgcttcgtttatgaaaaataactgaggaaaatgttccagcaaatcaaatttggataaaggcttagggatagctattgtgctgttagtaagtttttaaatggcagaaagagcaggagccaatagagataataaaataatatttttctaaaaaaaaaatgtttgagaagagtctcatagaaaagggtcaggcatgggtgtgctatccagcttgtatatggtttagtaaaatattgaagaacaatgtgaacaattacgctgctttcagtgcatatgaaagctgtttaaaaaatcaaagcttgtctgtctgctggctctgataagtcttattactctgttaaatgcagcgaaattttttaaactgtggcatctttattctctcttacctacagtctctcctttttcatttcctttcatcttcaggagctgccactccgaaaccagtcccagaacccgagaaacagacagaccatacagttaaaattgctggagtcatcgcgggcatcttgctgttcgtgattatatttcttggagttgtgttggtaatgaagaaaaggtgagctcctagctgttgccaaagatacagttatatcccattgtttgctggaatgttttgtgtgtgtgaaaattctcagttactgaactggctttgataacccagacacatctgtgactctgtgattgttaacatttttcatcatgtggcatggaaggttatgggacaaaaatttagagtaaatggctatgattctgtgtgaatacgcaaagcatatcatatcagaataaccatcctgtgtcttcccacacagtggcagataaagctctgcaaaatcttagaagccacttattcaccaggaaatgtttagtactgatttccaacatactaagacatttggtaatcacaaagatatgagaagactttactttttattatagtgaggatgatgatgatgacagattttatggggcctgtgttatatgtaggcaccgtgctagggaaggtcatcagcacaacatccatgagaaagagaacccgcaaaaacagcccgacagaaaaatgcagcgcgggagcagctcgtgttagaacaaatcacagagcaagtggtgtggctgggcaccgtggctcatgcctgtaatccccgcattttgggaggtggaggcaggtgaatcatttgatcactttatcccaggagttcgagaccagcctgggcaacatgacaaaaccctgtctctacaataaatacaaaaatttgttgggcgtggtggcacacacctgtagtctcagctactggtgaggctgagatgggaggatcactttgagctatgatcactccatggcactccagcctgggcaacagggcaaaaccctgtctccaaaaacaaacaaacaaacaaagttgtgtgttacaagagccaagggatagtctgggggagagaaaaacagatatggccataataagtgatcctcacctcccatacttgaaaactatgcagtgtcttgttttgtggaaacaagcaaaaacttgcttaataataaaatcttcgatttatgtaaaaatcaatacaaaaatatagatactaagaattgatggcataaagtttcccaaattgagggaatatgtggatcttgttcttttctctattgtttcgaaacagttgtagtcatgcattgagagtgagttcatggatgggagaaggtaaaggtggagaggttggcagagtgaagactagaaactctgatctggtcatggaaggaggttgaccttgggcctgagactgttgatggcctttgagtaggtggtaacatgatctcatttttaggaatataactctaacgttaggattggacacagtgaggaggggagagagctcaaatcaggaagaccagtagaaggaagagaaagagcaactttagaaacagttaagagttaaattttagtagccatttggagagagaagggacaatatagaaagacttagaatagttcctggtttgggcaagttagtggagatatttctgttcaccaaaatgtggaacataggaactacaaaatggggtgggggcactaaaaatggagagttcagctttgcacattttttttctttttctttattatattttaagttctgaggtacatgtgcagaatgagcagttttgttacataggtatacacgtgccatggtggtttgctttacccatcatcccatcacctatattaggtatttctcctaatgctatccctcccttaccgccctaccccctgacaggccccagggtgtgatgttcccctccctgtgtccatgcattgtcattgttcaactcccacatatgaatgagaacatgcagtgtttgcttttctgttcttgtgatagtttgctgagaatgatggtttccagcttcatccatgtccctgcagaggacatgaactcatccttttttatggctgcatagtattccatggtgcgtatgtgccacattttctttatccagtctgttttctttatcaattgatggtcatttaggttggttccaagtctttgctattgcgaatagtgccacgataaacatacctatacatgtatctttatggtagaacaatttataatcctttgggtatattcccagtaatgggattgttggatcaaatggtatttgtagttctaggtccttgaggaatcaccacaccgtcttccacaatggttgaactaatttacagttccaccaacagtgtaaaagtgttcctgtttctctgcatattctcaagcatctgttgtttcctgactttttatttctttcttttcttttttttttttttttttgagatggagttgtttgctctttttgcccaggctggcatgcaatggcatgatcccagctcgctgcaacctccgcctcccaggttcaagcaattatcctgcctcagcctcctcagtagctggaattacagatgcatgccaccacgctaatttttgtatttttagtagagacagggtttctccatgttggtcaagctggtctcaaactcccaatcttgtgatccgcctgcttggcctcccaaagtgctgggattacaggcgtgagccaccgtgcccagccttcctgacttttaatgatcgctattctaactggcataatatggtatctcattgtggttttcatttgcatttctctaacgaccggtgatgataagcatttttttatatgttggttggctgcataaatgtcttcttttgagaagtgtctgttcatatcctttgcccactttttaatgggattgttttttttttcttgtaaatttgtttaagttctttgtaggttctggatattagccctttgtcagatggatagattgcaaaaattttctcccattcttaggctgtctgttcactctgatgatagtttcttttgctgtgcagaagctctttagtttaattagatctcatttgtcaattttggcatttgttgccattgcttttggtgttttagacatgaaatctttgtccatgcctgtgctctgaatggtattgcctaggttttcttctaggatttttgtggttttaggtcttatgtttaagtctttaatccatcttgagttgatttttgtatcaggtgtaaggaaggggtccagtttcagttttctgcatatggctagctatttccaacaccatttattaaatagggaatcttttccccattgcttgtttttgtcaggtttggcaaagatcagatggttctagatgtgtggtgttatttctgaggcctatgttctgttccattggcctatatatccgttttgataccagtaccatgctgttttggttactgtagccttgtagtatagtttgaagtcaggtagcatgatgcctccagttttgttctttttacttagattgtcttggctatgtgggctcttttttggttccatatgaagttaaagtagttttttccaattctatgaagaacgtcaatggtagcttgatggagatagcattgaatttataaattactttgggcagtctggccattttcacaatcttaattcttcctatccatgagcatagaatgtttttccagttgtttgtgtcctctcttatttccttgagcagtggtttgtagttatccttgaagaggtccttcacatcccttgtaaattgtattcctagatattttattctctctatagcaattgcgaatgggagttcactcatgatttggctctctgtttgtctgttattggtgtataggaatgcttgttatttttgcgttgattttgtatcctgagactttgctgaagttacttatcagcttaaggaggttaggggctgagacgatggggttttctaaatgcacaatcatgtcttctgcaaagagataatttgacttcctctcttcctgtttgaataccctttatttctttctcttgcctgattgctctggccagaacttccaatactatgttaaataggagtgagtgagagaggacatccttgtcttgtgccagtttttaaagggagtgcttccaacttttgcccattcactatgatattggctgtgggtttgtcataaatagctcttattatttcgggttgtgttccaccgatacctagcttattcagtttttagcatggagggctgttgaattttgtcaaagaccttttctgcatctattgagataatcatgtggtttttgtcattggttctgtttatgtgatgggttacgtttattgatttgtgtatgttgaaccagccttgcatcccagggatgaaactgacttcattgtggtggataagctttttaatgtgttgctggattcagtttgccagtattttattgaggattttcgcatcgaagttcatcagggatattggcctgaaattttctttttttgttgttgttgtctctgccaggttttggtatcaggatgatgttggcctcataaaatgagttagggaggattctctctttttctgttgtttggaatagtttgagaaggcatggtaccagctcctctttgtacctctggtaaaattcagctgtgaatccatctggtcctggaccttttctcgttggtaggctattaattactgcctcaatttcagaacttgttatcagtctgttcagggatttgacttcttcctggtttagacttgggagggtgtatgtgtccaggaatttattcatttcttctagattttctagtttatttgcatagaggtgtttatagtattctctgatggtaatttgtatttctgtgggatcagtggtgatatcccctatatctttttttattacacatctatttgatcttctttcttttcttcgttattagtctggctcgtggtctagctattttgttgatcttttcagaaaaccagttcctggatttattgatttttttgaagggtttttcgtgtctgtatgtccttcagttctgctctgatcttagttatctcttgtcttctgctagcttttgaatttgtttgttgttgcttctctagttcttttcattttgattttagggtatcaactttcgatctttcctgctttctcttgtgggcctttagtgctataaattttccactacacattgctttaaatgtgtcccagagattctggtacgttgtgtcttcattctcattggtttcaaagaacatctttatttctgccttcatttcattatttacccagtagtcattcaggagcaggttgttcagtttccctgtagttgtgctgatttgattgagtttcttaatcctgagttctagtatgattgcactgtggtctgagagactgtttgttatgatttcctttcttttgaatttgctgaggagagttttacttcaaattttgtggtcaattttaaaataagtgtgatgaggtgaaaagaagaatgcatattctgttgatttggggtggagagttccgtggatgtctcttaggtccactttttccagagctgagttcaagtcctgaatatccttgttaattttctgtctaattgatctgtctaatattgacagtggggtgttaaagtctcccacaattattatgtgggaatctaagtctctttgtaagtctctaagaacttgctttatgaatctgggtgctcctgtgttgggggcatatatatttagcatagttagctcttcttgttgcattgatccctttaccattatgtaatgcccttctttgtctcttttgatctttgttggtttaaagtctgttttatcagagactaggattgtaactcctgatttttttcgctttccatttgcttggtaaatattctccatccatttattttgagccgtgtgcatctttgcacatgagatgggtctcctgaatacagcacactgatgggtcttgactctatccaatttgccagtctgtgtcttttaattggagcatttagcccatttacatgtaaggttaatattgttatatgtgaatttgatcctgtcattatgatgatagctggttattttgcccgttagttcatataatttcttcatagtgttgatggtctttacaatttggtatgtttttgcagtggctggtaccggttgttccttttcatgtttagtgcttccttcaggagctcttgtaaggcaggcctggtggtgacaaaatctctcagcatttgcttgtctgtaatggattttatttctccttcactatgaagcttagtttggcgggatgtgaaattccgggttgaaaattcttttctttaagaatgttgaatattgggccccactctcttctgacttgtagggtttctgcagagatatttactgttagtctgaggggcttcccttgtgagtaatctgacctttctctctggctgcccttaacattttttccttcatttcaaccttggtgagtctgacgattatgtcttggggttgctgttctcaagcagtatctttgtggtgttctctgtatttcctgaaattgaatgttagcctgtcttgctagattggggaagttctcctggataatatcctcaagagtgttttccaacttggttccattctcctcgtcactttcaggtacaccaatcagacatagatttggtcttttcacatagtcccatatttcttggaggctttgttagttcctttttattctttttttctctaatcttgtcttctcactttatttcattaagttgatcttcagtctctgacatccttttttctgcttgattgattcggctattgatacttgtgtatgcttcacaaagttctcgtgctgtgcttttcagctctatgaggtcatttatgttcttctctaaactgattattctagttagcaatttgtctaaccttttctcaaggttcttagcttccttgcattgggttagaacatgctcctttagcttggaggagtttgttattaccgaccttgtgaagcctacttctgtcacttcgtcaactcattctccaatcaattttgttcccttgctggcgaggaattatgatcctttggaggagaagagacattctggttttggaattttcaggctttttgcgctggtttctccccatctttatggatttatctacctttggtctttgatgttggtgaccttcagatggggtctttgagtggatgtgctattcctttctgtttgttagttttccttctaacagtctggcccctctgctgcaggtctgctgtagttttctggaggtccgctccagaccttgtttgcctgggtatcaccagcggagacagcagaccagcaaagattgctgcctgttccttcctctggaagcttcataccagaggggcaaccacgagatgccgctcagagctctcctgtatgaggtgtctgtcggcccctactgggaggtgtctcctagtcaggatacacgggggtcagggacccacttgaggaggcactctgtcccttatcagagcttcaacactgtgctggtagatctgctgttctcttcagagctgccaggtagggacatttaagtctgctgaagctgcgcccacagctgccctttcccccaggtgcttcgtcccagggaggtggggattttatctacaagtctctgactggggctgctgcctttttttcagagatgccctgctcaggaaggagaaatctggcagtctgaccacagtggccttgctgagctgcagtggactccacccagttcgaacttcttggtggctttgtttatactatgaggggaaaaccgcctactcaagcctcagcaatggcaggcaccccaccgcccccccccgccccccaccaagctggggcatctcaggtcaatctcagactactgctgtgctggctgcaagaatttcaagccaatggatctaagtttgctgggctccatgagggtgggacccactgaggcagaccacttggttccctggtttcagcacccctttccagaggagtgaatgattctgtctcacttgcgttccaggagccactggggtatggaaaaaaaaaaaaaaaaaaaactcctggagctagttcggtgtctgcccaaacagccatcttgttttgtgcttgaaacccggggccctggtggggttaggcgccagaggggatcccctggtctgtgggttgtgaagaccatgggaaaagcgcagtatctgagctggagtgcagggttcctcaggctcagtccctcacggcttcccttgggtagggaaagaaattccccgaccccttgcacttcccgggtgagatgacaccccaccctgcttcggctcgccctccatgggctgcacccactgtccaaccagtcccaatttgatgaaccatatacctcagttggaaatgcagaaatcacccaccttctgtgttgatctcgctgggagctgcagaccggagctgttcctattcagccatcttgccagcaatcccagctttgcacattttaagttcaatactcctttaaaattaagtggagatgttcactgggaggttgaatatgctactgtggactagaaataataatttccatagtctgaaagtcatcaacatttctggagctgaagccataggtttggaagaggctcctcagagtttttgtagagtgagaagaaggaatatcaaggatgaaggtaaaaccgttggcaacagcaatatttcagggcgagttaatattccagtatagatacatgcatctactccttttctgagtctccctccatttatggttctgttctagtcaagccccaggacaaaccgttgctctgtcacagctgtgcgcatccctggtctttggtccccaccattacaactgtttttccccacttgtcatgtgccgtttatctctttttctacccatcgtgtgattcctatctttatttttcattcattatttattttcattccattcctctctacccctcttttctttacccttctttacctatttctctctttatttcctttttcctccatatttcccatatttccttttttctttctctttttcttatgcctcacctcttttttttttttttttttttttttgagatagggtctcgttctgttaccaggctgaagtgcaatggcacgatctgagctcactgcaacctccgcctcctgggttcaagcagttcttctgcctcagcctcccaagtagctgggaatataggctcacaccaccaagcccagctaatttttgtatttttagtagagacagggtttcaccatgttagccaggatggtcttgatctcctgacctcgtgatccccctgcctcagcctcccaaagtgctaggattacaggcatgagccactgcgcctggcctttcctggatgttcttcgtccattccccacctcaatgtgtatgtagatagcttatttttggcaccagtagtttgtactttttaaaaacatatgacccagtgtaagtcctaaggaacaataggcccttccatgcctggacatccaaactaaacattttgaagaggtttatttttaattccgggaatatggtggatatattttgtcatctggcaagttctctgtgaggaatagcctgcaactactaatccagttgcccttgtgaccctagctaaatgtcaactaatcctccaagggtctatttctgcaatattaattcatgattctacctgggtctctctggtagtcgttgaggttatgttataaattatgcattgaagagatgcctttggtaacacgtggccttaatgcaactttagactaaatgccaacaagtcatgtcagatttacatgattatttactagataataatcttaaaagggttgtcttcacagcatgtgccactttgggatttgctttttctgaaaaatagagtatattctctgtcagatgaattagccagtataccatgctcagaaatacaaaacttgctattatctttagacttgagcagtcttgtacaaactatcatattccatagaaattcttaaaacgtctaattgtccaggactttttaccaaatttcaagtctaaatttgaaaggtagtgtttttaagcagaaaagttaaagcataacattaatcatagaaaaattgttggggtgttattgataggtaatcaccacattgtttggttagaagaacactgaacttagatgtggaattcctagatctgtattttaactgactttgtgattctgaacttctctggccctagtttcctcttttgtaagttgagaaaactcaactagatgatctctgaagaccttctcaattccaaaatgtcaggtttcctggtaggtagtagccactggtgacactactacgcatttgctattctagaagtaccgcatgtgttttgttactgtgtttccctacttaaacctctgcagcagctcttccccaggctctctcagttcagttcaagcccagaggtgatggctgatgagtggtttatcttccagctacatgttttcgaccttcacacaggaggccctcaattaaaagggaagccgtagggaaatggaaaaaggaatgagagagagggaaggaaaggaactgcctcgggtgtggatttcaatatattattagttgttactgtcagttagaagcaaatgctgtgaaactttgcactcattcctgtgtggactggttagcctatgtttcctctaccgcagcattctgagtcgtccacctcaaatatgtgctgttggtcataaagacagactgggcccaagagacagtgtgggtgaaacaaattcattcattccttctagaaataaaatgggaagtctgtcctacagaggatgagccagccgccatcgtctgtacttgtcacatgccaggccagctcgcctgctagcttgggagcaggaggacagcaaattcaaacactggaaaattgcttgacattttattgggaggcattgtcaattattagctaagattgttttgtcttctgaagaattggccctctataaaaaaatagttgtggaaggtgggcttttaacagaaaatgtaaagtctgttcagttcatactaattagtacatggaattatttaacatataggcaataatggctaaaaactgacatgaccatcagctttattttaggatgttttacaaacctatcacaaagcaacaactaattttttgttcatgtatattaattcatttggcctttacctggactaatatcatctgaaaccttcttttctttgaaacattttatgaaatgtatacacttatttttactttattatgtaagcaaagcaattttttattttccgtcccacaaattatgtgttcctttaaagatttgacattttgatgcagcaaatgttaagaaaaggtgtgagataaatgtctacaaaataaatgttttatacagaaccacggggcaatgtactctcaaaattaatataaaataacttgaataggacatattttttttaccaggtttcatccatgtataattagatatatttgtataaatgaaaatacctgtatttttaacatttttcataaggaataatgtatctcaataacatgtttgacagaacttagtatgtaagcactatcaattttaccatgattaattatatttacgattgtttctaaaatagctatagatctttcaggaatttgagaacatttgtattaattatagtaatattcctgtctcagccactgtggtacatagaaatcacagaagttgcagctattgaaaataattaaagagttaggcattctggggcaaaatagcaagtggtagctattatattacataaatacctgttataggtaaatataactattttaattctgaaacactatacctccatctcctttccataacacatttaaacagatgtacattttgcaaatgcagcatattatcaaatatttggcacccattctattatatttaaacaatgctagcactaccaagaaaaatcacaataaaaatgggaagtttttctgaagacaacatgaaacaaaaaagataagagggaaaatttgatgaaagccccattttcaaagagatgcctgcagcatgcagccggaggcaagttgacattaactatagttcccccggcctatccatttacatgtgaggtagtttctttccactgtaagtaagtgtgacttctgtgtggaaaatagcttaggtctggatgcattattcaaagttttatttcaaaatcacctttcctgagactacactgagaaagtcacacatagatgtttctttgtgacaattatttaaaatatgtggctttaatatgcagtcctataagtatgaaccagatgctgagatcttgcctagcacatactttggcatgcttggaacaggccatatgtgcacacaaacatgtatggatgttttatctcagtctatcaattagctgccgtccttcaggtttccagataattgaatagggttgaggtacaagggtaagttgaacaaattgacttttgtaaaggcctcttctgagctggactttatatgattactgtaacagttcctaaagtaacccctatttcttgactcaacctaatgggaactctttttaaagaagattttattttaaaaaaagagtgtggggaacatagctaccaatttttcatcttataggaggaaagtgtcagagaatgataagagtcatggctttagaatctgacgaacctgattttacaccacaactctttactttgtggcactgtaaatttaaatgagttacttaacacctctgaactattttgcacatgtgagatgtgacgatgatgataatgtgtactgcataggggatgcggtaaaaattagatggtatatgtacatagttggtctttgatagataatagcttaagaacccagcagttggagaacttgtcccagggcacgtaggtagtccgtgggagggcctagtctaagtcagtgcatctgacttttaactgccctgctaccctggctcaggcaagtaaaactcaaacatgcaccttgctctgtaaagctcaggtactctttataattagctgacaacaccgtgcagtcatcagcttgttgcagtttaccattgctttaagtctataaatatttgaaattctgccagcatgtcttattcttttctttgagccatcattgcagaatagctaaataaatgcttttttcgtatcctcctttgcagaagcatttttagaattcttttgaatagctgtattttgtgtcatttgttgattcctgagtttacttctgataactctcaatggtgaggatgctgtatcctcttgtctggtttactgaacaagagaatcttgttaagttttagaggaagccataaagcaggggagcattagctgcacctttcctcctcagagacaaatgctggggtcttccgtggtgaaagtggagaccctggggacagctgccttatgcccacaccttggttccgtggcttactggctgtgtgatcttagacaagccacctagctcggtgtccctcagtttccccagctattccaagggcataataatagttcttacatcataaaatgttatgacaagaaaacaagttgatacctttaaagtgctggccccagtaaatattaactctattgataatatgcattatacaccagtatacaagctgtagctgcctctctggtttcaatgctcatggcttgcgtgcctcgaagtctttgtgtccggacatgggagaagaccaaggaacggagctgtctccccttgagagggggtcctctctccttttcccatggagagcatcatttctttgtacccaaagaaacacacgggatgggtctttaattatgaagctagctaggaacacagctagctggaatgagacagctcattttctccttaccttaaggccatgccttggtgaaggtgccagagctgatagcacaaagtaaaatcattcttcagccatgctcagccactagtattccttatgcccaggctcctactcagtcaagtggagagccggattataggaaaaattgttctctgcagataagtaaaccaaaggtcctggggcatcaatactaccatgcttggggaacgtcctctaaaccccaaatgcttctgagtgggcatggcattggcattaaatgcaaatactttgggtattaaaaccttccagacccagacgcagcaaggtgccaagtggtctgccacctggggtgggaacagaaggacagcatcactgtcttcggtgtgcataaaggccttgtcatgtatctgtgtggactccctgagcctctcctcagtgctgcttgttcaccttccacagttgcaggaggtcgaaggccctgtggccaggcaccagccctgaacttgcaccacattcagcagggctgaattctcaccagccatctcagggcacaattttcctactgattcctcatttgaatgcctggtaactccactcatttttaacctctatctattagcatagcttattaaaactggttctatctgtgtctcttaattcctaaactcaagccctagacttcttaaaagggtattgagagagggctgcataattactactaaaattgatcattcttcacagttgatgtctcaagatggagtgtgttgacattcccagtcccacccaagtgcttcatgatctttactgggtgtgtgttttgattcatgttgatgtgacttcactttctagttcataagagcgttaaaaactgagcatatttttcttgggatgatcgtttaaacttgtatcttggttatcgaatccaggaattcaaacctaataataccacttttccaactctttccagttttgttttatattaataagtaaaacaatgaagagtatgaggaaagaaatatatgcattaagaaaaaaatagtccaatttctaacctgacttatttgggcaatgtattagtccatttttgtgttactataaacgaatacctgagagtgggtaatttataaagaaaagaggtttaactggcttatggttctgcaggctttacaagcatggtgccagcatctgttcagcttctggtgaggcctcaggaagcttccaatcatggaggaaggcaaagcacaagcaggcgtgtcccatggcaagagcaggagcacgagagcgagcgggagggtgtctcagactttgaaacaaccaaatttcatgtgaactgagtaggaactcactcaccaccaaagggatggtgttaaaccattcaaaagggatccatccctaccattcagacacctcccacccagcccacctccactgttggaaatcacattgcaacatgagatgtgggggacaaagatcctgcaaaccatgtcaagcaagattcatgacacctcttcttctaacataaatctaaatttctttttaacagggaaatggtttacctctggaatctttaatttagattcatttatagaaaattacataaaattaatttttaagaaggatacagaggcgccactgtgttgattgagaaaggaatattttggatggatctcagcattataagatgtagtattatattaagtactatattttcttgaatagtaatataaattttgcctggtatccttacagagtgtgctttttaaagtaaataaagcttcactggatcccctggaagatgttcttatcattgttatattcatatgtgccgtttgcttatggcactgctgtggtggaactaaagtgaaactgtttttatgagttttactgcaagtaaaaatggattcatttattaaatcccaacatactatttctttgtaaaaacaaaacaaaatttgacaaaactgtagtccatgttatcgtgtctaaagatggcccagtgttcattccggtgtttattatgtttctgtgatgacttaggcagcacctgcctgagtaccagaattccaatttggacacctgggatttagtgctttgcttactgtgtccctcccgacagtgccgacagtacgctctcctgcattcacagtcctgaatgatctgggtaccatatgtcttttctattagatcctttttaatcatcttcaacatcctattcttacatctagtctagtgttttccatagaagacatggagtataccgtcagtaaagaaaaatactcttctttcatgcaagccctttagtgcagcactggactttgaacagctttgctttttaaaaaaaaaatttcagggatgtaagtttcataatattataagatgttttaatttttctgtagtgtagatattataatggacagactccctacgtgtagtagtatgaatttgttaaagtttgaataataattatttgaattaaaaatttaatatattaaaatagttgaaatgaataggagtacctttaaattcagatacagcttaattcaaaagaaaaatgggctcatcactatcatttatttaaacgatcatttatttttaagccacctttgaaatattttttataaatcgtgtattccattgcatttttataaccaacatcaattgagattaacaagtcctttgttcaaaaaaacgaataaacctccttaagatgaaatttttttaagggaagtcagggagaactttattctttttatgtattttctatttatttatttattggagatagggacttgctctgttaaccaggctggagcacagtgacacaagctcgctgcagcctcaaactcctgggctcaagtgatcccccgtctcaacctcccaagtagctaggactgcagacatgcgccaccacgcccagaaaattttggggttttgttgttgttgttgttgtagagacagggtgttgccatgctgcccaggctgatcttgaactcagggcctcaagtgatcctcctgcgtaagcctcccaaagttctgggattacaggcactgaaccactatgcctagccaggatgaattcttcttatactgtgggcatcttaagttaaaatatctagtttttcaagtcttctattcagtggttttataacagaaatatctagacttccgtcttcagtggctaggctgcagcctagtaatttattcaggacttagcatttccaggcagctcttctcgctgttagctgtctcactgcatcattgtatggtattattcctccaagggtgtttgataagcatctgtgataaacattgattcattgttcccattgccagaaagaaagcattaattaataagaacaaattcaggaaaaggccgcttagtgtaagtgcctagttattgggagctatcaaaatgttctttgttctttatccttttacctgatttctataaaagcctgagttgtgggtttggagtcagtggtcagaatttgaagaaattggccactctctaaagatatgttcagctatcaatgactaattcttaggtttaacttttattaaaaaggaaaggaagaaaatctcagaaatatattaagatcttcaaaatgaagaggtgacatagcattcactgaaaatattaacttggaagctgtcatgcaggagtggtgttggctccttgggggacacttggggatgcctgagggtgtctttgctgagaattaccttattgtaattgcatctgttggttgcagttttgtagtcacaattgtcaagatttttctttaataatttgtcaggctaaggttgactctgagttcagatcctaaaggtcatagaagggttaaaatcataactgcctaggggggccagtagagttgacctgtgtatggatgagctcctggtgcagagagtgtggtgagaaggcacccactgtccagcttcaggcaagtatattacagtgtcacaaatcttcccatctcccctgagggaagggagaaatcttgatttctttactaagtgttctaactttttggttggcaatgaatcactttttaaagtatgtgttggccaaataaaatagatatccagtcacccgcatgtgattcttaattgtatttttaagataaaccaagcaggagacatttaaaaatcttctgtcacttacatgtctctggctacacatgttgtcttataccaaccaggaaaggacaacggatcatttcctggtcgtgctacccctttacccacgtgctcattcataccctgtgatgcatgcaaatggcaccactggcctgcatcctacttcgtgataactggttcttgctcagaaatccaagagaacttaggcatcagttatcttgtaggtgatatggccagatggtttggaataagtgtgcctcccatttctaattagagctcatccctgtgttctgcactgggattgctgttgactcctgttatttcttgctaatccaagctggaattcctctggactcttgttgagcctcagatagcaatatctgttagaatactttttctcataagactacagttaaattttgtggggtttttttcttttttttttttttcctacggagtttcactcttgttgcccaagctggagtgcaatggcgccatctcggctcactacaacctctgcctcctgggttcaagcaattctcctgcctcagcctcctgagtatctaggattacaggcacatgccaccacgcccagctaattttttacatttttagtacaaacagggtttcaccatgttagccaggctggccttgaactcctgacctcaggtgatccgcccaccttggcttcccaaagtgctgggattatgggcatgagctaccgcgcctggcctaaattaaattttgtaaattctgtttacatgaatggtctttctggactttgaaaacaactccgccagtgtaggaaagaggaatgggtggccctggctgtgcccacttctgcagatggttcccaggagggaagccagcccaccccagcatggctcctcaccctgagcactgagtgctggggaccacccgctacctcctcaacacaggtgaccaaggccggagacccagagatcatctaagaacaaggctgttgctaacacgtggctgatgatttctttatgtacccttttatgccgggtttgaggagtaagatttatctgagaataagtacatagcatatttccctatgtatccattcctctctccaccccatacacacatctttacgtgtgtttcaggaggtggggagggaataaaaatttaaacagtctccagggccctgaagtttctaaactgctaagtgtccaatccacagcctggcgagctgatgtggtcttggcatcaggctgcagttgtaaaaatgctctgctgcttctccaaacaaacactggagccctcagggcacatctaacagagccagccgtcagccacacacctgccctcagccagctctagcgccttcctgcaaccagtgtccacacgccccacgacagctagctcccaaggactgagccaatccactttcactccttggcaggcaattgctcaagtgcctgagctgaacaggcttagcttcaggatcagtttaattttctgctgtcctaattgctgtgctggtgcctggacttaaacaacctattcatttgaatctccaaacaacttcctattcatttgaatctccaaacaacttctaactcatgttccaaaacttcctaacttctaaagttgtgattttttttttaacctggaactttcaggatgctagcctgattttctaaattttgcctgactctagattaagtctagcttgtcgaatgttcttcaagaaacacactcaccattcctcagcttgccagtggtgaggtccagtctctttcaccgtataattagcgggaagtgtcccctgccctccttagccaatacccaggctgttagccatgtctctcaagggaagtctgccaagcacagaggacaatattttaccaaaggaacacagcataaataaatgttcttatcctgtgtacctttttcacttttatgatcaacactgatataaagaacaacaatagcattaaaattaactgaagttatgagtacctaagtagaatgataattcattatgtgaagagggtggttgattaatgagcaccattaacaagttcatagtttcagtggtcaaaattacagatctgattatgtgcagtgtaacatgctccattgattttcaagtactttttcctaacaccaacaattatttaaataccatgtgttctatgacttacacaattttgagttctcaaaaacatctttaattactatcctgaccactgtgttagctttagcactttttagttaaatcgaggacactagcaatcatttctctttcagatgttatactgctaattttagtgataatacgtgaagaacttgcaaccattaaaccagagctgtgtgcaagtaacaatctagttaagccagggtaaatgaaatagccattatgaaagatccataagttaagagagcaactaagaagaatagaagaaaagaaatcgagttttagattctaaaatgttgtttagtatcataagttgacctcactggatgagactgtgttagccaagaagtctcttgcttagttaattttgtgatttggcaaatacagtctgtaaaacatttttctttaacagcatgcagtccctttttaagtgtgcattcagtgaaaaaggttctatgctgggacccaaaaatgcagccctaccgccattatttacaaaaatatatttctaggtatatgtccaaaagaaatgaaaacagggactcaaacaaatatttgtatacctctgttcatgcagtattattcatgatagctgaaagttagaagcaaccaagtgtcctttgacagaagagtggataaacaaaaatgtggtctatccatacaacggagtactattcagtcttaaaaaggaaggaaatcctgacacatgctacaacatggatcagccttgaggacatcatgctacatgaaataagccagtcacaggaagacaaatactgtatcattccacttatataagtacctagagtagtcaaattcatagagacagaaagtagtatggtagctgccaggggcttggggaagaaggcaatgaggaattgatgtttaatggctagagagtttcagtttgagatgaaaaattagcgagacagacagtggtgatagttgcacaactatgtgcatgactcaatgccactgaattatacacttaaaaatagttaaaatggtaaattttaagttatatattttattacaataaatatcttctaaggccaggcgcagtggcacatgcctaatcccagcactttgggaggccaaggtgggcggatcactaggtcaaaagaccgaaaccatcctggccatcctggttgagtggaaaccccgtctccactaaaaatacaaaaattagctgagtacggtggcacacacctgtaatcccagctactcgggaggctgaggcaggagaattgcttgaacccaggaggcagaggttgcagtaagcggagatcacgccactgcactcctgcgtggtgacagagcaagactccatctcaaaaaaaaaaaaaaaagaaagaaagaaagaaatgttctaatactggtagagtgatttagacaggttttgaattcttggcaccgctcatcattctaatcaatggtcagcctctgagcattggagcactcagtggtacttgtacacttggcttgtcatcaagtgtttcccttttagactgttaggccaaggatggctaagaaagttactgtccagccgatagcaagagaatatttatgttgttggtacatgtctaccagagaccacagaaatgcacaaagctacatttgaagcatgtcaccggcagtattccagcattattactgacagtggtgacagtgagaaaaccaaactgccttgaaaaaacacctcctgaattgttaccacaataccccagagttaggcagcgtgtaccgccaaaacactggtgatgcccagattcttgcagtctcaagtgaagaaagcaatatgttctgctgcattatttttaggcaccagagagtgaaatatgggtagtgtcaggccagtcgcttccatggctatcaatttttgatcttctttactagtaacagtgagggtggcacaaattatccatggacagaataggaatgtgcccagcattctggaagcttatagtgcttcaaatcaaatccacacagctccccacgtgcagaattgtgcagttccccccttatgggcttgattttttttaaatgtaagaaaagatattcagcatttgctacctaacacttagggctcgggtccctctcagttgaatgaagctctaattatgcatcttgacttattctgtagtttctaagtagcctttccattcagggtattcttgtggctgtctgtgaactagaaactcacagagggcaggagccatggcttgatcatgtttgtctctcccattcctaaagcagactaagcacatgataaatgtttattgatccactgcagaaatgagtgaataaacgcagatcctatctatgggagtgccttggtgccttgcctactgtgtggtttctcctcccagctctgagaagtggcttggcggactccaacctatgcgctttacgtcattactgaggcaaggaacaagtcatactcttgcttcccacttctccctgcaacccgctttccctgggctgcagcctcttttctgtaattgaagtcaccttgaagaagaccatgcccagagcatagaattttgcctctctccccatgtgaggaccatatatgtttatatttattatgtgtgacatctgtaaggaacctattacagagcccttccttccttcaaacaagtttattaaccagcagagataataatgaccaaatgaaaaataaaagccagatttaccttgcataatctaaattaataataacacatccatgaacaaatgtcttgccacttgtattatttattacttatttggtgatgatgatgacagctaatatatattaagtgttaagcatctgcctcttactaagccctgctgtaagctttttacgagtattatcactgtttcgctttgtaatgactctgtagcacatattctgttgtcctgttttacactcaaggaaaccaagactgagcaaactaagttgcttaaagttgcatggtcagtaagcaactgaaccaaggggtaaagccaggctgctggtctccagagcttccactctgagccattatgatactttggttgaaataaaatagacctaggcaaagatagacacaagatctacctgttgagctggaaagaaagcagctgaaaattctgtgacttgaattattatgatactcatatctctcccttcacccagttaataaaagaagcaccctgcaaagccaagtgtgcaggctctaagctactcttggacacaggctctgctcacttaaggtcaggaagcagagaggagacctgggtgcctctggctcctttggaagctcctttagcatatgaagcatctaagtaggcttgaaatatgccacaaatgaatggtcatcttcacgcaccaatagttttcaagcctccatggtatgtgtgcatgttgtaaaatccacattggtgcagcagcctgtcttacccacatgcggtgactctttccctcctcctatctggtaccacatggcattaggccagagactcccacaaacaaagcctgttgttgctttgtgtacacttcattgtcacaggggaccaggctccacacttctcagcatcactcttagtggtttggctcaccttggtgactcaggagtcacagttaacatcatttccaacccacagcaaagactgggacttgaaatttcttctgtgttcttattacttcttccattgtcacttgttagattctgagagaagcaaataaggctgcccgtctgtggatggagcaggctccagcgcccttttcattgtagttgtacctctgaggactaatgaggagtcacttgcttgtgttcttggaagcatctgtggtccaaaggcaggaattctcaactctggactgaaaagatgccatgcagcaggaggaattgcactttagcaagtgaaatattgtgggcttgtgaacccttccttcagaaacagacacggttagtatgtggctctgatatgggagcagttggtgaagatgaatgtgatacagcagttcctgttctttgcccctgatgatgcagtgtggcacctgatgctgagataagtattatcttccagcgatgtcgcgaagtggcatgttaagcctttatggtgatttgttgcaccttgccattttggctggcattagagctctaaactcattttcttcccagctttctgcccttgcttgtgtattcccagtggtatttctcattagcattatcttctgttaagcaggaaatggtctctgcttctcaaccctggacaatgctgagtatgtttctagcgctcagttaaaaatatttactggcattagtatgccttttttcatgtatttcaatattattttactttacgacagtattagtattagtctgaaaagtagttcctgaaagttgttaagtatttttacataaatttgacaaggacgtattttcatttttaatcacagctaatcttagttttataccaaaccatttggttttcacattaaaccttgcagctccagaccactttatagccaaaccaagtaataggaaactggcagggccttataacatcgtttgtaattgttacaaaatatgctttgaaatatcatcataaatatgtaaaattaaagttagcaaaaataagtgtatagactacatttggagcctgtgatacccctgattttaatttttttctctctctcactagcaaatttgctaaatttgttaatttgtagactgtttcttcttaatttgtgagaaaaataagttagttccatattcacttttcttaaaataactgttttctaaagttctgtttataagtggaatcaacactaaattatttgtgttactagaggagaaaagagatccaactaaaacaatagataatcacaaattgtttagatactaaaaaagtgctgaattttgtggaacaaagctgatttatggaccatctactcctttcttactataaattgtatggagcaggatttaaccatctcaaacctacatagtgacaagtatctttgcaatggaatgcccctcactgggccttatcatggtgtgttcacacctttacttatagcacagactccatgccatggtagatagtttatgaagacgagtttttgctcacccataatccagattcactataatattatgcatgtaagttctgcctagactcaatggaagaagttaaattaaatatattgccttcctgtttgactttggaattaaatttctctataaatatcttatcacgctcctaggagatagtttccttagataaagaaatcttgtgagtgaaaggaaggaaaatgaaggtggaaaaggataaatgtcatcgatatagcacaatgagaaacaccacacctagcaagaagagacccgagtcctattttctccaaccattgtatattcattttctttctcttccgctcgaaaagtgaatttaaaaggtcctatagcagtatatcacagacacatgttaacaaatggctgcccaaaaagttacatcttcaaaaataccatgttgatttgggcaaaaaaaaaaaaaatgcttatcaaattagtaagacaaaaccttttgctttttgtggcagcagttgtgggggtgaaggaaaataaaaataataagtctaaaagtaataggtctacttcccctgttgccgagtacactctctgaacacttcataaagtgtacctccatgtagccttttcagatagcagtgatttagacatagaaacaacattatcagtaacaaggaagaaaaaaaccttaattgtctaattgatggctattatgagattccgtataattcatggaattggtaagaatttcacccaaggcaagaatttagcatggtgtatgcgtgtacttttatttagtcttcaggaatcacatggattgattgctgatgagactattttttaactaccaagcatatatattcatatatgctcaatggatacaaattttccaagatgttatttttttcttaatgttgggtccattttttcttctgtaagtactcatttctgaaacaacagtgtaagtaatttggaaacatgatttagtatgcaagtattcactttacactcctgtcttttggaatgcatttgatgcacatatttgttcaaactaaataaggcaaagaatttaaagagctagaaagagtcttggagttcatctcttgctaacctctcattttatagatgaaaaaacagaaacccagataggttcgatgcttctgttgggtgaggggaaaacccacagctgtgaatcctaatttacagtttctgcacacatttctttaatgtgacttttttgatgactgcttaacagagtgatgtcagctatgctaaagtcctgacatgtcagtgacaatacaaggaccacacgatgaatttgaggatatctgtatttttctggtacagctaggtgggctcttttaagacagaagtcttaatctgtgagagcctcccgaaatctagagaaagttctcagccaagaaaaggtcccggtgtgattgatggctgtgctggccgcacagttatagtcagttacagtccttgctccttcaaactatcaagcagtaaatttgtaaatgagctgagcgtttgttgttattaaagcttcattttaccattctctctgtgcaacaagcacttaacattgtacttgctcaagggttaaaaaaaaaaaaaaaagcatccctaaattatatataggtagtcttgggcctataggtaatctctttggggcttttaaaagaaatatacaaagattttcctacctttctgtgtattcttacaaataaatgttaagactcatggcctggggaaggaggagaaactcattaagggagcaaattgcagggagattcctgaagaatcagtctctgagccagtccaggcactttaattttgtctggccctggcattattattgtaactgagtagaaggccatgagatcatagcctctccatagctcccgatagccatcaaaggtgactggcttctattacttttgaagtgacaaccacatttgaagatggtatagactgaccactgattgtcaaaactagtccaaaataaaaccattcatccatacttacttctgccacataacttgcagatgccctgcagcaaaaataaattagctctaaattttctgttgagcacagtcttccgatggggcctctgtgtgaatgttcttcagtcattttgctgagggctaagagatgagggtaagacccttgggctataggagtagctaaaaactgaaatattcccaaggaaagattctacattagattcatggataattaaggcaaaacacaaatctcattcattctggacctaaataaccttttcctgctagagaactttttttaaaaagttgcagtgtttactgtctgaggaaggcttataaaggttatgcttcttgcatccagaatgtgcagaaattctacagctataaatgtctcagcagcaaatgggctgtgtggcatgctacagccacagcctgctaggtaatttacgttgctcagggactgtagtttttcaatagattgaactgttagttttcaggaggatttaatgaaatattgaaccagatgccactggtctgccatagatgtgggactatgagaaatgaggaaatgtcactctgtaaacagcttggacctctgtgagtaggggaaaaaattgtgtccttagtgaaagagaatcacaaccaagagaaaacatggcagtttgggggtaaatgtgtttgtttctatgtccatgtcctgtgttcatttaaaatgggaggctgggtctaggacggagatccagaaaaattgtctgaatctggagaaagctaaatagaggctgagatttttccgagtctttcttgttgtccagtggtaatcctctgaatggccctatacagatgctcctggacttttgataggattatggtccagtcaacccatcataagtaagaaatgcagttattgcacctaccctacccaacttcataggttagcctagcctcccttaaatgtgctcagaacacttaggttagcctaagtgttggggaaaatcatctaacacaaaacctattttataataaagtgtggaatatctcatttaacttattgaatactgtgccgaaagtgaaaaacagaatggttgtatggatactcgaagtacagtttctactgaatgcggatagctttagcaccattgtaaagtcggaaaatcataagtcagggaccgtctacaattgcttttgctgtattctcgttttcagcaatataaagacatacccgatactgagcagtttacaaaagaaagaggtttaatggactcacagttctacgtggctggggaggcctcacaattatggcggaaggtgagaaaggtggcaaagatacagataaagcactgttcctgaataacatttcaagtcttgacctttttttttttttttttttataactttacagacttacctattccctgcaactcattcagggtatagatgatcttgttttatggtcttgctgcaattcatagcctgttagtagctgtgtcttcaatgtactgggaaatttatctttgtacaggaaggcactgtttcaagacccagagctgtgttcctcaatagtccaaggaacctgtctcagaatcatccgggtacttacaacagtgcatacttctttgtcataccccaggcatattgaatcagaatgcaggatggaggaatctatacaagttcccccagtgatagggatcctcactgatgtttaacaaccactgctccagaggggtgggccagctgccgacatttcttgtgtcctaattgtgaggaaggttcttaaccatagaatgttaatgtaaacacaagaaaaaaaaaaaagaaaaaaaaaacttctgcttaacctcagcccatttgaagcagaaagaaaattgcagggaaacccaaatctgtggtcctgattctgctgttgctttaagatcatctcaccagcaaacaccatggtttggtctcgaaagggtcccagatgaactaactcacctggcactgtaattaattgtaccagagtatgatgatgcatgaaacaatgttcactgtgtgtatgtatgtatatctacttacatatacacacaaacacatatgtttttcttgtgcttatttaagttttcatctttcttaataaggaactgtactcagttcagggattaggagtggtagagagacatattgattcattcaaagaatacttgagatgactacttactcaaagccctaagctaggtgccgagtattatagtctaagtggaaccattaaccatgtacctagacaattttagattgaaaatgataaaacaccataggatgtgtgggtaaaggcttcacaagctcagagggaaaactggctttcagttggaagaatttggcaagaaggtggtggcaattatgttgaaattttcagatataatggtaatgatatatatgctgttggaacaagtattagcatatgaatgattattattttcacaatatttcttaacacttggtaaaaccagcagagcatctattttgctgtgttagaatcgggccagggtcagacaaataatatgagtcaatttataaaacaaataaaagattaaatatgactttggaagtaaactcgtaactgcccagtgggttcttgctgcctgctgcacagataaaaccaattcactgagactgtggcattgcaataaagaaagagcacaattgacacgaggtcggctatgccatgtaggagacagagttattattcaaatcaatctctccaaacatttagaggctggggtgtttcaagaatagcttggcaggccagagagtctgcttctgggtagggccacaggatctgttggtgggtctgtgtggggcatgggttgccagcaatgcaaaaacttcaaaagacatctcaaaaggccaatcttaggatggatgtggtggctcacccctgtaatcccagcactctgggaggccgaggtgggtggatcacttgaggtcaggagttcaagaccagcctggccaacatggcaaaaccccatctctattaaaaatacagaagttagcctgtgtggtggtgtcgcccataatcccagctactctggaagctgaggcaggagaatctcttgacctgggaagcagaggttgcagtgagctgagatcacgccactgcactccagtctgagcaacagagcgagactctgtctcaaaaaaaaaaaaaaggccaatcttagattttacaatagtggtgttatccacaggagtaaagggaagttgcaaatcttgtcacctccagaataatggctggtaaccattttcctttacactttagcagaattctggctcttcatccccctaacctggtggtctttcattagctttacaaaggtggtttagttttggggaagggttattatcatttaaactataaaagaaatgtctcccaaagttagcttggcctaagtctaggaataattaaggacagtttacagcttaaaggcaatatgggggttggttagctaagatctctttcactgtcatagtttcctcactgttataatttttgcaaaggcagtttaaaaccaaaagatcagagcaaagacatatgggtttgaggttttacaatgtaagaattgtaatatattatagttgatttgatgaaagaattatcaaccaagcagtataagcacaatactgaccaagtgtggaggattattgagctcagaaatagtcatgcagtaagaggcgagggaaatctatagggaaagtgcaatttgctgtctcttattaaaataaaaatatgccttgctacctgagtaagaatgcacatactttttttaaaaaaaatctttgtcatatgactgcctattactgtttgaatcataacctccattgctgctttcattcaaaagaagccattaaattcacagacttcctgcatgtgcccagtgtgtgaaagctttaattaaatctacaagtagagccttaaaagaacaagaatcaaattaattgcaacatggtccacgcatttgtctctctgacagtccctgtgctttggagaaaaggcaatctgtgcactcttatctgaattagtaaactcaatatcactttccattagcatggccagttgctgccatgtgtcttctggctgacactgtttacatgctaatgccctcacaaatagagtctgttccaactggtttgctataggattctggagcactaaatccaggaggtggaatatgctgtcttctgctttctgcatcactggcttttgtgagttctctagattgagcttcgtaattagactgcagactaattaaggaaaattcaccacatgcaaatagagcaaaaggatttgctgctaattatggttcttatgccatagtcaagacaaattaatttgtaatattattattcaactttttggtggcctgcaatagtgtaaaataaggaagtgatgtttgtgcttaaggaagacttctacaactggagtgaataaatattcaccccatgaggaaattagaggtaaaatctgtatatttgaggttttagacaaaaaagactccacaattcctatataagcttcagtgtataattactttgtttttatttttgttttatatccagaaggtactgtttcttaatatgtcaatgctataatataatcacaccggcaatctagaaatacctacttcccaactttcagcatttaaatgggagtttaattcaacagtgtatgattttcttgtttttaaaggcttcacctatgaatcccttaggccaaatgtttaaagctaatgaactgtagctcgttatattctgcttatatgagggaaatagcctgaagcagggtggcctggcttagtgtgctgagtccagtaggcatcttgaaggtaatttcgttggttgcacatagtttagaattataacaaggatttctgccttgaaacattacgtattttagcgtgagaattgtctcaccggcagagaattaggttttcttgctgaaaatgtaaagcagatttatttatgaactgtctgccccatgctgctgttttctgacttgcttctcattccttagacgctgaagcctaaagaacaagcatgtgctcttcttatgactaaaaagtggttcagaaagcagcattttaagagttaaaggctttgcattgctaactgagagaagcagtattcacaaagtattaaaaattaaagatttagtccatctaatgtcaaattgggaaatttaaaaatttatgagcttatattgttaatagtttcctgagggaaaattcatccagtatttggagcgattaatgaattgcttgttgtatggcagtataatagagagagagagagagagagagagtacagttagacataatatcgaagttatttttggaaacaagctaacaaagaaggctgtgtaatctctatctactgcaatctcaaaaaataggccgaatagccatctattgccagtgatttcagagggatgtgcctgaaggcagggagttggatctggtgacttcttaagtcctttccacatctctcattcccttaattattcatcaaatataaacacagacaatgtgattttctttattcacaatgtccctgtgtgaaaaaatatatgtatacatatgtaggattcagtactccttttatagaacattgctgtcaactattaagcttaacccaaaagaaagttctctgttaataagagaaccaaagtgcacatcatccccaacaggatggcaatttatgatgtattttgatcgtccacatgacttgcaggagagtctggaagaaaggtcatgggaagattaactgcaggcgcacccggttggtactgaagcaggattttgctctgattagcaaagcactgaaggccagtcagggaaaaagatcaaggtcagtgaccttccagaagggaagtcaacctcggcaataataaaggctgccactctgtcaggactccagtctcatgcagagttggtgactaatatccttcactctagcttgaaagccctgttgacagtttagttctaattatttgtggatcagattgagcagaaatacatctgcttcttttctatcttgtcttttgaccctccttttttctgcccttttaaaaaatgtgcactgatttctcaattatgtttttacttttttcatatttcttctgtcaaccccattttctcctgcctttctgaggggatgtgttttcttattacttgttcaaatactgatgccttttggaaaaagctaaatgacttaagtattttttaacctttataaaagtatgagaagcatattcttagaatcacagtgtacactttctcagccaaccattcaaccaataaagtaagtagtttctttagtaattctttgcagtttccacacctctttgtttattcattcaacacattttttgagaacctactgttaaaataaaaactttagacaaattaaatttagcagagtttaattgagcaaagaatgattcacaaatctggcagccctcagaaccagaagaggttcacagagttccccttcacaatgcgagacagaaggcaggtacagaaaggctgggctggttacagcagtgtttcccttatttgaaagtgatctgattagttggttcctgtgattgacggaagctcagctgctgtgattggctaaggcttgttatacttgttacaaaagtatactcctcttagcagcagcaaatcagtaagtgttgggagcaacctcaattcttgcctcctcagaagaaagaattcaacccaggggcataaggctgagtgagagaatgaggcaagttttagagcaggaatgaaagtttattgaaaagctttggagcagggaggaaagtaaatagagtacatttggaaaagggccaagtaggcaacttgagagggtcaagtgcacggtttgaccttagatctggggttgtacatattggcatgcttccagggtcttgtgtctcttctcccctgattcttcccttgggatgagctgtttgtatgcacagtggcctaccagcactggggaggggctgtattcacagtgtgtttactggagttgtgcacatgctcacttaagacatttttcccttagcagttgaacaattctagaaggtcatataccagttaaactctgccactttgcctcttagtgtgcatgcttgagcccacttgccccactcctgagatcttattgggaagctgctgatcaccagtttcagatgttgggtgcatggagttgctagccgattctagtatgtgcctagaattagaatattaatccaaatttttacattacccaccctctcgtttcttctgagctatagccagagatcattggtttgttcacaggaataagcaaggttagtctaaattgcagacaaaaactcaaaaagaactgatgagactagaatcttttaacaggtttgccgtcattcttgaaacacaatttttctccctccaatctccattttcattaaaaacaaatcatgataggactgatttgtttgcaaaataagctttagtcttgttatacttggcctgattatttgcataaatcacagcaagaataattatttgccacataggctccttttaaaattggctttgatgggctgggcacggtggctcatgcctgtagtctcagcactttgggaggccgaggcaggtggatgaactgaggtcaggagtttgagaccagcctggccaacatggtgaaacctcgtctctactaaaaatacaaaaaaaactagctgggcatggtggtatgtgcctgtaatcccagctactcgggaagctaagacaggagaatcactagaacctgggaggtggaggttgcagtgagccaagatcgcatcactgccctccagcctgggcaacagatcaagactccgtctcaaaaataataataataataaaataaaaaataaatttggctttgatggaactttgttccattaggatctcagataaaatgttttaaagccataagcctagctgtgggtttgtaccatcaaatacctgtatgagttgggtacattcctcacctcttaaggtcccaagataacttggtgctcctaggcctgtgagaaagtgatattctttacttaccacaggtcaggaacactgtacagggactgcatacagaaggtatgaggccagctttcccaagggacttttattatctctataagtcagatttgattccttaaaggaaagcatgccattccattcaaagccttggtaaaacaaccagtttctccaattgtgtcctgctgcgaaagaagtcagattattactgcacttatgcaaataatgtaagttaactttttcttgccacaagttaagaatacacaaaaatagtttccaaattctggagaaatcaggtacagagaaacaaatatgctccaaattttgtttgtaggaatatactttactcaattgttaaaagctctaaatggaaggattatttcagtcttctattagttcagtccatacatttaactcctgttctacttgatattcatgacacaccattcttggactttctgacttgtcctaaatatccctcttttttttttttcttttcttttttttttttagatggcgccttgctctgtcaccagactggagtgtagtggtgcaatctcagctcactgcaacctccgcctcccaggttcaagcaattctcctgcctcagtctcccaggtagctgggactacaggcatgagccaccacacccagctaatttttgtaattttagtagagaacgggtttcaccatgttggccaggatggtcttgatctcttgacctcgtgatcttcccgcctcagcttcctaaagtgctgggattacaggcatgagccactgtgcccggcctaaatatccctctttttaaacaaccagtcattttactttaggacaacaatttaccatacaagatcctttctcatataaaatctattttctttataaccttccttaccaaaaatacctctttacctttataacctttgaattagacaacagtcattttccttctattaggaagtgatggtttgtactacatgttgctgtgtgagtcctgtgtagggaaagcaaatgtggaggttatctacgtactgtgactgctaatgtgagccacccgttggggtgacctgaaaaatcagcttggaagagcagaaccacagtggccaagaggaattgttctaggggttgattagtaagcaggagagtgaaagggaggggaaaaaaaacatgtatggaggttgaacacctgcagccaaagaaggcaaggtgtagaggtgtcttaccactggggaatgtatcagagtcatgtggcatcaaagtatattaccactagagaatatatccaagtcatgcagcaccaaagtttgttagaagtagcaaatctgtaaggatctgcagcaacctcagttcttgcctcctcagaagaaagaatttgaccaaggagcataagacagagggagtgactgtggcaacttttagagcaccagtgaaagtttattaaaaagctttagagcagaaacaaaaggaaatagagtacacttggaaaagggtcaagcgggcaacttgagagagtcaagtgcatgttttgacctttgacttggggttttatacattggcatgcttccaggtcttgcattacttctccctgattcttcccttggggtgggctgttcgaatgcgcagtggcctgccggcacttgggaggggctgcatgtacactgtgtttatgggagttgtatgcatgctcacctgagctttcttcccttaccggttcattattcctagaggaaggtcatataccagttaaactccaccattttgcctcttagtgcacatgcttgagcccacttgcccaaatcctgagatcttattaggaagctgctgatcaccagtttcaggttttttctgtctactgggagactgccattcccatgtgccacctatgaccaattattattttagtgagacatttaactacttcctgaccatcacctgatggtcgactgatgttcttagtttgatggcgggtgggggggccctctcctgccctacttgtgtctgactagctacctactgtgacactcctgagttaggctttcagttaatttactgctaagttcagttgcagttggttaggaaaggactcaagtatggaggcatactcaagccaaatttagtttagttaactacatgtccgacactgttctagacattgcagatatagccatgaacaaaacaaacagaaatctttgcccttctggagatttgaaagctatgtcagatgttttactctgagcgatcatcaaggaggaaaaagtgagaattgagagtgattccatctttctccaagtgtaccccgtcttttttattttgggtaatgttggttaaattaacacagtctgctaaaaccaggccatagaaagcgtggcaattgctggaggcaacttctgaggagcccactttggtgggcagagtggcttctgctgagcctatcacagagggcggcgacctctgcggatcacgcacatcagagcctcactggaagcctgtgttcctctggaagtagacgagctatccatcctgagactgaggggcgaaaaaggaaatgagcctgaaccagactccacggaccaaacaaatgaccaagtgccagaaagccttctgtcttgggcaactgtacttctgccggagttaatagcattttctgctgcttgtgcatcttagaagagtaaaatcgttttgtgaactatttccacccatgacttctcatgacactcagttgaatcagacaagctgagggtctctgagggaagatgaatccgcatcaggctttccccagcttaacagttcagaacccacttttccttcatcggtgctggcagtgttgcaaagataattctcagctcttgagccctttaaaatatttagctttttaatacgtgaaaaaaaaaaataccttaaaaaagaaaaagtggaactcaaaggaaaccccttcttttaaatataatggttcaattttaagatgaagatgagtagcatttgttgggggtctttaattacgctggtctgtggcttaccttaggagctagctgcctttgatgctttcagttcttattctaatttaactatttttttcctatgccattattgtaccatgaaaggaaactccctcataaacccatcatattgttcactgtagagaagcagcgtgtgaatatgtttatagttgctgaatatattcaaaaatgtcttttttatatgattatggtcctgaatgtttatttttatttattttattttattttttactttagcttcagagggtacgtgtgcaggtttgttacttgggtatattgcatgatgctgaggtttgggcttctagtaatcccatcatccaagtggcaaacatagtatccaataggtagttttccagcccttgctccacaccctccctcctcaagactctcgtatatctcatgtattttgaaataatggagacattacgcaagctaaacttgagttcattttaaatattttaagctaaagtgacctgtcatgaatgtcacactagtgatagtacccttttctcttgcacttatttgttgctaagctgacttccaaatcggaattacctaaaggacttttcagatatatagatgtctagcccacactttgaattgcccaaatagagaataaacaggaatctttatttttagaaagcatcatagttcctacttggggaccactattgcactctactcaaaaatacatactgcagctgtaaaatcactatgattaaattataactttgatcgctttcttgtctttggaaaactaatacatgtttattataaaatcttgactcatagcagaaaagtgccaagaaaaaagtaaaataatctatcatctttccctgcccccaagtgctgtgactgctctgatgaccctcttttcgtatagcactgtgagtgtgcacgggtatgcatctgtcagtctgtctccctgttggagggagaacagtgctctatgtgcgtttcatagcccattgtttttcgcgcagtgtgtcacaaatcttgccacaccaagagttgtatttaacgatgtactgttaataatccccccagactcagctacagttaaggttgtagtcacacagcacttataattagataagtttacttttgtttcaaaactttctttgttttcattgtaagtcatggacttcctcgtttccaaaacctaaacaaaataaaccatagcttctaaatggatttagacattaaaagccttctcaagtatgtcacttttttttcttgattaaaaatatttaactcttacaagttatttaaatatggctaaattctgttatggctaaaatcctaattttttattttatttccaaagatttgatgctgtgactttcttatcagaatcaccattgttgctcataatataatcaatcgggagagacaaaaaagaggcaggaaagcggtgaacttgtgatgcgatgacataaaggaagagaagctaatgctgtgttgtttgtcctgcaatatctgcttcattttgctttcagcagaggtttcctggctgctttttcctcctttctttgcccttctcctccttcgttcattctccaggagcctcgtacggaatctcattcatcctcagcaggaatatatgtattgagtcacattccaggcaccgtgttaaccaatgggaggaataaaatagttaaccaatgggaggaataaaataaagtaggaggaataaaatggaataatcaatgggaggaatgaaatagtcaaagttgccaccctcatgaagctgtcagttttggggagactaaaaataaacaggtagacaaagggtattatgtggtgtttacatcctcaacctcagaggtgatttgtcccaagtctaggtggaaccggcctgccacttgggccccaggctgtctccagctcaggaaatctgacatggggcacaggtggccaattctggcccatgagtagaagtccactctgggtctgtgaaggatgacttagacttctgtgttctatccctgtctttatgctgatctcccaagatactggaatgaccaggcaaccactttgaacttgaatttccctgtactgcatcctcttcctcatcccaaagttcctgcccaggtccacacccacactgccaccctaaccagaagatcttctgtcccacctgctccctccgtttctttgcacagacacagtattcaagcaggcaagttcatggcctgccctgctgaagtggacaatctttggtcttgagctccagcattttgccattctggagcacgaataaatctgtttcaagtttatttcatcttctctgtttcactgattggtttgatgtgttttatcctgctgcaactatgtaaaaggaaagggatgtgctgtttttgaaagtcagagggtaaagtcccactgactttaatgataagtccattaaaaagatctgtcctgagagtcttggataccctgtcctctgtgccttcagaggagacgagtgagatgagtgaggttgcacagaccccactggactgttgggtggagaagagaaggggagcctcggcccgagcccatatcataggctgaaacatagatgtaatgctaagaacaagtgacgaaggtttaatgacttattttactttaatatataccaagaagctaaggaagacaatttgccctaatctataacactggcctaaagctgaacaaatgcctatgctgaacaaatatcatttttaggaaaaagttatatgaggatttgccctatgtatttaggatttatttttgatgtttaaccttttttagatttttttcagttcttaaatttttaaaagttgtcacctaccacatgagtgttagtaaagagtgctgagtgagagcgtccctttgtcctagtcctctggtcctaggtccaggctagcctcacagatagcagttgcccaggtaagacacctgaaagggtcttgccacgggccttgaattctaatgcagactttcaaaggataccactttctttcaccaagtataatctaactatcttgttggttttctttttttaagagtaataagttagttgctgtagttttgagatatattaacagcaaatgtactttgccaatgagtagacaatggtatattttacatgcaaagatagaattaaacccactaatttcatctgattactaattgttaaaaaaaataaaaaaaaaagatagtttctatccttctatccatgccaaatactttcaaaatttgtacatgaccatccagacatccatctctcctgtagggctcagctctctgtcctctagggtaaggctggctgggtattcttgcaccctgtgctgtgcaggccacacttcaccaggccccccaggagccccaccaggaggcaccgcatgatctccatattctacacgcgtaaactgagacacagaagctgatcaccttgctcggggtcctgtgactagtaggagtggggctggggtcgcgagccaggcagtgtggtgtttgggcctctgccctgaccagcctgcctcctggtagttgtctccctattcaggtttgtcactagacattaccgtctggcacagggcctggcaggtcagtggcctcaggtggctctgggtctgtggccaccgtacagagcgatttgaactgttcatctctatgacccgtctttgtgtgtcttgttaatagatgtttcccagggagtatatgagttgcataaaaacatatgttccttttgtgaaaagtttctctaggcaggcatatggaatagagtgtgaaaatcatgtgaccactggaggcctagtgccttcacctgaagaggcaaaattcctgggtaacaagaatctacagaggaaaaacaaaataaaatacataggtactatgttaacgtataaatgaaatgtgtctcccaatgttgccccttacctcctccatacacagtcctgttccccagggggaaatctggtttctaaatctggaaaaggaagtatatttacttctatttgttatttgttggacattttgtgaagagataggaaagaaatattatgcagaatatctcatttgtaaaaagagagatacacagaaggtttttaagaataaaaagtattggaggctgaggcaggcagatcacgaggtcaagagatcaagaccatcctggccaacatggtgaaaccccgtctctaataaaaatacaaaaactagctgggcgtggtggcgggcacctgtagtcccagctactagggagcctgaggcaggagaatcactagaacctggaaggcgaaggttgcagtgagcggagatcgtgccactgcactccagcctgggcaacagagcgatactccatctcaaaaaaaaaaaaaaaaaaaagaatgaaaagtattttgtttctttgtaagctgaatcaccccatcttgatggtctgtgactttttatttagcttaatatgtatgagggctctttccatgttaaccaggatatattgatctacctcaactttagctgtagcttcgtattttaacattccttttttgacagaaatgtgggcaactgccaggattttcttctgctttgtttctgctttcagagcaacagttgccctgcactcttgtgcatggccctcaaagctgttctttcttgccagctctcacctcattttccacatagcactaagatttgaaccaaggctgagagactccaccatgtctgtccagccactgtgttgcactcatgtgtcaggcacagcgcaaggtgacatgggggaaactgaggcagaggcattcctgcccttctaggccttacatttgaggttcaaagacatctagatactaataaaataatcacaaatttaaatgtacaaatgcactgtgacacaggtaacagaggagtgacgtgcatggttctgtctgcaagctcataatagagagattgacttagagtgggcaaggagggcctcccttgggaagattttttttttttttttgagacagagtctcgctctgttgtgcaggctggagtgcagtggcttgatcttggcgcactgcaacctccacctcccagatacagcaattctcgtctgtcagcctcccgagtagttgggattacaggcgcatgccaccacgctgggcaaatttttgtatttttagcagagaagggttttcaccatgttggccaggcaggtctcgaactcctggctgcaagtgacccaccctcctcggcctttcaaagtcctaggattacaggtgtgagccaccatgcccaaccaaaggatttgtgtgatagctacaagcgaaaaggagttaatgagatgaactgggaggtggagcattctgtgctgtggaagcaacatctgtcttgggtctgtggtgggagggaatatggtgcatctaggggctggagaaaggccagcaagagagcagccactggtagagcgggcaaagcctggtgggcaaggcggtggcagacgtgggctgggcctgaactgcctggtgcctttaggtcaggtggaagagtttccatgccatcttaagtagcgtagaaacctctattgtgttttaagtaagggcatgatgtgatcaaatttgtgttcaaagtgctctctggtaacagtgtggacagcacggaggccagtatggcttcagagagatcagcagaaaaacgttagcaagagtaggtgagagcctagactaagttggcaacagaagagatggagatttaagaggtgaagttaacgggacttggatagagccagctgtacaggaggaatagcagtgacggcaaccatggggtctggaaccttggcccaccatagagtgtacaggctttgagttggtttcatgagattaccacatgttttttaggaattgctttaaccttgaagagcagttccactgggcacatcaaataatacatcttgctcattccattcgccttttggagattggtatgcagatggcaactgcaaatgcttatattaaacatcgtatttttttctgtttctttccagtcattcttaaaagcatacaagcttctcattccatgagctaaaaacatatttcattccataaacagaagaaactatgtcagaaattgtaggctcctaaatctcacaaatgaggtaaacatacattaattgtttctcagatatttatggagaggcagaaaggaaatgttcagtagtatctcacttttaaaaggtaaaacaaaacaaaaatccagaagcacatagttcagcgtaaagctaatcacagttgtgcataaaatttgaataccatgtagtcagaggaaaggctcctcccatactgtggacaaaggatgtacacagctgaaacctttagtccttccctgtggcagcagccaacattttgctgcattctgcagtactgaaccaactcatcattttgaagcaagctccctgggaaatatgtaagtgaataatgctgctctgtgatgaatcacggactgaacacttcctgtatgtaacaggtggtgcgttaccatgatgtccgagaaaatgtccagctgaaatactagccccacaccgtgacgaaacgcacatagagctcaggctcagacctattgcctgtgcccagccctggaaagacagtgaccaagtaatgccctggtcatttaaatttgctaagcagcaaatgacttattggtgaagaccatcaagttgatggttttattgtaaaatttttgttagtttcactgtaactagattaaagagcaaaatataattttcttaaaatgaggggctgtgcttcagaagaacctaaagaggcttttgtgtgtgtgttgggggtgggggagttatgtttaatacagagatccagactccaccccagacctaagacctacctgacatcaccagagatgatgtaaaagcatgttatttgaaattttatggcataaatataagtcataagccactggattattaagataacagtggccacattcaaccagtttttcagaaaatacttttccaaagatggctgagtataaattatttttgtatgtttttcattcatagatctcagggttgaggctgggcgtggtggctcacacctgtaatcctagcactttgggaggccgtggcaggaggatcacctgagcccagaattcatagcctgggcaatatgacaagaccccatctctacaaaaaataaattagccaggcatggtggtgtgcacctgtggtcccagctactcaggaggctgaggcaggatcacttaagtctgaggctgaggcttcagtgagccatgctggcaccactgtactccaatctgggtaagagcaagactcgtctcaaaaaaaaaaaaaaaaggtctcagggttgaaaggtaaatgaagaaaacatcccctgtttttggagagatcagctcacggggggttctgctacttctgagtggtaaggggaagggcatactgatgtccttctctgtccactctgcatctccatggacaggtgctttgtcaccctgttccaccttataaaagcaaaaatgttcccactgagaattaagcctattttgttttatcctcagcccaaagcgaaataaagccatagaaagtttttgggatgatttatcaatgcctgaattggcatccttcagagctgatatgtgggctctttattcgtttattccctgggggtggagtataggggaaggtggcttacctgagtgaggagcctggggttggcactgcccacaggtctccctcctcagctggcctggcatatccagggaagacttccatctggaatacctgagtgactgctgggttacccatcactggagactttaaagagccctcttttaaaatccaacaagatagtgttcgtcagtttattttattgacgtataatttgtttgcatttaaaattcttagaaatacatcagtctttctctgcagtcacttttttactttacttacttaaaaattaaaataatgctatatgttaaacatatattcaataccaactctctaagaccgagttatcttttttacttgtagagtactttttaaattgtttaaatgacttataacaactatatatatttatggtgtacaatataatgttttgatatatgtatgcattgtgaaactgctcaatcaagctaattatgcttattttttgtggtgagaacacttaaaatctaccctcagcaattttcaaatgtacaatgtagtgttattaactaaagtcaccatgatgtacagtaaatctcttgaaattattcttcttgtctaactgaaattttgtgtcctttgaccaacatcattccagcctccctccccacacagcctctggtaaccacctatcttctccctgcttctatgagcttgagtttttacacattccacatatatgtgaggtcatgaggcatttgtctttctgtgcctgtcttcacttagcgtgatgtcctctaagttcacccatattgtcacaaatgacagaatttcctttaatttatcccatttttgtaaatgatagcacagttatagctgctcacgtcactttttgagtagttgttctagtcttccttccctttcagaaagacagagataatacaatctgttcaagaatcagtgactaaattaattttatttaaatattgtatgttttatttcaccctgtttggaaataataaatctatgttctgtttatctgtagtaatttcatataaaatacagttaatttaatagataagttagatttcaaatacatagataaattagatttcaaatacataaatgttaaaagtaatatacaagatgatggttttattgagtgaagatagttgtaattcagagaatatatgtggggaaatacaaaaaacaacattgtcatggccaatttttttcctgatattattactagaatgactttcctcttaataaaaaaaattgtgtgttggggaggagtgaatgttggtgggataggtcataccttagcagttacagacttgcataggaaagattaattaatatcttatcagctggaagcctgctgcctgctaaggacacagctgggaaattgggtgagcctctggagaagtctgtctaaaaaggagttaccaggaagaaggggttggaggaatggggatgggcacagagtaggaaagggaaccttaagttggcagggttggtgagaaaagctgcagtcacacagagcctgttttatgggcttgcccagccagccaaggatactcaccctgagccacctatggcctcagccttggtaatgtgccctgcaaactcttaatatgggccatatcatttgatacttagtttaaggcagagattggcggaacacagacacgtctgaggggcctagggagcacatacttgagtactgcacggctacagaggaggtgggaaaggacttctctgaacaggagtggggtgatttccagagacggtgacacgcaggagaagcatctcttcttcatagaaagatgccagctaataaatgtggaagaggcaagggaataggaaaccaccatgctgaaaaggcctgagaaatacaaggtgcaaatgactgtacatggagccaagccttctgtgtaacgaaaaagggggtatgagtaagtgtatgtgtatgtctgtcacctgtgtcacacaaatgcatgtgcacacacatccccccaacacacacacacccaagaaggataaacccaaagcaatggaaaatggctgcctatggggatgagtgagcaggggaatggggaggagggaataaaggtgagagctgcacaggagactcctctgactacattttttaatacagttttgactttagaaccaaatgtttttcatatcccagaaataaatagaatatatgaaacaagctcaccctgagattgtatatagatggaagcagatgaatctgactatgtagcaaattgacagtattaccaacctacagggaaaaaaagatttcaagtaacttctgaacacatatcattttctatatattcttgtaggatgtagtctaaggacaaaaaactgaaatgaaatcttaagctttatttagatttattttattattaataatattgatattattattctaaacttattttacatatagtaggactaagtaaataagccaatatattaatgtaattaagaatctaagttatcactgtaagaaagatgcagatactttgtttaaaagtaaggaaaatctctgtaatattaaatttgaattggaaatagtacaaaatcatatcaatattcgcacacatattctaggctttattcatgggaatgagctagaagctatgaaacttcagtagcagtgagcatgtattacaactagatcttgctttctaaataccactccccaataaaagaaaccaggacttcctggagaaattgctaatgaattttagatcttggtcagggataaaccagttgaacctatagcattttatgccaaaatcaaggttgtactcaaagactaatgagattatgtcaaaagaacacaagagcctgcatgaaagggctcccacaggccaaatttgggacaatttgatcacccaaagaatattgacaggaattgattataacacattgaattttttaataaatatatgcatctatggtaaacttaaaaaaatcaaaaatactgaaaataaatagaaaggatgggggatgtttttccttacagcatactgtaatgccaggaaataaatgtagaaatgataagattagagaatgactattttgcaaaggccaatataagatctaataataagaattgtcagtgtttgccaaaatgaccaggtaagagatattctgggagtcacaatattcacatgaccttcaagtgtcacctatagattacttaatttcttttttatgatggaaaactgagccttaacaacaaatagaagaatctagtagtcaacaccttgctcaaatttagcaaagccagtagtgatacagcttcacattatgtccttgagcttggatgtaggaaagaaaaagcagctacagaaagcatgtgggggacagttggatatattgaatgtaggcttcccattaagtgatattgtaaaatcatttttcttagttgtgataacattattgtggttatataggagatccatgctgaagtcatatttagggatagaaataatatctaaaactaagttgcaaatggttaggggaaattctatgtaagatatagatagagagatattgagaaacagcaagagaaagccaatgttaacaactgctggaaccaggcaaagggtattcaggtgtgtgttatactgctcctttgcctttactgtggaggggaggatgttcaaaatgagaagctgtggtgaagaaagctatcaaggggcagtaatacagcttcattttctcttccaggtgcttacaaattgattatgtgtaattttaattcttctttccaattttatactttccagtataaaagtcaacaaaatgtctgtaactcccaaagccctttaaaaaatatgattaaatgacagcataagggttttcttccccagtgagctatggtcagctgtaatgaacatcaactgtcctgtagcctgtggccagatgccctccccacaggggcctctcgcgcagactcagggagctttggtcacctgggcccaacaagtgtggagcagagagcagaacacagtagtgagtgcacagctggcagccttctgctttgattaagatgcagaaagtgttgagggacccagggcttcctgagttagagagactgtgggccacaggccaaggcttaaagagaaagagctgcccctgtctctactccaggcacagtggctgtagggacagcacccaggccactctgctatgtgtcgctgaaccttggcctgtcttcttaaagtactgtgtgttttccaaattgtttcagacacactgggtcttcaatttccagttctcatggatgctgtattaagaaacgcaccagaccatattaatctgacatggctgatttgggttgacattgactgttttatcttcgtgacactctgtaatgtcacactcctacaaagatcctccttgtcagacagggggccttgagaggccatcgtgaaaccaaattttctctccagacatctgtcctttaatcttttcccccttattttatgtgtctaaacaccacagttcaaaatatgtttagaatctttaatttggttctaaaactttaatgccatctcctcttcttatcatttctgtcttcatccccttcatctcccttggtagcttgactatttcaaaagctggttgtatccataatggttttgtagtaaatgtggtagcttatggtagctgagaacactggttattttagccaattgagttttgagttggtgggaaagaaatcatggccgaggtgttcaaaaccaagagctgatatgtggaaaacaagcattaaaacagtgtcactagaaagtgacggcggtggaaagttgtccatagagtaactctgctttcagggctccgtgtgaggactgagggggcaccctgaaatccacactggaaacaggcaggcccctttatgaataggagctccagctccatccatggtagctgtgcgtgctcattcattaggccttactggtttgttgtgagtgcagtatcagcatgatttatggcataggcagcctggaaataacatgagcagcacatagcacagccgtggctgtattcatccaacatatcctgtctgttcaaaggaaatgtagaaatctacttcttaatgacattttgtgctgctttttaatttttcttgcttttgaaatactgcattgttcagtactcctgtttgggagtcacttagagtgacgcagtgtcagtcagcccaagacttggtggttatctctgttttgtcagatctgagctgcactcgcctcttttattcttgtaaggattgggcatacaaacgtttcttctcaggaatcaaagaaggctctcatgagaaactgcctccccagcacctgagggccccaccatcccaaggcaggactctacatgcaaacagcatccaccctgaggacaacattctgcacagaaacctctcaaaactacagaattgtcatccacactttggccaggagtactgggaagtagctagaatggagttgagtcaattctcagctcttagaagttctttttttttttttttttttttttaaataatgttctgggaaagctagttacagaggcctttcacaaggacttcattggctacctgtaacctctggcctaagtatgtatttgcttcgtggttccatctcacatgaaattagtataaggtgaacccagtgatggctgcctttaacaagggttagcaactgttaggatggatgtgtggattgactcagccagcaccaccattttgaatgggttagtgaacagtaaaaaagaaatataaaatcctattactagttatctacccaaaggaaaagaaagcgctattcacaatagcaaagatgtggaatcaacctcgtatgcatcagtggatgattgtataaagaaagtatggtatctgtacactatgggatactatttagccattaaagactgaaagaagtcatgtctttgcagcagcatgaaggaactagaggccattattttaagtgaaacaccttagacacaaaaagtcaaataccacctgttctcacttacaagtgggagctaaataatgtgtacatttgggcatagagggtggaataatagacattggagactccagttagtggaagagtgagcgtcgggtgaagaagaaattccttaatgggtacagtgtacactgttcaggtgatggttacactgaaagcccagactccaccgctatgcagtatacccatgtaacaaaaatacacttgtaccattaaatgttatacaaataaaaaataaagacaaaaaaatcaatcctcacatcatatgagaaaaaatgaaaagaacacagctgactccttatctaaacttaggtaaaattatcgttactagttagttggtattcctttccactcaagcactctgaccagctggctagaggtaacaatctttcagaaaggtcttaaagaactaaaatgactgagcacctgcttctatccaatgagccatcccctagagtgtgaaccgtaatttggcttggatatagctggcagtgaggaagttttgtaggattatcttgcctcagcatttcttaagaactcggggagtggggcctgtcaccttaatccctttcagaagttccaaggtaagcctgccttaggctgccttagatcaggaaaaggtcatcactacagatgtaacaagagctgtcagatgcttgcttttattttcaggtgaagtcctatacctctgttccttagtgctattactgttagagagatgggaacaggagagagtggaatgagcagtgtttacctccttgaaggaaagtgctatgccaatacaaggaggtgctgcgcaggtcagcagtgcgccagcatactggtttcgtacaactcagaaactatcctgtttgcacatagcatttgctgaaaatattcagctgtctaggactagtgcccagtagagagattggcagaaaaacactcattttagctggctttcaaattatttttcaaattcaacacgaagtcagttaaggaagaccattagattatgtcaaaaagcagtttggaaaacatttatcatttgtagggagcccagcactgacgtttctaaattgtgtgtgacgttgacatgttcccatatgtcacgatatgttccttacttcccttgttatgagcttgggttagaagtcactgttcttttgaaccttgatgtcacctcagggcagtttgctagcactcagaaattcaaaattgcctaaagtgcgtggtgggatgtctatctgtatcataccgtgggcaaacgtctgacttgaaggcatcaaacaggcaaacggaagaaccatgaaggatgctaagttttgactgtgtctgggtagccaattgggagtgtattatgtagaaagccaaataaatgcttatttcaagcacttcaaggtaaaggacaatatttaactctggtttgttttgagagattagagtagtttatgcccataagaaatattcagaaatagttgttgagtgtgtgagtgaacagcagggcattaaataacattatagtcatggtctttatgagcgttaggccaatgttctatgtaatgaggtaaattatttaaggttcttataatgtgttattttaggtaaggatgttgctatttactcagtgttttttcacggaagatagtgtgctctacagattccgtgtcactaagctaagcatctatgaagcattattgataatcactcagttgactattacatacaaatttcaatgtggtcatcaactcttaaatttctttatagttaaaggataggaaaactgacaaaaaatgttactttttatcacttagtagaatttcatgagtcactagtttagaactttcatttccattcacaggacaaggttaaaagaaacagaattaagaagttgcttaggagtaggcttttctgtttattgggagtcggtattggacattcataaatttataatctgcattatgtttcagcgatacgttaatgctgagttcataggattaatcaggccacatgctgtcctgtggcttcactaatatactcctcagtcacatcagcactttctctttcacaccacacacaaaaagccttacggagcagtgggtaagcagtcctaacaggcaaatgttcacacatagtgaaagagaagtttagtttttctgtcatggttgctgaacaagataatattctctaattctttgataggaaaatagagccaaggcatttgactgccgacacactctcattggaactccatgcaggacttcaccagtcattagaagctcattccaggaatcccagcctcgaagggatcatggagaaggtgggatggagtgacctgagtctgatgggtagaaacagccacccttgctctctcccaccttcttctgtgtggacactctgcctctggaatttttagtaactgggtacctgttggaagattagttccttttgctaggctatgaactagagggagggtgtgcattcatttcactaaagtaaaattttgccttttctttgttgttagacaggatcttactcccatcatcctggctggagtgttgtggcacaaacatggctcactgcagcctcgacttcccaggcccaggtgatcctcccacctcagcctcccaagtagctgggacctacagacgtgtaccactatacctggctaacttttgtgtttttttgtagagacagggttttgccatgttgcccaggctggtctcaaactcctaggctaaagcgatctgcctaccttggcctgccaaagtgctgtgattacaggcatgaaccatcacacccggccaaaattttgccgctgatttttagaaattgaattattattttagactgaagttgtatctttttaaaatgaaagccatacctccgtatttctaagaaatcagatgggatcatcatcccatcaggtattcactgagctcctgcttgtgctccactgtctgctcagtgctggttctgtattgcggagaggatctaaacagaaagtaatccaaagggctacatctgtctttcttaatgacgaaccgacggctttccaccttacccttttggctacaaccagtgggattgactgctgtcttattgactctgtttatctagatatggtggacatattgcccagttagatgggctaagataccgatagccccccaaaatgccagattccagaataaatgaaatcactcagtcattaaggtgatatatttaactgggctggctgggctaatttgtccatgttaccaattattattgagcagacaaactcaggtaatgatggcagcaaaagcccatctggggcctgagactagaggaggaggaggctggccagaccctcctcagatgcgcagaggacagcttcaggataaggagagatcagatcatgcctgctccatctcggcgggctcatcttctctcgcccccatctgcatggtcctcttgattttcttcataataataacactgaaatcctttgagtgctaacattactgtaagtgtcagctgtttatgctgttatatgccttaagttatttcagccttaccacatgcagtgaaggagacactagtattatccttatgttgcagctgaggaaactgaagtgtggagtttaagtaactggcccaaggtaacagatgcagtgatcagaggagcagggacccacagccaggcactgtgacgcagagcctgcgctcctcactcatatcctgcttcaggcttcacaggtcttgggaagaaaaagagaacgtttacaccctgaataacattgcaaaaggatagtgcgctgtgtctgccggtcagcagagctctttgatgatattagtaggagacacctaagcaaagtaaagttgaggtcagtgtagctccataacaaaagatagggaatgctctaggtctcctcaagaaaaatctacaccatggttttctgttttcacctacagcttagttgcccaggaagattcatttattatttatttaagtaatacatcacagggacaagattcattgaagtgaaggtatttcacttccaactgtcctacagggaaacaatgagcctaaataaatcctacaaattctccctggagagggagcagtgattgattcatttttgcatctgtcaaatgcctctatagtccaaagagtgcgttttgttccctcccttaacaagattctcttacctttgttttgttcaggctttattggcgctgtgtgtataaataagattacaatgaatagaaattaacactgtatcccagttttctgagtcaaagccccaattccaaacagaaaaaaaaaatcttgttgttaaataatatatgggtattatttgtcacatatgataaatattgctactcatgcccaaaaagagactttacaactgtccttgtgctagacgaatgactggtctacaggctacagactattcacagagctttggggaagccctgaaactcacctgatagcagtgtccttgggactgaatataaacttctacagttacaaggccttaagaggttacaaagtagagcaagtttggggacttcaaaagcagtgcctgggatggcagacatcattgccgtggtgcaggggcctctctatgatcccatcgctgtgcccccaccgagacccaggtggacagtttggaggtggggagggagctgggatgtgactcagcagtcatgtggggcaaaaccagggtgggggcacgaccctgctagattagcctgaaggtggggcaaatgactggcaccttgtcacaagacattgttgtttttacgcatttgacttgatttcacccttcaggctcagggctggccctgtgaggcctttccactgcattcagttgttctttcttgaatgttagagggaggaagttggagtctctgttctggggaactgaacacaccgcacgcagcccatctggcctgtgccgtgacccacgcagcacaaatcactagttccagcggcgacaacactaacatttatacatcatgcaagttgtagtcttttattttaacttaaactttttattttcaaataatttcaaactcacaaaaagttataaaaatagtacaaaaaattgccatataccttttacccagattccccaattattaaaatttcacatttgtgtgtttctgtatatgtgtgagaaagtaaaaaacacgaagcctttttactcctaaatacctgggagtaattcctaaaagataaaacatatattcctttacataactgcaatacataaattataatgttcaataatttaataaagtatatttgtgttactctaaatggtaaaataagttttttctcctattaattaatatgattaataatactatgacatggagattagaaaaattaagatttaaggccaggcacgatggctcccgcctgtaatcccagcactttgggaagctgaggcagacagatcacctgagatcaggagttcaagaccagactggccaacatagcaaaaccctgtctctactaaaaatacaaaaattagccaggcatggtggtgcgcacctgtagccccagctactcgggaagctgaggcaggagaattgcttaaacctgggaggcggaggttgcagtgagccaacatcgtgccactgcaccccagcctgggcaacagagcaagactccgtctccaaaaacaaaaaagaaaagatttaaaaactaaaatataatcttcggttttacatatatattaatgattgtttctttttcaggtgataatttttttaaatatgtgaatggctcattagtacttgtgtccttttaaaaacacttatgaataccacagcaaaattaggttgtggtgctattactatatctatttattagtctgctcaggcttccataacaaaatacgatagactgggtggcttaaacaatgcacatgaatttttcacggttctggaggccagaagtctaagatcacggtgctgaccaattcgtttcctgctgagggctctctccctggtgtgtggatgaccaccttcttgctgtgccctctcgtagaagagagttctcttcctcttctaataaggacaccaatcctatcagattaggacccaccctaaagacctcatttaattctaattacctcctagataccccatctctaactataatcacattgaggatagggattcgacatatgaattttggaggggcacaattcagtccatagtgcacagtccgtcatttcatttcaacatcattggagaacaccttcaagcacatgatacctcctttgatgtgttttgctgtttaaaggcgtggtgaacccttgacagaaacattatcatggattcttctccacatgtttactgacttcattgtgcttttcaagttttcttcctccttaaacaacataaaacattttggaaaaagtactggaatattaaatgtgttgttcaaatttgatgctgatgcttgaatttcaaggcaaggcacatcatgggcttgaccttcatgtcttcagactcacagagcttccagtttctcagactggattattataagatctcatacgagttattttgagggaagggaatggaaaataaagattaaccagaaatcaaattccattttcccagccctcccttggcaatgcctagtggtcacatttcaaaatattatacaaacctattttacagtaaatagacatgttttgaagtggtgctagaaagaagaggggcgtctctgccatattctagttatcatatttctgttcattctctgctcagtgtgggcccagaggactgaaaaacagtcagtaagcacctctactttttgcctatggcatgcagaaatttctccatatgcaaaaaagtggggagaggggagaaagattaagatgtttctgtctggtttcagtcacatttttagttctttcccactttcatttgttctctgattttttttttttaatggtaagaaattggcaggtttctcacggaactgcctgtgtttaccatactactgataattcttgtaaactgtctaccatctcagttccttacctcatcgcagctttttatttctttacagatcaagaccatcatccttttaagcatttttctccttgactctgtctcgattgtcctgttctctctcacctcctaggcaattaccttatcttaataaaatataattgggccggtagacgtttctttctatttgaaaagcctcccagcctagcctgtggactgatctccctgccagccagtgtataggtctccacaggcctcctcttcttccatgaagggactgctaaactcagctcaggcagcatagggctatgattgctttcccattcatcaccccgaaaaatgagtttgcactttaatttataaatataaaatatattttcttggttacggcgaatcaaactgaattatatttgtgcaattactgagttacatgaccgaatgtatatctacgtagttgagattattcttgggaaatgcaaggagggactcccatctgattcagttatatggagcagctctagggtagcaccattctgggctttgagggtaacacgatgtaactggtattgtatacattaacattagtagagttccttggctgtttaaaatagctagaaatcagagaagtatgatacaaactactacggactgaatttctgggtatgtgttgtattaaaagaaaacaacaacacaaatttcggaagtttttgtagaacaactggctttcattctttaaaaaggttggtgtcattaaaggaagaaatgctggggattgttttaggttaaagaaacatgatgacttaatgtggtgcttgatccttgattcttgagcaaaatgaaaagtttaaaagacattgggaaaatttggaagatgtagatatgcatatatattagataatatttttgtatcaatgttgtatttcttgagagtagtaatactgcagttatatggaagaattccttgttcttaggtgatacatgctaaagtattgggggaaattgtcataatgtcttcaactttcaaacggtttggcaaaataagtgtatatatgtatgtatgtctatagtgtgtgtgtgagaaagtaaacacacacacacatgcatagtgaaaaatagaagttgcaaagattcatttttgtcattccttatttcttctaatcgagtaaaagttttctaaattagctttcctactaataaataaaatatttttcttatgctcggtcaggaaagctaaatgggagaggcaagcccacctaagtccttccctgtcaaggagggggtagaaaatacatcgtaacagtacacccagcgacctccagagtcactggttccatatgtgcaggattcacctaagccacatgccaaccacaagatggttttctctgagacttcttggaaaaataaacccaagaaattcaaatcacttgatgtcaaaggatctaaacagagattgcagactttagctgtgtagctctctggtttgtgagcagaatgagattgggggtggggaattgcactcattattgaacacctcttctgcttgcagtttcagcagcagcagcctagcttccccctaaatgtgacacttcttacttgtcatcacttaccatactttgggaggtattttatcctcttctttatgtgtgtgtgttcagttgtgtggggaagtgaattgagtcttaacattttgaagtaaaataggcttgttttctttttaaatccctctagtcatttagtgaaatactctgataaggttttattaatgaaatataaatagaaggaagattcgttttgaaagcacagtgccatcttagaaaacaccaaaagaggaaagaaaaaaaaaatgaagactgtaccttgatgtcagagctttgggggagaaactgattccaccttgaagggagatgacccaagcttgacagctgcctccacaaggagtcctattagcaaaagaaggggagccatgtgctaggagggccattttctctgttcttcgcatcactgaggagtgttcagcaatcacacttggacttgatacagaaaatgactgcattgagagcccttcttcataagtaagccatatatggtaactaaaaaaacaaaaacaaaaaaaaaacaaaaacaaaaaccctaacacttcccatcacaaaaccaatttttttgaggattaccaggctcgtgttttctctctagtatgtcagggtttgtgatacttctggtcagagtgtggaaagagtttgggctatcagcacaggccatattctgtttgcttcatatgcatttggagacatgaaatgatattttactggttaagtttccgctaagtgcttagattttctttattgcgtttctcttacactgttaaacaaaatattgtgtggctaaatgatttcagcctatctaatttgcttgacaattagacagtcgttctagccttaggaacaaaatatgttcatcataaaaaaattaagaatgtgatctaaagttcaaagctgaaatattaaaacattaataaatagaaagctttaagaactattcactcagtatgcaaagaaacagtcatttctcgctgctctaaattctattcctgcacataaaaggaaaatatatcaagtttaacaattcaatacaaaaaaaaaccctgcaatgtgagttctccaaacaaacatccctattatccctacatacaggtatagccttaggttatatttttatgatttcatttttgaggtatatacaaaacatgcatatggttttcatcactagaaataaactacactgagtcctttgggtttgctttctttatttctttattatatgtttaattgatcacgtactttataactttcagtattttgacattttagagtacagcaatgtgctgtattgctgtaatccacatatagttatatttggaatgatacgttatgcttgagttagaaaaataatttgacacatccactacccataacacatgttcagtggatatcatgcctgccagaaatatttccatttacacactgctagctctcatacataattacttacttgttcatctcaggacatagtgtcagattgtactatgtaatataaaataatcttatctagttgcataatgaattttattatctgagagttgtttatatttgatggcattttccctcttagagaaaatgaattttaatgagagaaaaattgctaacgtttttaaagccagcactcacattttggcattacagcatatttggagtgcccggtgattaggatcactgttctttggtggcagcgtgtgaggtctgtgaaatgtgggaaatggtctgtaacctaatggatctcataagaactatacatattgaaaggtgattaatttaaaataagggatgagttgaggataatgattgctttggagttgagcgaaaagagaggttactatgaaccaaaagagaagatgcatgaagatgaacaaaatgtgaagatgcaccaagaaatggctattgtagtagtagaagcagagagaaatgcagagtgagatgagggggagagagaagactggaggcacaaaaagactttatcaaggctgaatttttattttattttattttattttgagacggagtcttgcactgtcgcccaggctggagtgcagtcgcgccatctcggctcactgcaagctccgcttcctgggttcacaccattctcctgcctcagcctcccgagtagctacaggcgcccgccaccacatccagctaattttttgtacttttagtagagacggggtttcaccatgttagccagaatggtctcgatctcctgacctcatcatctgcccgcctcagcctcccaaagtgctgggattacagtcgtgaaccaccgcgcctggccctgaatgttttaataagcaacaaatgactgatgttcctaaagtaatccattcaaattcacatactttaatagaaaaataggcaaaggacatgaaccatcagtttataaaagaggagatgcagatgatcaatatatgtattaaaggctgcacaacttcattaataagcaacaaaatggaaattttcaaagtaaaatgctaggtatcacatcatattgacaacttttgaaatcccattagggtacagtgaaaagggcatccttgtgtgtggtgacagagagagactctgcttcaaaaaaaaggggttggcggggtggaaattgagacacagggagagaatgtgaagagacacggggagaaggctgcgggaggacagaggcagagattggaggggtcctgccacaacccagggaacatctgggccaccagaagctgaaagaacaaggaagggtccttcctctacaggtttcagagggggcatggctctaccagcatctggatttgggatttctgggctctggaactgtgagataataaatttctctggttctgatccgcccaatttagggtactttttacagcagccctaggaaattagcacagaatccaagtgggacagccgaggtcatgggtggatatgaaactgtagagttcaaaggagagatctggactagagaaataaaatttggagttttcaccggatgatatttcaccagaatagaaattggtacagttttgtggggaagcaatttatagcttgcaccactactcaaacatgagtctcaggtaaattaatatacttagaatttcttctaagggaattttccaatgcagtgatttatagataggattgatggtcacgggattatatatgacagtgaaatatttgggcactacctacgtttccaataatggtgacataaataaatgatggtgcacatttcattaagtgcggttagtcattaaatcctgtgttttcaggaaaagaattcatgacatagagaaatgatgaaataagtggtacagtaaaatccaaatgtcatttaaaataaaaatgtataaaaaagactggataggaatactctgaagtgttagcaattctgaatagtgaaataatgatttgtattttcttagatcttctctatatgttttagattttatgcaatgaaaatgaattatttttagagaaattatattacatgttcttgtattttaacaatttattgagacagaaaaaataaaataggtagagtggagtcccaaagagagggactgattttatgaatcagtaaatgccagtgttatccctggaccagcaatgaggttgctgaataaaaaagtgtatgtttgtgtgtgttagtgtgttgtaaagctaggaaaaatgtttggcagtttgaaagaaatatatctgccaacaaatattcagaaattacgtgccatattttttaaaaaagaaaactttaagcattctttatagtaggagaaacagggactaccgaggtcagaggaaatgagcagagtctagaacctcagggagcaacaaaggatgggcatggtcagcaaccataaccgtaagctgagctctttcagactcctgcaggccttggcctgatgcgtgctctcctgtgcagccacgccacttgtacacagttcattttagtgcaggcgagttatctaaatcccacagtaaacaccctcagtatgactagtgcacaggtacatgctgaatatgtgtctcttcattcatttaacaaattccacatgagcagctgtgataagccaggcaaggttctaagctttggagaacaaaattaacaaaatctctcctcttgtggggcttgctttctgatgggaggagatagaatgtaactaaaataagtagcttatttgtactatggagaaaaataaagctgggaaggtagataaggagtggggtaagtgagacttgtaagtagagtggccaggcaaggcctatttttttttttaaacagggtctcactctgtcacctaggcttaagtgcagtggcaccatcatagttcactgcagtcttgaactcctgggctcaagtgatcctcccatctcagcctcctgagttgggaccacaggtgtgagccaccaccctgagctaattttttaaaaaaattttgtagagacagaatctcactatgttgcccaggctggtctagaactcctggccacaggcaatcctcccaccttggccccccaaagtgttgggattacaggtgtgaatcactgcatcctgccaaggccttacttttgagcacgtgattcataaagaggaaggaagccatgaagacatcaggggaaagaaattcgaggcagagggagcagacagcagtgcatgcaggagagcataagcatgcgtgctctgggaggggacagcaaggagtccttgtggccggagcaggataagcagaggaaggagtgttggcagtttaggtctgtgctggtggggaagccagtgaagtcagatagggcataggggctgctgtaaaaggcttcagcttttattctgaatgcaatggagtcccgtcggaaggttttgaaaaaaggcgtgacattgtctgctttctactgtagaacagaagagttttctgtgcttgtctccagttccttttggaggactaagtgtggctgctgtgttaagcatagaccaagagatggcaagggaggaggcaaggacacaagcgaagagactgcaccgacagcacaggccagaggcagtgatggctggtcccgagtggtagcaggagagagatgggtgggtttcagacgtattttcaaggtaggaccaacagggtttgctgatagattgaagtgtcaagaaaaaaatcaaggatgtctctgaggttttcagcttgagcaactacaaagatggatttgccattttctgagaaggaaactacaggaaaatgaggtccgggtgggagatgaggagaaattaagaagtcgggatttgtttggggactgagaaatttgaaatgtctctgacatctgtgatggatttaattgtgtccccccaaaaagatgttgaagtcctaacccccagtacctccgaaggtgaccttatttggaaacagagtctttagggagataatcaatttaaaatgaggcaattagggtagaccctaatccaatattttataaggacaagaacagaaaaccagacaccgcaggttctcactcataagtgggagtcgaacaatgagaacacatggacacagggaggcgaacaacacacaccagggcctgtcagggtgaggggtaaggggagggagagcattaggacaaataactgatacatgtggggcttaaaacctagatgatgggttgataggtgcagcaaaccaccatggcacaggtatacctgtgtaacaaacctgcactttctgcacatgtatcccggaacttgaagtaaaattaaaaaaaaaaaaaaaaaaaaaaaaaaaaaaggtgctcgggcaaggtggctcatgcctcatgcctataatcccaacactttgggaggctgaggtggcagatcgcttgaggccaggagttcaagaccagcctggccaacatggcgaaatcctgtctccactaaaaatgtgaaaattagctgggcatggtggcaagggcctgtaatcccagcttctcaggaggctgaggcacgagaatctattgaacccgggaggcggagtttgccatgagcagagattgcaccactgcattccagccaaggcgacagagagagactctgcctcaaaaaaaggggttgggggtggggtggaaattgagacacagggagagaatgtgaagagacacggggagaaggctgcgggaggacagaggcagagattggaggggtcctgccacaacccaaggaacatctgggccaccagaagctgaaagaacaaggaattgtccttcccctacaggtttcagagagggcatggctctacctgcatctggattttgggtttctgggctctagaactgtgagataaatttctcttgttctgatccgcccaatttagggtactttttacagcagccctaggaaattagcacagaatccaagtgggaaagccgaggtcatgggtggatatgaaactgtagagttcaaaggagagatctggactagagaaataaaatttggagttttcaccagatgatatttaaaacaacgagactgtatgacgttctgaaggtgtatagacagtgagccctgggggaactgttgctttaaagggtttgggagttgaggaggaactagcaaagcaaactgaaggcattgccagtggtgtagaggcaaaccaggaaggatagttcccaagtaaataaagtgttctaaggagaaaggaacattcatcttgaccaaatgctactggcaggaaggaatgttcatcttgactaaatgctactggcacattatgtaaggtgaggactaaaaagtgaccattggatttagcaacatggaggtcacaagaaatccacactcatcgattcagataggatcaaaatcctcactggaacgagttccagagaaacttggagaggaattagagatggagaataagtagctctttagaagacttgggctatcgaaagcatcagagcaatgggataccaactggaggaataactggaggagagttgcacaggcaggaatagagagaattgctagggcggcctcctgcacaacaggaaggggtgaaatgtggggcatgggggagagcccgtctcagtggcacagtcatctcagcatcagaacagggtggaaggtggagaaccttggggaattggggaagcttgtgtaggtctcttcttctttttttttttttttttttttttttgtttgtttctaagacagagtctcgccctgtcgcccaggctggagtgtgtggagtgcagtggtgtgatctcggctcactgcaacctccaccttccggtttcaagtgattctcctacctcagcctcccgagtagctgggattacaggcacccgccaccacccctggctatttttttctatctttagtagagacagggtttcaccatgttagccaggctggtctcaaactcctgacctcgtgatccgcctgcctcgccctcccaaagtgctgggattacaggcgtgagccaccgtgcccagccaggtctcttctgattgactcattttcctcaatgaaacaggaagcaaggtcatcagctgagagtgaagatgtggagtgggagatctgaagacagagggggaggcatgaaattgttctgttgtggaaacgaagggtgaatggactgggaagggcagcacaactcccaggcagcatggagggctcgctggaggctgtggccatgcactcgtcagcatggctatgccagccagaggggagtggactcggtgcagggctgtgaccaggtgtcaggggtaagctggggagttgagggttttgtgagggaatgatgggcatgactggctgtagggtgagctgggtgagaagagagaccaggacagaagatgtcaagacctttgttgaatgaatgggcaaagataaaaaaaaagaaactgtcatctcaaacagttcaagtcaggactgcaaaagaggaccaggtgcctgtgcctggtaggaaggaggaccaagatggcttccaagaggaaaagtcttaaagcatgaacggaaatttggacagacagatgagcaggtgaggaatgggcaggtccaaggagagaatgttgtgtgccagtgccaccccagaggcggcaatacaggtgtggcctgcaggtaatgcacttaccaacaggcctagaaactgccttcttcattactgaggattagtaatagtaattattatttcttaattataaatttaatgctcctttgtcactcccagtgtgtgtgtatacacacacacacgagaattatgtatgtaacaatgacatatttacatatgtaagaaattataaaattatctatggctggacacagttgttcatgcctgtaatctcagtgctttgtggggggccaaggcaggaggatagcttgaagccaaaagtcagagaccaacctgggtgccatagcgagaccctgtctctgcaaaaaaatttttttaattagctgagtgtgatggtgcatgcctgtagtcccagctactcaggagcctgaggcagaaggatcacttgagcctaggatttcaaggcttcagtgagctatgactgacctctgcgctctagcctgggtgacagagtgagacctggtttctaaaaatttaactaatgtgtacattgtataaatataaaacaaaagcatattgtctgtctcctccccctacccaccacccgtctccattccaatttccttcttcagatcttatgaacattcttcctagccacctttaggccaactcctcatctgctgggtttcatgcagtattccagaagaccagcctgaaaatagagaactcaagctcttgtatgtttagtctgggttcctgccaaataacgtgcagcactgtcgagaatgatgtgacggacagagcttgatgcacagcatgatggggcaccctgtccacttgcctgtgagtcatgaacatttcatcatagggtttacagttttttgttatagatgtttaatcacaaaaataacagaggccacttacgctaagtatattctgtgaggatcattcttgcacacgaaaggtaacagcatgaccttgatatggtaaggccttggcattgcagaggagaacaggctgcagaaggtaatgtgcaatctcataaactggactccttgtcagcattcttttgatatttcacaaatgacaaaagtcatcaagagaagattccaatggttcagatatttaacggtcacccgtgtttatactacttttgaatgggtgaaactttaggatggggattagttaaatcatgctataaattcaggcccagaaaataatggagaaagaattcccaaagctactagaattctcccacaattgagatgtcagttcacacccacagagggcttctggtggtgacagttggtggaatgagagccaggatcctacagcaacagcccttcatgaagggcacatgaaagctctgaagagtgcagaaagtctcactgtggtcactggatgaaattatgacctccagtttctcagaaaactaaaagtggatccaccattcgatccagcagtcccactactgggtatgtaaccaaaggaaaataaatcattatatcaaaaagacacctgcatgcatgcgcttgtcactgcactgttcacaattgcaaagatacggaatcagcccaaatgcccatcatccgatgagtggataaataatatttatagaaatatttatataccatggactactactcagtcatagaaaagaatgaaataatgtcttttgctttaacttggatggagctggaagccattattctaaatgaagtaactcaggaatggaaaaccaaataccacatgttctcacttataagtgggagctaagctatgggtacgcaaaagcagacagaatggtataatggacattggagactcggaggggggcaggtaggggagtgagacatgaaaaactgcctattggggtacagtgtacactgttttggtggcaggtgcactaatatcccagacttcattgctatccatgtaaccaaaaaccacttgttcccctaaagctattataaaaacttgttttgcaagaaattgaaacttaaattttagaaaacttttaaaaaattatgactctggattcctataaatgtctgcttctgtttggtgttgtatctatagcaacatagtgacaatattaggtagcaatttctgaaccacagctttgaaaatttgagcaatggtgtttccaatttcatttattaaattcttttaaaaagtttagttattaccgatgatggcaaagaacatttaggtttcattaagtgagagttttttatgttatagtattctatgttttctttatctattaatgggtttttcttcttatctgcagtgaccctgtctctttgaagttttaaatccagcctaagttttcaatagttggtttgtatttctaatacgaaattcagaacatccttgatcatgattttatttatttattttgagatggagcctctctctgtcacccaggctggagtgcaatggcgcaatctcggtccactgcaacttcagcctcccaggttcaagcgattctcctacctcagcctcctgagtagcgggattacaggcacccgccaccgtgcctggctaatctttgtatttttagtagagatggggtttcaccatgttggccaggctggtctcaaactcctgacctcaagtgatctgcccccttggcctcccaaattacaggcgtgagccactgcgcctggccatccttgataatgatttaaatccacttttccataggactaagcttgactatctttgacaccattttgaccacattattaactctagcaaataggataaaatataacagtcatacttttaaaaaataccttccctacatccagaactgggtttctgaaaaataataaataggaaaattcatggttgagggacaacattgggaagcaatagcaataggtgacctgtgagaacccgaaaatagttatttcttcattccacataatacaataaaggtgaagcaccacataaacagtccgccaattgtataaacatattttaaaatagtaataacaaatattattcagtagttcgtatttaccatctcctgcttggcagaaacttttcaagaatctgccatttccaaaatttcatgaagatacttataaaagcatctcccttatttctggaaatatgcctattttcccatgtgtctgttgtgatagacaattgttcagagtcattctggttttaagactcagttattctttctctccttgccttaattctttccttaagtcctacctagtgcttttttttctttctttctttcttttctttttttttttttttttttttgagacaagatctgtcgcccaggccggagtgcagtggtatgatctcagctcactgcagcccatacccgccgggctcaagtgatcctctcatctcagtctcctgagtagctgagactacaggctcatgccactaggctcagctactttttttcgttcattttttgtagagaccaggtctccctatttttcccaggctggtcttgaactcctggactcaagggatcctcctgccttgacctcccaaagtgctgcaattacaggatcaccacaccaggcagctattgcttcttatctggttccttgagatgcagagtaaccgggctgctttgaatgaaagaaggcttggaataaccatcatttaacctatttcacttaacccagccccctgtctgtcaataaccaggtttccctagcctaagctctatctgtgattccttcctgctaaagcacaggcctaagggcctctcacaggagagtgcagttctctttctgtcttcctcctttcccttcatattaattggttttgttgcaaaaacccgtatttctttaattttttttattttttcccttcttttcatggaagtcataaaaacctggtcattctatttctaaccccggttctctctctctcttttttctttttctttaacgtttttccaacaagattgtctgtttatgcatatcctctgtatctggaattgtcccaatgacttcaaatatgtgggggtatacatttttgtgcactaaaattttgaataacaagaatttttgtttgaaagggatcatggcatcctattttaattaatctcaataacaaataacttgttcaattctagaaccacagtctgtcatatctacatataacagtaatagcagttcagatatgtaaaacttgttattgctcatcctgtaaggcgaagaaaacacattctgctgatgtctttgttttcaatactttttctctcattcattgtgatcagggtggtaatacacctgttttaatttatttttgatcatttttcctattttgttttgtttttctgaaagaccaaaactttcatttggttacccctttcaaaaattttgttttttgtttttctttcaactgttgacatactctctctgagacatatggtaacatattatttccatggggcatgcctaggcattttgtgggaaattacatgtatttcacagaagtagatgctctttttgaccaatatttttattttaaatgctattaaccaatatgctgttaatattcagcaagagtaatcaagtaactcgtccagtgaagctgatgggattcttgagagagtgcaaggtttccctctctggagaatctgttgaaggagggtttttgcatatatgctggtttaaaggaaatggaggtgttgaactttagaaccatgttgcttatggaaatagcttcgcgtagagtaactcttagtccattttgaaaccctcttccctagaaatttctatctctttcatttaatactgtggcaaggttaataatatttacacatactttcttctgtgttgtgagatgttagtttaagttggaacatgctggcttgtcattttctaaagtgaatcagtttatctttggtttagcctgaaattgcagcagagagtacgcatcctcctgggatctgaatgtaaaataactgaaacagattgaagttggcagtgactaatgaagtcttgcgcataagtcggcaagtcagtaggtttctgcgtatcaagaaggaagagcagaggaacccgagcccctggggtctaggcatttcttccttcttccccctgtgcccagctctgatggaggaggggaatttaaccacagatattccacctacattctttctaaagacatcaaattcctagtatacaaattcgttacattactggtaattcccagctagcttccttgtttaacgagccgttttagctgcctaaaggtattctacatagcaattttaatcagtcatataaaattgatgaagctgagataccagggaaaattagaatggttatattgtttctttgataactccttccgcaggctggctacactgttccacctttagtgccctggaaatgactccatgtcaccaatttacatagtaaagaccactttgctcatagctgagtctcagtatgcccagtgaggctttgtgttgttttgttttgtttgtggtcagcattcatatatttccgtacatcactacacgtatacacctttacttcagaaaatgccagattaatttctttgtttctttcttgaaatgttttctttttgcacttttttttaaccattaacatggtatcagggatccatagtatcgcgttgtatttacaagattacagaaatacaatctgcttggcacatttagaaatatgttttgaaagaaattggtgtgctgttacccttcggttcagttctcccagcccgttcccacatagagagcaacaagatttgtgttttccagctcattaaactgacagcagaaattagattgtggtattaaaaactaaaaagttaaattacagctacacatgtcctttatgcagtggggcgtgtggaagatgtttgattttaatgtttgctataatggagaatttaaattacaatgtttgtcaaatctctaatctttgttacagagtggaatattaattacgcttttaactatgagaggtaaataaaatgagcatccactgcacgcccaggggtaaattgcagattaccaacaacgtgacataatgcactaaatgtcagttttgtcaaacaaatttagaagaacggttaaactattagcttcctgttgttctagggcctttcttgcagcaagcaactattgggagcagcagggacactgtgccttgtggaagactaagggagttaaattgaataagcaagatgaatggggagacagcaccacagaggcactcaattagtttataactgtctattaacttctgtaggtggttttgaataaacagcagattatctgttgcactcttgggggacaaggggagccatgggagagggtcagtgtagcgctcaaaggaaagagattttttgattctcaattgccctctgtcttctcctttcctacttttgtgcatgaagcatgggtaatggttgtcaaaaccttctacatgtttaaaacttacacgcatacaaaggagcagtgcccgccttgacatttctcttggcagttcttgcatggaacactggtgtgatgcccccaaagaataagttgaatttaggttctttggctactttttcagaacatgttcttgggaaaagagtagtaactcttggttcttagaactcaggaagataaaacctctccatgaatgatcatagccaggatttctttccagagagggctgagagtgtggagggaaactgatggagctctctgcatcatgcagtacatcctggagacttgcagggcgtgggaagtccccttgcttccagtgaaggcattgtttctagcttcagtgtttatgcaagttctaatctcctgatgcttaccttagagtacatttaggaaccagtgctctgttaatggaaaaactaaattctaaaagatttttaagaggcttattctggccaagcccggtggcttacgcctgtaatcccagcactttgggaggccgagacgggtggatcatgaggtcaggcgatcgagaccatcctggctaacatggtgaaaccccgtctctacttaaaatacaaaaaattagccgggcgtggtggaggacgcctgtagtcccagctactcgggaggctgaggcaggagaatggcgtgaacccaggaggcagaggttgcagtgagccgagatcaggccactgcactccagcctgggtgacagagcaagagtccatctcaaaaaaaaaaaaacttattctgagtcaatatgagtaaccgtggcccaaggaaaaacagtcttaagagatcctgacaaagtcaagagagtcagattacagttttctacattttggagaggaaggagttacaggcaaagacataaatcaatacatggaagatattgattagtttagcccataaaggtgggatatcttgaggtggaggcttacaagtcaatagatggattcagagattctttaatttgcaattggttaaaggaacaaaacttggtctaaaaacttggagttagcagaaaggaatgttttaagttaagataagcatgctatgtcagagtcagccacaatatgacctgcttaacaaaagcagtggcttgcaggcatgacttaacccttgccttaggtattgtttataatttgatatatcattaccacaaagagtatgtttagtcaatcttatgatctctattttaacattaatgctggtcaattattgtgcctaaactccaaaagggggcgctataacgaggtgtgtctgacctccccatcacatccaggaactcaggaaaatttttaagatttttctgagttcctcttggctacaagtcagtggggagcttaggattttcttttaccgcatggtacaatcactagatcattataaagaattgcaaattttaatgaaattgctgaagaaacatggtgagaattaaaggggaaggagataaaagattagagatgaaggaaaaaacaagaccaagaagatgtggaaactatgagtgatgacttccgaactttaaagtatttttagtgcttctgaatttatgtccttcaaactgtgtaccaacttgcttttttgagcatgcagacattacataatgcaagccatttatcagagttcttttacatagcacagaacagtcataagatactcttacttttcaacacacatacacacacatatatcccacaaagggattcatttttcttttgctattttgaaaaggctgagaaatgtatgcctccaccagcaggattggggcattctttatgtgaacctgtcccacttaaaaccagttgtcaaggagagaatcaagataaaacacagtgtgtggtgggtggatccactaagtgaggaaagcttattaggaaagagttaggaaagctgtagttcctcctgaataagactcctttgagaaaaagagccaagacttaatctaactcttgggtatctgttttgacacctgtgtctgtaattgctggtttgctttgtaataggggtgttttctttggtcatccattgaattacctttaattcaattaccattgaattacattgaatcgatgctcttaatacctaagttttctttgagctaaatgtaagcatttatgtgctgatggatgttattaaaccctacatctcctttataatcattcatgagatccatcagcatgagggcagtttcttcatcaacagactgtacaaaacccttatgaggtaagatctcagtgaacaaaatgagaataatcagatgaaataatagtcaagtgattgcccttgaaaaatagaggcacttgatacaacttagacttgaagtctctttttttttctgtttttcctcccactaaactattgcagatttgacagggtgtttattttgcaaatatgattggagggatttgtcaaggaagactaggatagcaatggtcatgaagaaaagcattatccaaattataacccaaagtttactcacccatttccctgtgttccctggcactttgtggagcctgtattgttgtcgctgtgggggttggtttcacatgccgtctatcccagtacctgtgagtttctcagaggccagggctgtcattgtcaccctgcatcccaagtacctagcccagtgctgagctcacaggggatgcttatgcaatgttgaatggattgttaaaagaaaaatgttagacaaattaaatttaacagagtttaattgagcaaggaaaaatgattagtgaatcaggcagccctcagaataagagcagattcagagagagccaatgctgccatgaggttggagaaaatttatagatagaaaaacgaaagtgacacacagaagacaaaagtgaggtacaacagctccattggttacagcctggcatttgccttgtttgaacagttgtttgcctgtgagtggatgaagtctggtgctgagtttgtctggggctcggctattgttacagaagcacactcctagctcaggttttcagtccgctgatactaaatcaagtttagcctaaaccttcctccttacatattttaattttggcctacagatttccctgtgcatagtgaactgtaacctaaacagactgtaacctaccaatgattgtgattgtgccaatcaccaagtcttggccaaaggtggccaactgctcaaactgggttcaagcaaggcaaataccacactgtacccagttcattgtttctgtacctcacttcagttttctgtatgtacctcacttttctttttctgtccataaattgtctcccaccacgtagctgcactggagtctctgagcctactttggcttgggaggctgcccaattcaagaatcattctttgctcagttaaactccattacatttaatttggctaaagattttcttttaacactgacctgctaagataagttgtggtttgtccataagaactcaagtatgcaaatatggaggttttttcaggccagattttggttgatttaacagaatgaatactggaaaagacacctttcatgggtatccagatatccaagaagaaatcacagtgctgtttaaaacaaaattaagccattagggaaagtttttgtctcatttttccctcctatctgttgagtccttaccaggtataggaactgtgctttacatgtattctcatttcattttcatcaaccccctacaaagtagatgacatgctttctctgtcaagcatatgaggaaaccaagattttacaaagtttccatctctttcataaggaaagccggaactgacagagtatgggggctggggacgggatctcttccgattgccatttactcattgaaataagttttcatctgagcggggacagagaatggttaatggaggtagaaggaggtaagagaaaagggaaaatcagttttcctaaaatgtaatgtctgtcatattattctcctgctcagcaggactttccttgtctaagaattatgtacccacttctcagctttgcctccaaggcattccacagaatgacaccagggtttcactataggcagcttatgccttatttggttttctaagcattttttgaactgggcatggtggtttgcacctttaatcccagctgatcagaaggctgagacagaaggattgcaagcccaggagttcgagaccagcttgggcaatatagtgagaccccccatctcaaaaatagataaataataggctagtgtggtggctcacacctataatcccaactctttgggaggctgagacgggcagatcaccctgaggtcaggagttcgagaccagcctggtcaacattgcgaaaccccgtctctactaagagtacaaaaattagccgggcgtggtggcacatgcctgtagtctcagctactcgagaggcttaggcaggataattgcttgaacctgggaggtggagattacagtgagccacgatcgcaccactgcactccagcctgggagacagagcgggactctgtctcaaaaataaataaataagtaataaataaaaactggttgactaattataaataaactgaaatgcatagccatgtggtagtaattctaagagtcaagagttaattcttgtgtcttatcaaaatgaaatgttaaggaaacatcaagtcagtggcctaaagttggatagattaacaaaaggcttttctattttctgttcatctaagtcaacctcaaatattacagatattttttaaagaactacttatttttaaaggactaagaattattttcaaagaagtatgtcttcaagcatcatgagcagaatgaaaggccgaatgctctccttgtgacaaagtgagtggacagacccatccgcagtgcagcatgcctatcaccagccaccagcgcagtccaaagttacatgattgaaaaagaaatttgcacctgattgaagatgctttgggctcagttttgctgtcctctccccacagaagtctaagctgttcagactgctcaagataacacttcacacagtttaggaattgtggtttatgtcgaacgccaatctatatcagctttcataacatttaatatggtggggggagtgataggtgtttgagaaattaagcaaaaccataaattttctcttggtatgtatagtatatacaaggagagctttcgagtaccttcttcctagtgttctctcttaactcttgatgtgagtgaaaagcttcatccattgcatgacacagactaggtcattgtgtttgaattccttgggttggggagaagtatggtagagtctttctcctcacttcagaaatcaaaagaaagtacagtacctgcttggtaggtattccttgaaagttgccagcacttttggctagacagctcccagataagcagatggcttctttaatgatgaaaccccacttttctacaatgctaattagttagagaaagataatttgaaagtctgctgtacattgcaggaaatgtcttttgtgtctgtgtcatttgcttctaagaatcatgcaactgccacctgagtaggctccagttttctctttttatttaaatcttgtgactcttcaatcacaagaaaaggggaaagacagtcaatgaggaaaaggagaaccctctttcaggatgaaacactcaattacaagtgcagctatatttctgttttcaaaaatcagccttattgttatgttttgaactatacatttggaacagtctcttcagtggcttcatatggcgtgtgcatctcaattcatttctctacagattgccattgagacttggaaaaaccagattgcccatttgaaagctggttctgactcagcttgtcaagccagccatcctggtcagaatgtattggggaaaaaaatgaataaaagtaacagagacctggatttttattctgatcccacacttgattcatttgtgacccagggcaagtcacataaccttttatatatgattccttatttgttatgtggcataatatggttcatccctaccttacttatttgttgaataaacccttcatcctgtagaattcccccacattccaaactcactgatgcattcttatgctgtcatttaacgcgtccctcagttatctggacttgctgtgaactggggctagcactagaggattaattgattcaactttcttattttggtaagaatttttcataagtagtgttctgtacttcctcttgcattacattaggaagcatataaggctgaacttgattagcgagttgcagttttgccaacctcatccatccattttaaagttccacatcagcccttcacttaatggttttttaagctactggtgatgattgcctgatacattattttattagggatttcaaaatggtgacatcttaattctgtcattccttctgtatttattaagtgtcattctctactcacctgctaggttactgtgaaatgcagttcatataggaaactcaagataaatgtctgaagtttattcttcttatttaccaatttcagaatgagttggtgccttaggattttgtaagatgaccagtagtgtcattatcagtgattttaacatatgtgatatgtttgaatattttagagtaattactgtttggatgttcagagtatctcacctttggccaataggagttcattcaagttgtctcttgtatttttttttttaacataaccccaaaactttggagagcttctggtacaacaggatgttcttagctcatcttctgtattgtctgccccatggctggaatcagtcatttctctaataaaccctggtttcttttactggaaaatggcatttagagaccacaatctgaccacaaggggagctcattgaagtgggtcagccgttgcttctaggctcacatcagccactttcaccatcggtagccctgctgtctgcttacctgacatgccagcagctaactcatcccctttgtctgtgttcactaagcagagaaagaccattggtaaatagtgaaatataagagaatatctttatgacctcagggtagggaacgtcctaaaatcataatagacttaattgatacatttgagtatatcaaaattataaatttctgtataccaaaagataaccataaacaaaatttcaaacaagctatagattaggagaaaacatttctaatacttatatgtcaaagtatcagtagcctaaatataatgaatttgtagacatcaacaaacaataacaacccaatagaaaaagggatataatatataaacagacaactacagagtaggaatataggctgaataacatttgaaaagatgtgaaacctcacatataatcaagtatatgcaaatcaacaaattataagatgccatcttttcacccatcagattgaggaacgtttctgtaacagatagcaaatgttggcaaatgtgtggttaaaaaaaaaatgcatcactccgttaacataacacaactttggtgatgcttttgagacttcattttaatttttgaaaaagcaatcccttctgttccccatcattcccacctagcccccaatatcccccccacacacatacatacaaacacaaataaatagcatgtaaaggccaaatcgtttgctttctacattcttattaacaagtaagaacctttcactaccagtatactcaagttctgcaatatagctagttcatcttgagatctatatctgtgaaacaagaaattcagaatcagatctaaagatttttaaagtgtgatttttatatttttcctaggagaaaaaggcattttttacaataaagtgacagttgtttaggataaattaataagaaaatgtaggcccttgttgggaagaattgttgatagatgggtgttttagaaaagccaaatggttagtcaaatgaccacagaaatgcctgtaggaaataaaatattaaaattctgaacactgtttgattatatgccttgtattagtttcctgttcctgctgtaaataaattcctacaaacctagtggcttaaagcaaaataattatcttatagttgagtaggttagaagtctgacacaggttttgcttggctaaagtcaaggtgtcagcagggctgtgttcctttctgggactctaagagagaattcatttcctggccttttttccacttctggagactacccgcattccttggcttgtggccccttcctcatctccaaaggcaggaagggtgggttgagtgctcctcacacccatcattctgacctgctgttttgcctcttaaggtgtcatgtgataacactggcccacttggataatttaggataatcttccttttttaaagttagcttattagcaacctcaattccaaccacagctttaatttcattttgccaagtaatgtaccagattggtgcaaaagtaattgcgacttttgtcgttacttttaatggcaaaaccacaattacttatgcaccaacctaataaaatatattcacaggtttcgagattagtaggtggatgccttcaggagaccattctgcccagtgaatgggatctgggccctccaaaaagagacatccttttctgggttatcattcatgcacctgaagcaacctcttttagttactgctttccatgccagttgccagggctcctgaacaaacaggaagtatttactcacacataaattaatcagcatctatgtttttaacttggaatagaaaggttttttaaaaaaaattttcatcctttgtgtttatgagatgcttggatacttaattctgcacatccaagggatcacttggattttatgaagtcagtgcttaaagtgggatccagaatatgcaattttatcaggcccccattgtcctatgtgcagacatcagtggcttgccttgtttctattacatagagacattccagaattttttagcgagtttaacaaacatcatcaagaggaaagtggaggtagtgttccaatatgacatgcattaaaaattcttctctttctcacttatatttatagtctgatagaggatcaacagtataccaatttaatcttgctgcagagtgacatttttgaaaccattaaatttccagataatgtgcacatgtggaattcagcagcataagccagctgtgagtggggacccactatcactaatgtcacttgattcccatcttgcttgactatggattgtaccagtttcatatttcttgcactgtcaccggttccagcccctctggattcatattgctgtgatgtgagaaataaaactaaacaaaatattactaaggatgacagatactacatctattatttttatggctgacttatttcagtgtttaaaaatcttcggttggtttggggaatggcgttaggcgctcacgtgagctgtgggttactcccaagtggagggtgttgtttcaggagggatctatttgcaggtggatattggagggcagaatgcctcttatgtgcaggtcttgccacactgtgtgttcagaggagcccagctgaagacacggtggaactgatctgtatggggcactcctgctccaggcccagggactgatagaaaatgagagggaaaggaggaaacagagctcacaagtttttccttggtgggaacgatatctaagggacttagggaaggtgccccagccagatatataatgagagacagtgatgattaagtgcatttcaagatcgacccaaaggcttttttccagggctgttatattgtcatatgaataacattaaattcaagttataaatgaagttgttttaaaatatgtgtatatgtgtgtgtatatgtatttatattcctctttatcatttagaaaaaatcagaaataggctgggtgtggtggctcacacctgtaatcccagcactttgggaggcgaggcaggtggatcacgaggtcaggagatcgataccatcctggccaacatggtgaaacccaaactctactaaaaaaaaaaaaaaaaaatacaaaaattagccaggtgtggtggcatacgcctgtagtcccagctacttgggaggctgaggcaggagaatcgcttgaacctgggaggtggaggttgcagtgagccgagatcacaccaccgcactccagcctggcgacacagcaagactccgtctcaaaagaaaagaaaaagaaaaagaaaaattcagaaattaaaatatatatacctatgaagtggttaggtgttttcaacttccaaggtctttttctttcaacaacttgaaaagtggtagaccataggatcaagccatgaaatgtgagagtcgtcaccaagccctgagctggaaccttcaggatcattagacatgcatcagtcagtgtccgtctgtctgtctgtcatgcctctctcttatgcacgattatgtttatcatatattttttatgatcaggaagtaaggtattaagattaatcagacaagcagaataagaacaaacaaatgtttggtgagcgcctaccacatgccaggcactttctaacaggagatgttagaacagaagaggcataaagccctgtcctcacccagctggcacgtgatgtttgcccaggagcatagtaaaatacctgttggctaagaacaaaaacagtggcttccaagtacgtaaggataatgcttactaaccagagattcttttgaaattaaagagtaggaaaatgtttccttttgatccattgaacactctacagttagaaaactttaggtactcgtgccctctccagaaagcagcaggctcttttcttaattttttagttctgaaaataaaaattatttaacatataaggatattgggtgtattttttatctcacatgttggtttagcatatgattccttgaattttgttgccataaataacatcatcatgattcttttgtttattgtaatttaattatcatctcagagtcatgcaagacatttgtgtcatggttttgaggtgatcatagatacatgtaatttcaacttgttttaaaagaaagccaatcttttccaaatatttgattttcaacttgtaagtttgagaaagactaatttttattatatttgtataatatgactattatttgaacctcttcaacatgaagtacacatggttatatatatatgtgtgtatacacacatgtaccaagagatcctgacagttacttgctgaagagatccacacacctctttgcttcttttgctctggtgcaagttcatttgcagacacctttcctcaccagtgactcatcgtgtggtgttgttaccactaggtcatctgaaataaagttgtagcctaaagcgatatgtgaataaaacccatacccgtttctcacttggtgaggtaggaagatacatatccaagtccttctgtctggtttctttttagcctatcagcctttctaagagtccttcagtctgtcatttgatataaccccatggtgtaaagaggtgaactctacaacagaggcccaacaaagataaaaaccctgacttgtcttaaaaaaaactgtttttttgtgataaatgtatgtctgttaactagtgaatgaagaacagagagtggctgggtaggtagtgtgtgccatagtttgttgtctctagagtgggcttcttaagtgatgatacagttagcgatgttagaagaacactttcacctcagtcaacagctataaagtccaagctgggaactttatggacagtgtccagacataagcaaccataagtgtagctagtgatgccaatagattccagattcccaggatcattttatctcaacatgggaaaataatgccagatgtctaaagttctctagccatgtggccatggacagcttagcaccactgtgcctcagtttccttctctggaagatagggataataatggcagtttcctcattgggcttttgtaagagttaaacgaattaatgaacataaagtgcctggcatggctaatctgaagccctacataaatttttgtaattactattttcatgttgtatttctgtcaactgttgcagtgctggttcttttgaattggaataattaaatatcagaccactatgtttctttcttaaaattttacctttaaatgcaacaggatctgctaattcttacagatccatctttaatgtgacaacctcttattcattctggtttatttaagtggatcttgtaatttggtataatatatgcattgtttgactaaaccaataataatttcatcccttctttaataaaaaataaacacttattcttgttaccagctcctactgcagcccttaattaagtctaagcacacacgtaattgtagatgccaggaccaaagagccatttaccctttcattcttagtttatatgtgatttacctttccatgagttttgctatccctgtagtatttgaaaaacaccttttctgtggccaacagtgatctttggctcagtgctaataagcatttccccagtgacaatctgttgacataacctagcatggcagggtctatcacagagggtgggggtaatcaggctctggggaaccatggcctgtgaccttgaatggcaatagaccaggactgggaggagcatccatattgaatccactgatacccatggcagacgggcccatccatcctgctcctctcccaattgccactcagtccagtttcagagcgggaaactggaggaggagtgatttcttcttccttccagccaggtggcaatttgttctcctagttggcagcaatttgtcctgcagctctcccataggacacattactgaagagttcattcttcaccatggtttctttatcggttgtgattcatacccatcataaacataataacttgccaagaggtttttcttccatttcccttatttccatttcatacttttaaacatttttactgtagaaaagaaatactcaggaaatagtagagtataataaccattcctttaatttgaattcagcgcgcatttctctcctgtcctacctttattctactttacagtttttgagctatgacagtttttctccctccaattatttttctaaacagtattgcaatgtttaataaactatttttagagcagtttttgtttcaccacataagtgagcagaaaatacggagttcccatatagttctaacacccccctgccaacacacacacacagtatcctcatttatcataatccgtgaggctctattgccacatcattatcaccaaaggctgtagttcacatcagggttcattcttcataatgcacctactatgggtttgacaactctataatgacaggcatccttcattatagtatcatataaataagatcacagcctagaacctcctctgtgctctgcctgtttatccctccctttccgttaacctttgacaatcactaatccttttactgtcttcatagtcttgcctcttccagagtgttatgtagttggaataataaaatattaggtcagtgcaaaagcaattgcattttttgccattatgtagcctttcagattgacatctttcacttagtgacacacgtttaagtttcctccatgcctgttcatggcttcatagcttattcctttgtaacactgaacaatattccattgtctaaatgtaccacagtttagccattcacctattgaaggacagcttggtttcttccaaattgtcagttatggataaagctatatgaacatctctatggaggttttgtgtgagcataagttttcaaatcctttgggtaaatagcaaggagcataactgctggatcatatgggaagaatatgttaatgttgtaggaaactgacaaactgtttttcttttttttgagatggagtctcactctgtcacccagtgacagtgcagtggtacgatcttggctcactgcaatgtccgcctcccaggctcaagccattctcctgcctcagcctcctaagtagcaagtaccagagatggggtttcaccatgttggcaaggctggtctcaaactcctgacctcaaatgatccacccacttttgtgaagctccccacgaccctatattggactgaacaaaagaggacgaacgtgggaatagaagacaaagacaaaagagtatatttggaagaaggggtcagggggcaccttgcttctagtgaacaagggccctgagctgtacacagccttccatatttattaggcaaaagagatagcaaggaggggggtggtggttgtcaggtaattgtcagtcggccatttggttcacagcaggcttgtgagactgcattcctggaacaatgggtactagatgtctcaggagataacttcaaggagtcccgcaccaggaagtgatggtcctcagcaaaccttttggcgacaggagcagtttgagtttgcccacatcctgcattcatgataaacagtttgctgtttgatcatatagcctccagtggaatgctgagctagtcacaatccctttgccggcacactacacaccttggcctcccagagtgctgggattacaggcgtaagccactgtgcctggcccaaactgtttttcaaagtggctatgtccttttgcattcctatcaacaatgaatgaggagtcttgttgctctatattcttaccagcagttggtgatgtcagtgttttttagattttggccttataacagatgtgtggtggtatcttgttgttctgatttgcattttccttataacatatggtgcagagcatctttttatatgctcgtttgctatgtgtacatctttggtgaggcatcaaggtctctggcccattttttaatcccattgtttgtgttcttattgttcagttttaagagttatttgaacattatggataccagttcattaccaggtatgtcttttacaaatattttctccaagtttatggcttctttcttgacagtgtctttcacagagcaggaatttttattggaaagatgtctatcttatcattttttttcatggattatccctttaatattttaactgaaaagtcattgccatatccaaggtcatctagattttctcctatgttatcttctaggagtttcatagttttgcattttacatttaggtctataatccattttgagttaatttttgtgaagggtgtaaggcctgtgtctagattcatttttctgcatgtggatgtctagttgttccaccaccatttgttgtccattgtagtacccttgcttctttgccagttgatcgtatttatgtaggtttctttctgttctctctcttctgtcctagtgatctgtttgtctcttatttcaccaataccacactgtcttgattactgtagctttatagtaagtctggaagtcaggtagtatcaatcttccaacttttttctaatcagtattgtgttggctattctgggtcttttgcctctccatatagaatcagtttgttattaaccctaaataagtttctaggattttgattaggattgcactgaatctatagatcaatttgggaagaattgacatgtggacaatattaaatctttcatttatttagttctttgatttctttcatcagaattttacagttttcctctatactttttgtacgtatttgttagatttatgcctaattatttcacttttggagatgctaatgtaaatggtattacgtctttaatgtcaaattacagttgctcattgctggtatataggaaagtattgacttttgtatattaacctggtatcctgcaaccttgctacatttgcttattagtactaggagctaattttgttggttctttcagatttttttacacagacagtcatgtcatctgtgaacaaagagcgtttcattcattccttcttaacctgttgatattttcattttcttgtcttatggcattagctaactgagacttccaagaggatattgaaaagtattggtgagagaggacattctggccttgatcctggtatttgtgggaaagcttttatttttgcaacattaagtataatattagctatagcgttttagtagatcttttttttatcaagttgaggggtgttcccctctattcctactttgctgaaaacatttatcaagactgggtattggattttgtcaactctttttctgcatctattaatatgaccatctgacttttcttccatagcctgtcaatgtgatggattgcattttttgagtttcaaatgttgaaccagcctcccatacctgaaatatattctacttggccatggtgtataattatttttataaattgttggattcaatttgctatactctgttgaagatttttgcatctgttttcatgagaaattatggtttgcagttttctgtttctgtaatgtcttcagttttggtattagggaaatgctggccttttagaatgagctaggaagtattctctatttatgttctgggagacatggtagagaattggtatgattgccttaaatatttggtagaatttaacagtgaaaccatctgagcctggtacttcatgttttgaaaggttattaattattgactcaattttttaatagctataggcctagtgagattgtgtgtttcttcttgtgtgagttttggcagattacacctttcaaggaactggtctatttcaaccaggtcatcaaatttgtaggtatagagttgttcgtaatattctttattatccttttaatgtccatgggatctgtaataatgtcccctctttcatttctaatatgagtaatctgtgtcttctttttttttttttttttttttttagcctggctagaggtgtatcaattttactaatcttttcaaccagtttttagttttgttaatttttttctattgacttcttgtttctgtttcattgatttctgcactaatttttttttattttcttctaccttctttagatttaattttatcttcttattttagattccgtaggtgggagcttagattattggttttagatgtttctttttgtctaatatgtgcatccagtgctacaaatttcactctaagcacctcttttgctacataccacaaattttgataagttgtattttaattttcatttggttcaaaatattttttaaatttctcttgagatttcttttttgacctgtgttttacttaacatgcatcttttatcttccaagtattagggatttttccagccattttcatgttactgatttctaatttaattccattgtagtctaacagcagacaccgtatgatttctattctttttaatttgttaagctgtgtttaatggctcatgatgcggtctatctggtgaatgtaccctgtgaacttgaatataatgtgtattctgctgctggtggatgaaggattcttaagatgtcagtaatatccagttgattgatggtgctcttgaattcagccatgtccttactgattttctgcctgctgagctgtccattactgacagaggggttgaaatctccaactatagtagtggattcatctatttctccttgcaattctatcaccttttgcctcatatattttgacactatggtataggtgcatacacgttaaaaaattttatgtcttcttgaagaattgacccttttatccttatgtaatgcttttctttatccctggtaattgtttttgctctaaagtctgctctgtctgaatttaatacagcttattccagttttcctttgattagtgttagcatggtacatttttctccatctctttacttttaatctatgtgtctttatatttaaataagtttcttgtagatcatatgtagttgagttgtgtgttttaatctgataatctgccttttaattggtttattttttatttatttttttgagatggggtcttgctatgttgcccaggctggagtgaattggtgcaatcttggttcgctgcaacctctgcctcctgagttcaagcaatcctcccagctcagcctcccgagtatttgtgactatgggtgtgtgccactatgtctggttaatttttgtatttttggtagagacagggtttcaccatgttgcccagggtggtcttgaacccctgagctcaagcagtccacctgcctctgcttcccaaagtgctgagattataggtgtgagccacctagtgcatagcctaacgggtatatttagactactgacatttacatgattattgataacattggatatctttttttattactgttttctatttgttgctcttattctttctttgttcctgttcttttactgccttttttggttttaatggagcattttatattatcccattttgtcttctttattagtttaatgttttgttacttttttcagtggttgccctagagttcacatatgtttacagctagtccaagtctactttcaaataacactgtaccacttcacaggtagtgaaagttcttataatagcaaagtattccattttcctctcctgtcccttatcttattgctgttactcatttcacttgtctatagctataatcatcaaatactttgttgctgttattattttgaacaaacttctttctgctatatcaattaagaattttaaaaaatgttttattttacttttactaattccttctctcatgttcttcctttctctttgtagctccaagtttctgatctatcatttttcttctctctgaagaactttttaatattttgtagaaggcagatctgctggcaactgattccctcaatttttttttttttttttttttttttttttttcctgagacagagtttcgctcttgttgcccaggctgcagtgcaatggcacgatctcagctcactgcaacctcaacctcccgggttcaagcgattctcctgcctcagccttctgagtagctgagattacaagcatgcgccaccatgcccggctaattgtatttttagtagagatggggtttcaccatgttggttaggctggtctcacactcctaacttcaagctatctgcccacctcggcctcccaaagtgctgggattacaggtgtgagccaccgcacctggcccagattccctcaatttgtatttgagaaagtctttgtttttccttcacttttgagggataaattcacaggacacagaattctaggttggtggctttttccttcaacataatgaatatttcacttcactttgttcttgtttgaatggtttctgaggagaagtgcaatgtaattcttatcctcactcctctgtaagtaacgtgttttccccccttggattttttttaagactttatctttgtctgcaatttgaatatgatattactaggtgtagattttttggcatttatcctgcttggtgttctttgagcttcctggatctgtggtttcataaaattagaaatcagtaatagaaaaataactggaaaaatccaaaatgtttggaagataaatgacatgctttaaacattagttttaggaaatagttattattgcttcaaatatttcttctgttcctttctcctccttcttgtattcccattacatgtaagttacaccttttgtagttgccccatggttttgggatattctgacattttgtgtgtttttgtttttgtttttgtcttttttctcttttcagttttggaggtttttactgagataatcttcaagctcagagattcttttctcaaccatttccagtctgctaatgaactatcacaggcgttttcattctgttacaacgttttttgtctctagcgtttcttttttggctttcttagaatttccatctctctgcttacattacctatctgttcttgcatgctatctactttatcaattagacattagagctcatagcatactaatcgtggttgttttaaattcccactctgttaattccaacgcctctgccatatcagagtctggttttgttgtttgctctgtctcttcacactgttttgtgtgtttttttttttttttttttttttttttttttttgcgaagctacacatggtgtattgagtaacaggaactgtggtaaataggcctttagtaacatggtgtaaggtgtggggggaggggaggcactctgtagtcatatgattaggtcttagtctatagtgaacctgtgcctctggactgtggacttcacaaatacttctcattattcctctcccccaccgttagttgggataggatggctaacgtgggatggagttgtatttcttcccccaggtcagttaggctctgacaaaagtctggcaggttaggtactggtaaacatagcttctcttttttttttttaatttaattttattattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaagagtccccagagtgtgatgttccccttcctgtctccatgtgttctcattgttcatttcccacctatgagtgagaatatgcggtgtttggttttttgttcttgcgatagtttactgagaatgatgatttccaatttcatccatgtcacatagcttctcttaagagcaggctttgttaagaacagaacaaacctgctgactgctgatgtatttcagagtggctacttaccagtgcttcttgctggaggcctgaggggatttgtctcaaatcttctctgtgaaaacctggtagggttcctggaggtaaaactcacaaaactgtgtgagcccccttaaaactaattccccctggagtttttacctctaagatgtgtccacactgagctccagcagtttgtcagctacagtttaggttttcctggctaggttctggctctcacagaggtttctgttcatgaagttcagctccagtaagttgtgattctctgtatttaccttttggtctctccaatttggggggcagtggtttgccctgtagcctcagttctccaacaaatctaagaaaagttattaattttcagttttttcagctttgacttactgttaggaaaaagttatgacttccaaactcctttcatgccaggctagaaaccaccaagtcctttctttaaattttaatgatctatttatagatattcgtaagaacctttaatttaattactaagggcctttgagattcatgcagtgcaagtttggagattggagattaaaatattttcggcaaaccatttgttgtaaatcaaaatggaaaataaatttacttgtgtctttacataagattgcaaagaaaattgtttcaactttagttttcctacacaaaagactttgtttcattaagttcacaaagcttttctgatagtgttccaagttttcacttgaaaaaagtaaggtctgaaacgggaggctcaaaagagggagaaagaaaaagagagaaacaaactattacttatcgacaatcctaacagagtctctttcttgatgtaaccctttcagccatctgtagttatggacaaaagcatttgacctgtacaggcatacattgatttactgtgcttcactttatggctcttttgggtatattgtatttttaatcaattgaaaggctactggggaggctgaggtaggagaatggcgtgaactcaggaggcagagcttatagtgagccgagatcgcaccactgcactccagcctgggtgacagagcaagactctgtctcaaaaataaagagagagagagagagagagagggagggagggaggggaggagagagagagagagagaggaaggaaggaaggaaggaaggaaggaaggaaggaaggaaggaaggaaggaaagaaggaaagaaagaaagaaattgaaagtttgtggcaacctgcatggagagagagagagagggagggagagagagagagagagagagagagagagagagagaaagaaagaaagaaagaaagaaagaaaaagaaagagagaaagagagaaagaaagaaggaaagaagagaaagaaagaaattgaaagtttgtggcaacccgcgagggagggagggagagagagagggagagagagagagagagagagagagagagagagagagagagagagagagaaagaaagaaagaaagaaaagaaagaaagaaagaaattgaaagtttgtggcaaccctcatggagcaggtctgtcagcaccgtttttcctacagcatgtgctcactttctgtccctgtgtcaacagctttgtgtaaagcattggctaggcacttttaaactttttcaaagcatattgaacttgggggtgatagatgatgtatatttgaaagcaatttggtggccaggcgcagtggctcatgcctgtaatcccagtactttgggaggccgaggcgagcggatcacctgaggtcaggagtttgagacgagcctggccaacatggcgaaaccccacctctactaaaaatacaaaaatacaaaaaaattagctgggtgtggtggctcacacctgtagtctcaactacttgttaggctgaggcacgagaatcacttgaacctgggtggcggaggttgcagtgagtcaagattgtgccactgcactccagcctgggatgacaaaatgagactctgtctcaacaaaaaataaaaaattaaaattaaaaattaaagaaaatgaaagcaatttggtgataattatattataacttccttcagttccaatacaatgacatttccaaagtgctgttattgatgaaaaacaaaagtgcccacaaacatgctttatttgggctgtgtagtgatttatttttaaatttgaattatttgacaacacgtaaaaattaagagttgatataaagtcgggtctagtttctcctgaaacttgaaatgacttgaacctccatggggcatcagtgtgcaggagctgagttactgttcccctccagctctccacaaccctttattgtcttacactgtcttcctccacttatattacttgcctggtcccagggagacattcatgtttatgacatctgctgaaagtaaaaaggtgtctaatgtgtagggttaatgcatgaaggcttgcagaagacattgagaactgggtttagaaggtggttcacagacatacagtatgtcctatggatatgagcttaatgttgtggtgtctgcctggacctctgtttgatttgagcatgctctcacagtctttacagggcttcttttgtgcttaaagatcagcaattaagtgatgagtgtgacatcactgaaattagtttatgcacgtggaggattagaagggagaaagaatttttccagtacaagcatagcttttattggcacatatatccctcccagccaaccacacaagaagcacagtacctgtcatttcctaacctttaggattagaggaattcaagcaagaaaaggcaaagaggaaagcctagtaaagttcacaatgcttctctttataggcagaacaaaaaagaatattgaggcaattactggcataaatcagtccaaagcaaatcaaagaaattcaagcaaaaagaaggcattttgcctgaattatggagctaatgatctcagtcctccacttcagtgttcctgaggagacctggcctgagaatgtttttccagtgatctggcagattcagaagtgaagagaaaatgtattattgtaagtgcagctatggagatggagtccagtgctgcctctgtccagaacatgtgttgagaacacccaggctcaactagcatggctagctgggaggagagaggctctagaagggatgatcatgatccccacggggcaagagaggggtggtgtcagtgcccagaggagtcatgctggctcatctttcaaaatctttgtagctttaacactgtcagagatgttataagtaattttcatttttctgtttaaaaatatgtctcttttctaacagcttttagcaataaaaaggcaacttattaatgaaacccttctgccttcaaagtatgaaattaaaatattattgtaactacaggcaagaaagcatttggattatgtgtcatttagaaatggtaataaagattatccgtatggtcttatgttgtcagtgccttacattgcattagcaatcacctaatatgagtgtgattttgattatgtggttcattttaaattctgtgtcctaggtcaatcagtgtcaagatgatttactagaaggaggtgcggttttctttcatagatgctgttaagtgcttgggcacaattagaatattttagggcatagtatatttggtattatcgtgctgtgggtgttcttaaaccttctcactgtataccttctccttaggcatctctaattctcatcttgtctgtcttgggtacacaaaacaatctctggtagcaagatctataaaaatttgtgttacctgtttatttatgttagtttccctttaagtcttctggcttttgtacaggtgtcagtcattttagatgttgagtttttgatggtcagcgagcaggatgcagaggccaggattaacctatgtctccaaaagaattagaaatctctctgcttttttttcattctcttccactgaaagagggaacaaagaagccttactcctgctgaacgttgcagggaacccagcgacatgacattttttaaccttctgctctgtaggggttgacaaaacttgatgggaactaatctgggttcatttgggatttgggacagggtcatagccttttgagaattcagtaccttccccttgatcctcctacagcctgagctctctgagctttgtaggttctgtgtcaggttctgctccctgtatgaacatactccaattatacgttcttgactcctcacctagttctgttctttagttttaacaatgtgccttttagattcatctgttatttcatttttgcttggaaaatatttactcaagggagtcttctctttgacactgtatatggtgatgttgacaataatttcgtaaaaacttagtaactctaggagtgtaacaattagattatgattgtgttgtactagaatcattggtcattttaatctagcttataataggagaaacagtgttttaggctgtggtgttttatctttctggttgtttggggttttttattttgttttgttttttgaggatagacagtacctgtttttcatctctgtgtctgcagcctggcagagtgcttgccacaaataaggcactatacatccatctctgaatgaataggattaattcagtagatgttattcctgaacatctgtcaatatacatgccaaagctctgtatcccgttcaaatgcatgcctacataattgaattctttatcctaaggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatgtaagtgcatatgtttcttggcttctaacacatctccttggttttgcaagattccaggtggtactaggggatttcaaaaaaaaaaaaagcttcctgaagaaatttttatgccgtgttggtttcttcagtcattttcagtgatcctttgtgccacaggttgcttagcagagatgttctaaaggtgataggaccagatcagagagtccagaaaaccacagtgcagtttctgtaaagatttagagagcagtgacacgaggctttccttcttttgaggaagaaggcacctgcttctcatcatccttcttgttgtttagatcccatttgtaaactatccaggtgtggaattacacatgggaagcctgttataaaaacagttcactaaatggcagtaacaagttaattgtttatttgtttagatgacaggttctgcctttattatagggctgtcagtgtcaattaataaattaaactctatttcagcttcacaagtcttatgcttcataccaggtgtgtaaaccaacctcagctactgccttcccatactactacctgtgatccaggtagaaggcattattttaggaaactaacaattagattgattatatcaagcacaaaaggagtagttgctttgtccctggtaatctcggagaccagagggagatacctcactctgtggtttagggcacactttggtgagttcaaggtcgggggtttctttactgtgtgaaatctgtgcctcaggcctgagctgcataaccaggattctggtcagcatggggatggaattaaagtgcagctattcctgttacaaaaaaataatcgtagtattttaaaggccggtgggccttgtggctgtgaggagcacagaaatggcatctggcgtggggcgactgggagcagtttggacggtgtgggctcatgtcctaatacccactgtggtcagtgtggtactgcagctcccctccactcctcctcttccagatcacagtgtggtcaatgcacgtgcctgtccctgagctttgcgtttctcgtacacgcggctgagctccgaattcagtcttacatttttctgcttgtagcggctgcagttgtcccacttcatcctcctccatcagtttgtactacacacacacatggcccagtggagcatgcacaggtgctgctttggcaccaatgggcagggcagcactgttgctttcatccttgatcttctttctttaccctttcctgtcattttcagtgcaggaaatagaagctatggggtctcagtgtacccaagctccttcccattttttcatagagttctctctgctttttttgtggcagatataatgtttttcatttaaaaatatgtatgtataatttatttaactgccataagaaagcaacctatgatgcattcgttgtgggctggaattggagaagcccttttggccacacacaggattagaatttttgtagtagcaggtattccttgaaggggaccacacagatacatcttcattttgcagtataacccattaacgttccaaatcttctatttcatggtgaaattcctcaagaatcaatttacttagaatcactcatcccaaaagcaagaatcttctttagtagttctaggtgtttgaagtttgaacaacaagaatattcacttctggacaggaagtttaatttggcagttacttttttgaaagtgaatgtatctgtggaaatccaaaaatgttcatgtacaaacggcagctgcagaggccaacggagcttccacaactgatcggctattagacgttattttttgccttccttcaataaagccaacagaaggaacacagcagtagactttccattttcctcccactctgagcaatgagttctcatcagatctcatctgataggagcgaccctagaggtagatatcataatactgtcttgatgtctttgaaataagacagcagtttctggggaggaaaccttcaggaaagatgttccttagaccacaaggctgccagcaccacacctatgacaagtgtgggtatgcatgagctctttcagggttgggagaaagtgctggaagttgtgaagtgagcagtttttagaaatgagacaaggggaaaaacgaaataggagaatttaaaaataagcatgaccacagttatgagaatggggattaatctctccagcaaagcaagtatgagttgcactatctgctttaatatgctataaaaaggggagaatagatacaggtagtgggaatgggtttagtttttatgctagaagatgaaaatatttttaaaatattttgacaggaaggtgaagataaacacagttattttatatctgctgtgcacatctttaccaaccacataaaaatgtctgcagctaataaaaaggctttattctcactgaccctggcatattttattggtactcatttttttcattcttattttcatccattgtgctctttttccaggcttcttaccataaacatgcgttgtaagtgtgatacatttctattttgtaaaaatacctgtaaatgacaggcagcctgagttctggtctttgttctgtcacgtactgattctacactttaaaaatataaacacaggtaaatgcactctcctaaacggactgctcctggagagttaaaatatattaatatgtcatcagaataattacccagtatgcacagggatttggtcatgcttcccataaatataatggtataattgtgtcttagtgtcctgatgaggaacttagcatcaaacagatcatgtaactacatcagaggagttacaatttagacttaagtttaaccaccttgagcaactttcaagtctttatactttaatgaaattaaactgttttaaaaacactaatcaattaatacatttgaagaggtttttttttacttaaaaaaattattctatcaaggctctgtcatccatgaagagcgttttaaaatgtctcttaaaattaggaaatacccatttttaatgaaatcagataaattggatgggattgactatcctgcttgataaaagagaggaagagaaggtgcaataattcagtcttgagtgtttcagaggaatattttaaagaagagcatttttgtaaggatttaaaatactaaggaacacgcatggagcaccacctttgtttttcataaagcattgtggagtattctctgcatatccaaatatgagcaaggagaggatttagcaaactatgggaacattgacattgggaatcgtctccaaaagccatgtgtagacaccttcttctacttttacttgtaaaattcagcttggcctgagagcagatttctataagcaaagggcagaagtcaaaatagaagtctgatgaatttctctatccaaaatggtggctgtggttgtgggctttctctttatttgtggggtaagaaaagtctttaagtgacgaaaggttgcttgtcttctaaaggataagtaagtactcagaaacaactgggaatgatgatatttcccacatagacatcagtgagtcccggagtcaccgtgggtagcatggagtcaccatgggtggtctcagagcattgtgtgttcagagtgtattacctctctgctgcccctgaccagcctctcttttatttacagctgtgtcttcaccatcgtccttcacaatgaaaacaaatacactgagcacatcggtgcctaattcctattacccaggtaacagttttttccattgtctcctctctgctctctcctcagcagtcagaatcactccgccctctctctgctatccctggtgcttgaggggcttactgtgtttgagatgttgtaacccaatgcgtttctacagctttctatgcagaaaataggggtgggcattcatcaatcatttactgttctttctctttttactttctctgcattgacctgcttacggtgtatgacagacccatttgtgccaactgcaattttaggtgagaacatttccctttaccacagtttattgcaggagtaatttagaaagtcagtgaccactctgtaggagattggagttttaattctgtataatgcagtgattataagcacgacatgtgggaggtgggtggcctgggtcatggggttaaaggaaaaagagacttttctctaaacagtcgccattaataagaggggtttgctgcatgtatcttggggatgataccaacaggttcaaatgaacaatctcagccccaatattctccctttctgtgttcagaatttaaagttaggtctgatcccaggggaaaaaaacaaggtgtcatcactcagctgtgtactttccaagagctgaattctgtctagtgtgatagtcataaaagtgaaaatagcttctcattattttcacttattgctaagcactaaaaacttcaattttaaaagtagcgtttttctaattatgccaaatgtcatgcagaaaaatgatcacaatggacttctggccctctacccatcctcggtgccactcagggcaccccacccccccaccaacattccaaagtgtctgtcacacagtggaatttcaaaggagctgatgatctgaacagcaaaatgacaagatggcacttataatcatatgctttattatgtgtcagatgtcactagaaatgaactaaggtgttagcccggtggggcagaatgcatttaaagtatgaaatattcccagcagggggttacagaaaaagtcccgtttgtccaatataagaagggtgaggagaaaaatggcattacctggctgtgataaccaaacaagcatgagctgctgttgcatttgagacgcataaataacctgagtgtatcacggctgtgttctctttctactactaacctttccgaaaaggagcacaacaaaaacgacttcaaggtatataacaattcattgtagcaagagttccaccctcagttgttcgacttctccttcctaattcacttgacaagggtttatatctttccaacatgatttttcccccctctgcttctcttttctctaagttgttacgatttttgtatagaaggtaatttttattttcctaatggtgttctgtgggcttaagcaagtttgttgcctaaggaaaaaatgaattaagatagaactttaagaatggatataaaacagagtttttaaattttgcatcattctgagggctaacaaagcccactaaaccctccctgcccacacacttttaataccaattaaaaggggaagaaaattgcattttattcttttcataagtgaggggcacaggctaatcttaggcaccagaacaatgtaatctacatacaaatgacatttgcagaatcttttgataggcgaagatttgcgatttcttcatgtgctgtggcattcattctgaggttcctctagtagattttctgaccttgggggagccgtgagtggggagggctaaaacgtgccttgtcagaaggaagaaaatgttcagatttcacagcagggttaagacaagcttattaaacaaatatcattctttaaagtcgctgctttgttattatgaacattaatgacatcttttaaagttgattagttttctttactgaaagggaatcacttggacagacaattcaagtagcaaaaatgatgcacattgtaaaaaataagtcacccagatagaccaataactgttatcatgtatggcttatataggtaccaaatggtagtacttgggaactgcattccttacacgttacttggtgcaaatgtgaatctatgtattgagtaacaaggattggtgaggttagcacttgaaaccacggaagaatttaagatatatatatctactctggcagttttgggggatagtagcagttataatttacacaaagacaacaagaaatgtcttgctgtgagtcagagctcagcacaattaaattctctggcaccttcagctccacctctctcatgctaagatgcccagccctaatgtatagagctggagtatatctttacttcatttgcttgcaaaaatgtagatgattaaatggatggttggatagctggatggatggatggatggatggatcgatagatagacagacagaacctaccctacctcaaatatattgcatccatttcaacttaaggtttttcagctagtttgttaaaaattcaagataattcataaagaatataagtagaactaattttcagttcttagaaaaccatcaaaactattagtgagaagctttgtttctttatttctaatgtgctcttctgcattatttttaattaaaaaaaatgttgaggccaggcactatatagtgcaagcatgtaatcccagcactttgggaggccaaggcaggaagatcgcttgaggccaggagttcaagaccagcctccgcaacataaggagacccccatctcttcaaataataataataataataaattagccaggcatggtggaacacacctgtattcccagctactcaagaggctgaggcaggaggattgctggagcccaggagtttggggctgcagtgagctatgatagagccactgccctccagcctggatgatggagaaagaccctgtctccaaaaaaaaaaaaagtagaaaaaaaaattgttgatgggtaatttttaaacacataaaggaaattaatgacaagtaatatattttatcaataataattcttttttaagttagagaagattaatcactaattttagtggaatcaagaatgtctagtagtataagtgacccaatttcatagcagcacacaagaagccttctattccctcttccatatgcatgtactagataatagggctcttctttcatggacttggtggtgtttaaatgcttgaagacgtgttccacactagtaatgagggcaagatggcataatgcagcacaggatgattacatacaacagtgacagttgatgtagctctatggatttaaaacttccaagaatacctagccctgggatcagagcattgctaggttgctggtgtatccacgtgaaggacccagatcacttctgggaagtttagaaggtcagcccaccatggagggcatgttaattatgttcatcccataagatacaaaactgagagaacgagagaggcacagaggggaaactaattaatgttccatttattttagtataaagaacagaacttcctgctggagtggctcaaagctcaagggattcggtacttcagcagggttcctgtatcccagtttataaagcttggcagttgccagcaagcaaatctgatgtgaaaatttccaggtttatttgtgactgttaaaatgggaacatgtgacttgctaaatttcaaagcaaatccaaatgaaacaaaaatcataaaatcaacttaccacccttttttattttgtctttgtgtctttagccacgttgtagtgatccaggtgccatttcagcaacagcaacatagctacacacttgtgtaccacctttcataccatgcatccccaggtgctttgcgatgcagatagaagtgaggttcccaaaccaggccctgctcatcaagcacccttggactaaattttcttcagagctgaacttctccgtaaaaaataaataacatatgaataactatagctgaattccctattgatatacaatctggtaatttttaaaacttgaatatatcttttatatgttttatataacattctcattttaagtgactttagcattatattttgacagcacccatcctcaatcataaaactgctaaagggattcagcattataatgagttaacctgtagaatgtggaattcttaatctaatagcatttccctgcataagacatttttaataggtaccatttctgcagttcattaacctaattttctagtaggcctccattaaaatagagcctctttaggcttctttgaccaaattttgacattaattttatagtacaatttggttgacttgttcaagaaatttaaatgagaaaatgtgttgaatacaaataagacttatttagacattacttggttcatgggggatgaaaagcaattatgatgctaattttaacctcctttttgttatggagtacttaaattcaatgcctccatcctaacgtgatggaagaattgaggcttcgccctctgaccacctctgaatagaaaacttaactggaaagttaaagcataaaataaaaactacctgtaattatgcacgcagtactattgcttatgccctgtttcctttttctcctccttttttctcctgatatgtatcttcttaaaagtgccaataaatggtaagttccccgattcgccccatggaagagttgtggagggagtgggagtgtgtgtcttactggtagattctgacaaagccagctggtgctgctctgtgctggcctgcatgtttgcctttgtagaacattccatgtgtgatgtgttggtccacaacattttgtcaagctttctgataccagagcatgcaaagtgattcatcaaaatgttatccccaaaccaggttcccttttatttttccattcttctttgatttcatgtattaagtccccatttccattgctagctttataagccacaccattttgtgcacttttattttgctcacagaacatttgtgcagagtttatttatgtcatcatacgaactactgaactaatgtttcaaagaatacaagactggttttgcaccaggtcttgatgaagtttcaggttgaaactttcacaaactttagcactggaaggctaaagggctcttctcaattagctttgtgaaagcaatatatcgtttggactgctttgtaaaagaaagatttctgcgcattcttatcagtattgccaaccccatttaaatttctaaacatttaacttttcttttttgctgagccatcgtagggaattttgcacccctaggtgaggggatgccaggagccagcttcttagcattctcagtgatgccgacctagctccctggctctccctcattttctccctggccttcttttcctagatgaaacccacacaatggccagcgataccagcagcctggtgcagtcccatacttacaagaagcgagagccggccgacgtgccctatcagactgggcagctccaccccgccatccgggtggcagacctccttcagcacatcacacagatgaagtgtgcggagggctacggcttcaaggaggaatacgaggtgagcacaagctctgtgccagggctttcccattccttcttggattccatgccaggtactgtgctcccaactcaatcagaaagccagagaaaaccccctgccccgagagatgccagaaagagatgaagtacagttgtccctcagtattctgggggattggttccaggaccccagtatatgtccaagtcccggtgtgagccctgtgaaacctgagaatccaaaaatccagtcctccagatccatgggttttgcatctcaaagatattatatatattcttttcaatcctcatttgattgaatctgcgggtgcagaatgctaggatatcaaggccgactgtattttatccgtggatccactttcatctgatagtaaaacttgttaccaagaagttcacatgcgttacatggaaaaaggaagaatgctttgccttttaccttattctgcacaaatacacaatgaaaacaaatttaccagggtctcttcccctccccatcctgttttttttccctttttttcttcttccctctggcagaattaagttttagttcatgtctccctccccattcttgatcacctttcttggcttttcctgtaattatgatatgaaatcctaatgattttgtagtcattatctcaggaagaaactgtccacttaaagcaattatagaccaaccagcaatgtcatgtggtggagatcagacagcagtacagggactggctattgtcatggcagtgacagctgttactgtccagccagcccagagagcatgccactgtcttgggctcttgtgtgggcagctgtcagggacatttctgggaataatgatattctccgaatacataaaatacagggcttacccctttcacaccctgtgccattagttaattctgtcagaaggtcattcaagaattgaagagaattaattgattgaagaaatctaattcaaagaagcatgccatcccttgagtgggtggtgtggggcccagggagcaggacaggaaagttggattgcttttttatgttattaaaatcagtccgcagtcattgatgaagttaaagtagcatgcttactcagagtaaaaataggattatgtagacatgtggtttttttaaaccttagaatgtggttctggtctcatattcacctaactagctcagagttgggaaacatcttgtctggaattagagtgtttttgaaatctgtttctaccacctggatagtctgtgagtttccaactctgtttcttctcttcctgtgggcacactcacaacacttcattttatgccccagacactgcattgtcttgggtttagctctttttccaagcttgatcatcagagattcattacagcagtcaaagcaacacatggtaccactgttggcggagcctgtgctacacttcttttaggaataaggctttggtccaaagcagacatagacacactttgctctgctaacatgtgcatcctggtgtattgccaatgacctcagttcagaagactgtgaagccaaacaatcccatccagaccgtgctccagggtttaattgaagtccagaaaatattttcagttgaagttctgccttttagcaaccctgaaattcttagatttatctttagcaattcaatgtgtaaattcagtgaaattgactgcctttgcatatttcctcatgcacttttaaagtctagcttaggaattaataggattaagagtaagacttccaaaagcttaatatcgtatgaaagacaaaattaggttattgaaaaaatataagcctaatgaatagggatgatgtctaggttctatccaatattctgaatgcagatattactgaaatgtttattaaagatgttaaagagattagttttaggctcaaataacaattcatgaaataacctgagcccaattttccatggactatttaaaaatacctacttcctataacatgctacagacaatgcatatttgaaagatgtagaaaatatttcccattcagatcttttgaataaatatgatttataagtataaactgaaatattatatactaatttgaaccatattatgactgacaactaattcagttctcaaaataaagtgttgtattcattaagtacattgcagaaaactttttctcattttagctattccgtggtcagagaggactgccaaaaagtgaatacttttaaaccctaaagccattgttcatttaaaaaaaaagaaggaaaggaaataatgaacaaaacacatatactagagatgatatcaggaacaaataggaaggagatgttgggagaagtatgaaatgggcagttctgttaggaataatcccgtcactgagtaccgtgccccttgtgctgccctcctggagggatgctgatgttgtcgtctagtggggtagatgacagggaagtgaggagtggtgatggtgggcgggcatgcctgtgccatggccgcagggagaaggggacgccccctaagaagcgtgtgtcatggaatgacatgctctggtcttgatggaggcacagccaggcttctgggaactggtggtggagtgaaaggtcccagactgcaggtactcatatgtcccactttctctaaccccagggaggtgttattctcatgagaatctggcaaatccttaaacagttatttttttgaagtttatgtagtttttagacctctaataaaacagacctctttccatcatgctgtaaagtctgcatccttttcattaacacccacccagagtcaagagtgttgagtgctaactggtgtagtgggagtctctgtgctattcagtgaggccatcccacccaacagatactgagaggctgtggtttggaacacaggctctggcacccgactgcctgtattcaaactcagctctgcttcttagctgtgtgaccttcggcaagttatctaacctctctgggcctcagtttccaaatctataaatagaataattatagtctcaacctcaaaaggttgttgtgaggagtaaatcattttaatgtaggtgctagaattatatctggcatatagtaagtgttcatttgaagtgttaggtagtagaagaaaaaaaatactaatgtataataagaccaagagcagaagttgacaccatgttctttatagggaaacttcgttatactgaggtttcagtaaaactctcatctcttgcgcatagcagtctgaggatagagtgagccacatgttatggaaaggggttatacttttccttcatctccagggctggataactttcttaccatgtaccatatatcatcaaaaattcccgttaacaagtaacttacacataaataggtagacttgattctatggattaagagtttaagaactgagaaaataaattttaagaaatatatgctgtcatgttttattgctataatagtatttccatatctaagttggagagtcctaaggaatactataactctagactgcataatcctcctaaaaaattattggttgctgcattggtgtctttggcaaagtaggatttggggaagagtttaattttaccaatcatacactgtacatggcgccagggatacagagaggagaactgcttctccgctgtcccctggggaagctgacagggcaggagaaggcagccaggtaatgactgtagtttgtccagtcaaaccccacaccctctaagagagatgcgcaggcatactctgaaggccagtggggtcacctgagccagccaagagcaaggatgacttctctcttggaagatgagtgggagctgaccaagagaaggtgaaagagggtagccatccaggtagacccaaaagcaggagaatggggttctctgaggaaatggcaggagttctatatgcctgagtcccaggacgggctggtctgtgggatgagggtggtcagggctccaatcaccaaaagcacctcctgtgtcacactgagaggtttggacatcattatagaagtagtaaaagagaagaaagactcaaatagcctgagtctcattcctgtacttggatggagagctatttagtctgaacagctcaattttaaaatattatttgtatgaggcacacaggcaatgcttaaaaggtaataccccaaaaaagtaaaggagaaagggaatgtgtatttactttaaaagttcctgttgttctatctctattcaaaaatgccgtggaatgcttggcttcaagacttgttgaagcagtgaattacttcagtactgaagcatctttggggataaaatctaaagaatggctctggttgttgctgtgactctgtgtaatcatcccatcggcctttctggtcttcttcaatctgtatattatcaggaaaagccagtcatttatgttgtaaaatttttttgaagtagtgatgttctctctgctgaacaggtttcaaccaattcttctttatcgttttcaagacagcagtgtctcaaaattggcctaaacaccagaaggattcattactgatcaagtagccgacagaagtatgtccgaacaagagcataccatgtggtggggatgagatggagcagagctcagtgcaggttttttatttgattttgttctaacaaggtagtcatatggcacctctcaccagggagatgcaataatttgattcaaaagaaactcagacatgaatcacaataaagaagtaaacatgctgaattgaacagaaaatggcatgttgtcaacagagagtggtgcagggacctctccaggagaggagaaagagcagaaagggcaagtttgtttatgttgctgtgagagaagagctgcctggttcctctgacaagcaaagggcagtctgtgctaagcctctggggggaacctttgggcttcccagaaaagtagaagagagagcgcttcactcacgagggacagacaggtcagactcagccaccctgccccacgcagacttctgggcctttctcagctagagttgaacagggacatttgccatgactgcagctctgccctgaaccctcacacccagccctagacaagggtgtgttgcaccccttgtaagtggcttgataccacgtcaggtccaacgttgtggtgatcctgtgcgagtggagagtgagttcctccccttttgcagtccccaaaggaccttgttgatggctcgattattttttttatgcctcaatttttgaactgattctaagtccctttggggatccaagcagaaagacaaccttaagtaggaaaacagccaaattattctgaaagaatatgttttgctataactgtaaaattaagataaagaaaggatgtcagttgaaggctacttccagagaggatgtcctgaaaaacacagatggtactattttattagctaatagtgtcactctggggcacaaaaaaatgatttccaattactagagctgaaacgtatcaaagactgaagtaactctttgcatcctattcttcaaaaaaaaaaaagtgtgtgtgtacatgtatgtatctaaatatattaagaaaagcattatctttattccacgtactttttttgtttttgtttgttttgtttttgagacagtgtcttgctctgtcacccaggctggagtgcagttgcacaatctcagctcactgcaacctctacctctggattaaagcgatactcaagcctcagcctcctgaaagctggaactacaggcttgcacgaccatgcccggctcatttttgtatttttagtagagatggattttcgccatgttacccaggctggtctcaaactcctgacctcaagtaatctgcctgcctcagcctcccaaaatactaggattataggcatgagctgctgtgctcggccccacctacttttcttatattatgcctctctcctgggcacaaacactgttaattaattttatagttgaatgtgaagattgttttttagctcagtttaaactggggaattgaaaacattatgccagaatcttcagaattaggtacagcctataaagttttctgaggaacctgaattttctttaaacacgtctgtctccttgtagctccttttaggtcttttttaaacatatgagttgtatatccccccacctcttatccttcccccgttttctaagtaaaacagctgactttgttaaatgcaagttcagtgttttatttgctgcctttgtctatatttgacaaagctgtggcaacttaagaaaaaattattattaaaatgtctcacctgcactctaaaatcttgcttttttttttgtgacttagtctcactctgtggcccacccaggctggagtgcagtggtgccatctcagttcactgcaaccttcgcctcctgggttcaagtgattttcccaacccagcctcccaagtagctggagctacaggcacacgccaccactcctggctcatgttgtatttttagtagagtttttcaccatgttggccaggctggtctcgaactcctgacctcaggtatctgcccatcttggcctcccaaagtgttgggattacaggtgtgagccaccctctctggccccagatctccctcttatttacttgcctcctacctcagtgaagccagctgttcttgtctgtttaatgtggctacaacagaatacctggggctcggtcatttgtaaagaaaaaaggttctgcaagctgggaaggagagaagcatggcactgccttctggtgagggccatgtgctaagtcaaaggggaagtggacacgagcagtgagagaggaccaaacagaaggagaattgcttttttcattttttttaagagacactctgttgcccaggctggagtgtagtggtgtaatcatagcttactacagccttgacctcctcagctcaagaaatcatcccactcagcctcctgagtagctgggactacaggcacgcaccaccaagcccagctaacttttttaattttttgtagagacagagtctcactatgttgctgaggctcgtcttgaactcctggactcaagtgatcctcccacctcagccccacaaagtgctggagctacaggcatgaaccacctcctggaattgctctgtaacaacctgctcttgtggtaactaagccagttttgccagagcatgactcactcattagcatgaggatggcaccaacccattcatgagggatctactcccctgatccaaacacctcccactaggccccatctcccaacactgccacaccagggaccagatttcaacatgagttttgatggggacaggcaacccatattcaaaccatagcaccagcatatcctacaaaaagcactcccagaaagccacctgctctctgcagagatcgcagttctgactccctcccttcagatgcccttccatgggaaaggccttgaactggggaggacagcccctggaattttgagaccagcccagcagcagggcgcgggaggaaggcgccccgggcatctgggctcccccttgttgggagttggttggcagagggagaattgcacacacttctagacgacttttcagaatggtgcacagcagccccttcgctggcttttgcacaaagaagcaggggcaggtggaatcaaaggcgctttgtgttactcagctgacagaacattgcctgtgcacagctggttcatagattctgtgtgcagtccagagggagaggcgccccttccctcacctccagcccacacacttttcagatgtgcttttcagttcctgcttcatatttcgagggaccagctgagtcaatcaattggcacaatcagtgcaggttgttttctgtcccataggatacaaaacaaacaaaacaaaaccaaaccattgaaggctaaggatggggagctgggggtggggaggcactggcaggcactgtaaatgcattaagaatcacacggctgtgtctccaatggctgaagcagccaagtgatttttgacgctcttttttcctttaattattatggtgctggtgagccaggtccataagaaaatgataaacacttctagaactctgaaattttgagatggcttcaagctatttgggcaagtaaggtgtatgtgtttatgggtactttcttagtgggtgaaagtttctgcgtatttttaaataatgcaatagagagttggttttgacatgaatatttggtttatttttttttctgaagtaccagtagaaaagtgtgttttatgtgttgcctgcttcactcagtccgcctgctttcggggcctctttcacatcagctaattttttatacagttttcgtttgcccttgcctctgatgacatcatatacaagctcagacttcagaaaattagattaaaaattgttatttcctacaactctccatgctcccgctgatgataattcatggcagttgatgttttcctatttgtgtgaagcacttctaggcaactgtctggtttccattttgaagctggttattagaattttctgtatctaacctgaaagaagttaagcaattttcccacttgttaacatgcttttagtgtcagatgccattagccacaagtgccttcttggaggacctggcccagaaaggatagtgaacgtgcccgtgtgccagcatctgcggaccttatgtgtgtctggtactggtcctcctgcttttgattagtttgatgctgtcaccgcccactaacatggtcaaactagatatttcacggttgccattgcccctgccgctccctcatttccacaccagcaggctcaagtcccaactgctctctctcctccccattttcagtggctgccctctctcccctcccctagggcctgccctgatcacttgtctgtgccatcggaagagtcccctgacttgtcttcctacctagtctttccccttcaaatctgttccagactctgcaaccagttttctttgtaagacatggatgttatcatgtttgactgatgctgaaaactatgccacggattctttccaaaaataagaacctcagcatagcacattcagccctctgtgtcaagacctcactctgtgtttcagactttcgttgtaatgcaggtgcttcccaccgtgcaggctgtgctctgcttctgctcatgtactcgccaccctgccatcctccaggcctccagggctcatgctgcaggttgtggcctctgcctggccgtgacttcagctcctccttcacttgccaaatccctttggacacagctcagatgtgactgccccccaagctgtccctgatcccaaccagaaacaaccattccccctacagtctcacagctctgtgtttgaataatatagtaggcaatatattaactgataatacagtaggcagtatattaactgataatatagtaggcaatatattaattgatttattcagtacgtatttgacaaacaatactgaatatgtgctgaattgatttctatgtagttacaccttgtaattcatatttgatgaattgatttctgcatatttaaacacatacacctgttcctggggaaatgatagagatggatatagaactattaaaaaatacaagctcagaatgttacaaatcatcatataggatcgggtgggctaggggtatccagtcagaaaaactgtatggaccaacttgaacctgatcaatactgatcacctaaaaatggaaagcatagatatgttccatttggtcattttacttattgaaagccaacctgtttaaaaatttgaggatagacttttttttttcaaggtggagtctcactctgctgcccaggttggaatgcagtggtacagtctgggttcactgcaacctccatctgccgggttcaagagattctcccacctcagcctcccgagtagctgggactacaggcaagcaccaccacacccggctaatttttgtatttttagtagagacagggtttcaccatgttggccaggctggtctcgaactcctgacctcaagtgatccacctgcctagggctcccaaagtgctaggataacaggtgtgagccaccactcccagctgaggatgaacatttttaatacatgtttgctttacatttcttatttaaccttgtggcaggaatgaaatatatttggtctttgtgcctggttcctgacactgagctcttaaaacccttgggattttatgagtgataagagcatcttttactaaaatctaacttgatgctaatgttgacttagagtggagcccttagctagcctcaggatggggtgggtctccagaaaaacctaatgattagagagttggaactttttcagccccacacaccaacctccagcgaagaggggtagaggcagctagagatcacactctctaaaaactcgaacaagctgtgatgagcttctgggctgctgaatatatacatggaggtgctgggtggtggcacatccacagagggcatggaagcttggcgtcctggccccatacccagtcctacgcacctgttcgtgtggttgcttgcctgtatcctttataataaaccagtaaatgtgtgttccctgagttctgtgagctgctctagtgaataaattaaacctaaggaggatgtcataggaaccttgattgatagtatagatgacagcctactactggggactggcatctgaagcggggggttgccatcttgtgggactgaggcctcagcctatgggatctgactccaggtagaaagtgtcagagtggaagcgaatgagaggaaacagagttgatgtccactggagagttgtttggtgtggaaaaatcctgcacgtctgatgacagcagtgttctgtgctgggctgaatgtgtgagaggagaaaaagcactttggcttttcctatctcttaccaaccgctaatagaagcaatgtagaattatttacatgagactgtagtgcatttcataacatgactattccaacaaagaaactctatatcatcatagacagtttcacagctcataaaggcatttcagaggcaagtgaggctttgaggggtggactttccataagtcttgcttggctgctagaactttcatgatgttgagggtacctgcccttgtactaacacctactatatcggcactgtacaaagaacacaccaggccgggcgtggtggctcactcctgtaatcccagcactttgggaggccgaggcgggcagatcatgaggtcaggagatcgagaccatcctggccaacacagcgaaacgctgtctctactaaaatacaaaaaattagctgggcgtggtggtgcgcacctgtagtcccagctactcgggaggctgaggcaggggaatcacttgaacccagcaggtggaggttgcagtgagcagagatccgagattgcaccactgcactcctgcgtggtgacagagcaagactccatctcaaaaaaaaaaaaaaaaaaagagtacacacctacacacacagcacacacagagatgtttatttctaaccacaatgctattacattactatcaaacccattttccagatgagaaaatgagtcagaatttaagtaactcgccccaggctgtcctgtctagagttgcaggcaggctggagcaacacaaagcctgtgttctttctactgaagcacatgacttctgtatgaaactccatgaagacacagacctatggaaataaccttgtgttttattgatgtgacttgtgatttcaaggcaggaatgttagttttcctctctgctgttgtgtttgctttgaacagcgatttgttctttggcagaggacccatccagcctggggccccgttgacagcgccaattctgctgtgtttcagcagctcagcagcagcagatgctgtccattaatctcactcagggtctcagctctgtgacatgaggtccctgcaacattgctcctccctgctctagtttctcattgtctgaggaatgcaggaaaatcattctgaagatatccgccatcctggctcatctgacatgaccagttctaggctaaaaccaagctacagctcttgagagccgtagattccatgtgctgctctcctgggttattgcgtggctgccaaccaaccttgcagcaggaagaagggagaagagaagaagaagacaagtttgtaagcctgagttgggcatgaaagcccaaggttttctaaaaaatcttctctggaagttgatgaatcttttttcaatggaatgatacaaaataactgacaatcttattaacctcatggcagagccaagaaaacaccttatgctttgattaaatgatacaaaaaataaccagttgaaaagtcaattttttttcaaataacagtgctgtgttatagaaaggacagtggattaggaatcagaaggcaaatgtgggtcatggttcctctctgcgaactctctaacactggaacattgaggaaatcacggaacttccatgaaggaacttccatcagttgtgacagcaactactcacaaaatgtctctgatattagcagtagtacggtctccttagagatgctggatttccagtttcatgggcgtattctcatggatggaatgtttttcagtgggcgacactaactggctgttggagatctgtgtggggacatggccatcacgtatgatccacaggcacttctctggttctctgtggctggttctgattttattccaagtttctgaatgaggtggtttctatcccgatgtgcccttcctatcttttcttcctcttgtctcccctcatttcagcctcttccgaatctcacttctaacccacaccccatctccaaaacactgggaagtctgcattgagatgataaggttatagtattagcacacttttgtatcaagttctcacagtgtctgaaatgtggttatgattccatgatgtctctaatccctactcacccagttcttaagaatcatgggcaaccccgcttgggtccccttccacgctgtggaagctttgttctttcgctcttcactgtaaaccttgctaccactcaaaaaaaaaaaaaaaagaatcgtgaatgataaggaaataatgtggactaaatgttttgaattacttaatgtttgacattttacagtgtataaattcgtattattgtcacatgtatcattcagaacacagtaatattgaattagagcccatgtttttgaccagtcatgtcacggaaaagaaagggaatatgctgacttttccaatttctattgtctcttctgaaataaagtacttttatgtccatgattgaaatataatcaaattggctggatgccacggctcatgcctataatctcagcactttgggaggctgaggtgggcagatcacaaggtgaggagtttgagaccagcctggccaatatggtgaaaccccacctctactaaaaatagcaaaataagccaggtgtggtggcaggtacctgtagtcccagctacttgggaggctgaggcaggagaattgcttgaacccaggaggcggaggttgcagtgagccgagatcataccactgcactccagcctgggcaacagagtgaaactctgtctcaaaaacaaaaaaaaaagaattcacccatattattcattatgctatagattttaaaaacttcttcactccctttatcttctattatcgccctttagggagacatggaaaaccttttatctgtttacttcagggaaactatatgagatactgaataattgtaatgtattcagtgttaattataaatacgcagcgtatgtttttatatgtattgtatttatgtgctttaggtaattatgcatgtgagttccttgccaattttatggccaaaatattttacttggctgattactaagtatattttaagcttacttcttgaaacatgaagagaatatactataaatccaattaacataatttatctgcctaaagagaatggttgcttttattttttttctccattttaatgatgaaaaatagttgtaagagtatggagtatttaatttgtttttaaagctttccaggcccaattttgttgttttcttttaagagaaaaatataattttaaaaagaaatttggaaattttaaagaaagcattaaaaaaatcacctataactcactatcaattttcaataattttctgcctaatattttaaggcattacaatcttaacacaaagagtttcatatcttatttttacacttaatattatatcccaaatgtttcctttatcttttctatgaacactgctataaataactcttaagatttacctccattcctttctaaagatgtatttcaagagatgaaattactagttcgaagtatataaaatgcttaagattcattacatactcctgttttgacaacctgttttcatgaaggttgcataagctcacattcgcatcagcactctgtaagaatggttacttcagttcctcactaaaatggctattaaacttttaaaagatctttgccaatttgatgagtgaaaaaagattatttccttattgttccatttgaagctatacatgtcttcatatgtttactgaccaggtgaaaattttcttttgtgaattgttcgtatcctttgcatctttacccactagagtattattatttgtctcctactaatgtgtctaagctcttttattgcctacctttcctttcttctgtagaaacatgttgttaattctcagtatttgtgtttccataattttagaatcaccaaggccatgggaaacatggacaattcagtcagcgttaggaaaaactctgtatagttttgtttgaaattgcatgggatgcatttataaatcttgggagaattgtcttcttggcagtattggctgttcctatccattaatatggtttatgcctccatttgtttggatcttctttaatgtttttcaataaagcttcaaaatcttctttataaatcctatacatcttttggtttgataagattaaagtatgccaactaattggataacctagaagaactgggtaaattcctagaaacgtacaacttattcatgaagaaatagaaaattcaaatatagcaatagcaaggagattcaatcactaatcaaaaatctcccacaaagaaaagttcatgtccagatggctttactggtgaattctaccaaacatttaaagaagaattaaggctagtatttctcagatgcttccaaaaaagttgaagatgagaaaacagttccaaactcattttacaaggccgatattaccctgatccaaagccagataaggaccctatgagaaaaaggattaaccaatatccccagtgaatgtagatccaaaaattacccacaaaacactagcaagccaaattcaacagcacattaaaaggatcatacaccataatcaaatgggatttatccctggggtgcaaggatggttcaacatatgcaaatcaataaatatgataccccacattaagagaatgaagcatataaattatatgatcacctcaatatatgtagaaaaggcatttctcaaaattcaaagtcctttcatgataaaaactctcaacaaattgtgtatagaaggaatatacctcagcatatatgaaaggccgtatataaagtttccagctaacatactcaacaaagaaaagctgaaagcttttcttctaacaagacaaaggtgcccactctcaccagttctgttcaacatagtactagaaatccaagccagagcaattaggcaagaacaagacattaaaggcatccaaattggaaaggaagaagcaaaattgtctctgtttatatgtaacatgatcttatatatagaaatacctcagagactccaccagaaactgttataactaataaattaatcagtaaaacaaaataaacatacaaaaatcagttttacttctatacacaaactatttgaaaatgaagaggaaaaatcatatttataatagcatcaaaaagaataaaaatacttagaataaatttaaccatggatgtgaaagatctatacactggaaactagaaaacatttataaaagaaattgaagatacaaataagtggaaagaaatacccatgttcatggattggaaggcttaatattgttaaaatgcccatattacccaaactgaccaataaattcagtgcaatctccattgaaattccaatggcattttttaacaaataggaaaaaaaattctaaaatttgtatggaactacaaaggaccccaaatagccaaagcaatcttaagaaagaataaaactataggcattagactccctgatttcaaactttattgcaagctacagtaatcaaattagtatgatcctagcataaaaacagacacagagaccaatggaacagaattaggagcccagaaataaactcatgcatatatgatcaactaatattttacaagagtgccaagaatacacgatggggaaaggataatctcttcaataaatggtgttggggaaactagatatgcacatgcaaaagaatgaaattgggttgctctcttatactcacaaaacttaacttgaaattcttcaaagacttaaacatgagacccgagacagtaaaactcttagaagaaaacctagggaaataccccctgacattggtcttggcaatgtttttttctttgtttgtttgttttcttaggacccactacaaagcagtcaatgacattttcgatatgaaacaaagacataagcaacaaaaccaaaagtagcaagtaggtttatatcaaagtacaaaacttctgtacagcaaaggaaacaatcaacaaagagaaaaagcaacctacagaatgagagcatatatttgaagaccgtatatctgataagagggttaatattcaagatatataagaaattcatacaactcaatagcaaaaaaaaaaaaatccttaagaatgagcaaataacctgatacatttttccaaggaagatatacaaatggtcaataggtataataaaaggtgattaacatcactaatcatcaaggaaatgcaaatcaaaaccacaatgagatatcacctcacacctttcagaatgacaaatcaacctaagtgttggcaaggatgtggaggaaaaggaactcttctgcattgttggtgagaatgtaattttttaccaccattatggaaaacagtgtggagattccacaaaaggttaaaaatagaagcatcttaaagagacatctggactccaatgctcattacagcattattcacaataaccaagacatggaaacaacctaaatgtttatcaatagatgaatggatgaagaaattatggtgcatatatgcaatggaatattattcagccacaaaaaaagaagtctaccctgccatttgcagcaacatgaatgaaccttgaggacgttatgcaaaatgaaatacgtcagagaaagataaacactgtatggttttacttacatgtggaatctaaaaaagtcatagaaacagagtagaacgatgattgccaggggatgggggttagaggaaatggagatgttggtcaaaaggtacaaactttagttattagatgaagaagttccgggaaactaatgtacagcatggtacagcatggtgactgtagttaattatacttattacatacttgaaatttgctgagacttaagtagatcttaaatgttctcaccacacacacaaaagtaactaaattaggttataagatgtgttaactaacttgactgtggtaatcatttcacaatatatatgttacatgaaatattttaaaaacataggttgacaagtacccttaatagcttgtcagttatgattaggttaaggaaattccctttaatccctggtttatttatattatttaccatggatagatactggatttgataggatcctttttagcattttttgagatacaaaataattatttgatttctcttctttggtatgttaacatagaaagttaatataacatatatgtgatttatataattaatattattattatataccaaaaagccaacccttcatccttgggataaacctaacttggtcatgatatatattaaacattgctgagtgctgttaactgatcatttttcattcatgttcataggcgagtctaatctgttagttatccttattatattttcatattgtgattttagaattaaaataatatctgctttttaaaatgagtggaatcacattctgtatttttttattctcttaaaattatttttcccttaagtgtttaaaagtcacctgtaaaactggctagatctggcaatttccccatgctaaaattttagattactaatttttttcagtagttaataggtctgttacagatttctcatttttcttgagttaattttgatagttaatattttcatatgaatttctacattttatcttttttatttagaggcatacatttcttaatatattcttatctttttaatttgtttctactcatgtttctttatccctttttcataattatatagtttatttatgccttcttttttcctttagcattcctgccagacgtttgtcagttttattaatcttttcaaagaaataacttttgttggctgagcgcagtggctcacgcctgtaatcccagcactctgggaggccgaggcaggcggatcacctgaggtcaggagattgagaccatcctggttaacatggtgaaaccccatctctactaaaaatacaaaaaattagctgggcgtggtggtgggcgcctgtaatcccagctactcgggagaggagaatcgcttgaacctgggaggtggaggttgcagtgagccaagattgtgccactgcactccaagcctgggtgacagagcaagactctgcctcaataaaaaaaaaaaaaaagaaagaaagaaagaaaaaagaaaaagaaatagcttttgtgtttgttgatctttaatattacattttttaaaaatttcttttaatactgttctttattaatttccttctactttctttgagtttattcttttcttatttttaaatgaggtgctaaacacattaacttgccctctttttttcaaatataaacattgatttgagagtattgatttttcctctaagtattgattttcctctaagtaacacttgccctgcatccagtaagtttgacagtatttctattatcattgactattaaatatttttagtttttaatatgaattatttgacccatgaattatttagaagcatgtgagtttatgagtgtatattttagttctcagtgcatggaagatttttatctttttattaatgatttccaagttgattgcattatatacaatcagaacattcattgcaatttgtgaacattagttagagccttatacataatgttttcttaaatattttatgtattcttaaaaacaatgttgagcacagtgttttatatattttttagatcaagcttttgttcacattttctgtatacttaatttttgtctatttaatctatcagttactgaaagaagtgtgttgaaagaggtaatatattttggagctaagttataaggaaaatacaagtttagaattgctatcttttaaagtgaatttaacattttatcattaagcactgatagaattatctttagtaatgtttttctttacagtttattttgtctaatttcaatataactttgccagtttccttctaattagtattttttctagaatatattttcaacccctctattttagtggtgtctcataaataacatatagctagattttagtatttcaatcaagtctcacagcttttacctttaaattctaccatgttaccacttagtacatttttagtttattgtggttcatgatagatttgaatgcatttctatcaccttattttgtaagagatgtttcttccatttgttcttaggcttctcccccaccctaccttttcttccctatataggaagttcatgtaaaatggagtgaatatctgtaatttactttgattctatagatctctctagtcttgatctttatgtgagcccctgactgctggctcattttccctctatgaattgcagtggttctgaaagatgggattatatgttccataccctctgctcagttacctctcctttgctactgccctgggctcatcattcatcttctcttttgtcactgacccaaagcctagacttcagccaggtccatgcatcttcctccacagctcctgttccttcttgttttcattgcattgctgaaccttcagagctttgtctaaaagctctaatttttaaacaagatcctcccagtaaaaacatattctcaggcatcagaggttgtggggattcagcagtatggtaggaatcattggtatatatgggtcttttataagttacatttgcaattcaagactgacagtatttagaaacaatacgacttgtcctgtaagtctgatgagcagaaaggaggagaaaatggagctcgccaaacaattcagaactgatggaaaagcagtttgctcaaaagccccatatggtttgcccattttcctctgccctttggaaattcctctaaacattagttctgactgtcagcatgcagtccagtaacatttttttttcaatcccccagctcctctgcaatggggaggcaactgacctactccagtgtgcttgaaaccattgtcactgtactcaagagcaccaggtagcactagtacttctcccaatagatggagcattaagctcaccagtgttgctcactgtcatgctgtttcgtgctttgttggtggggactaaatcttgtatagagttttcagcggtttatgctttgtttagggtcttgatatccaatttccatgttggacttcttgtttatagtttggcacagagctcattaatgttgaccccttagccattttaaagaacctcagatacgctgcagaacgtggaatttgatctatttttcactaaataaaatttttaaatttatgtgtttgagtactagctatgactactgcattggtcagataattttaatgcttttttaaaaatctgccaatatttgacatcagtgttcccataaaataaataaatgattcttcataattgcttttccaatgcttttcccatgtgactcttttcaatagttttcactccaaaattgtgtgagtagtggctgtcatgattcttctgaactggcaattatgtcagaaccatttaatcagtgcctgagctgtgctggcattgctcttggaaggccatttttcagaatgacatccacctaagcatttgttaaattattagacctataaacccttcccatgagaactctcagaaatactgttagatatgcagagccttagggacacagccctttgcaccaccgtaagtaccagaactctgttaagcaaagttcaaaactttgagccagagtggataagagtcacagctctctgtcctcaggaaacatccctccaatgtccttgtcaagagcttgcatgcatagttaatcaaggaagaactcactgggattttgagtgacatcagacaccattccagcattgcatgttgaaggattactagcagggtttccccttaatttacgagacatatatgattatccttcagcctgcagtcactgtaggaaacatgtttcttctgcaacctgcaactggtagatgccgtaagaaaatgcataaaaaattagtgctagattttgaaatcgttattaaaaggatcataaaaatcaaagcatccctgtctcagttctgtccatttgatttataaggaggctaaaaatggaaatgtaggtttcaacgggaccaggtgtggtagctcatacctgtaatcttagcactttgggaggccaaggccggggaatcacttgggcccaagagtttgaggctaacctgggcaacatagtgagaccccgtctccaaaaaaaagaaaaattaaaaaattagctggccatggtagtgtgcacctgtggttccagctactcggaggctgaggtgggaggatcactggagcccagtaggttgaggcttcagtaagctatgattgcaccactaccctccagcctgggcaatagagtaagattctgtaaaaaaagaaaagaaaagacttcaatggttccaggaaactctgttgcgtttagagctttataggtaggtaaagagatttttctgctgtttgaggcatgaatgcggtcagaaagtcttaaaatctcaagccttttcctggcaattttcttgtgctgcctgacatagggcacacgctgctataggaaactgcggtttgcttttcccttctgctgaacctctcaaaacctctaactcctcgagaaaagggattcgtgtctatttcataggactgttgtgagaatgacattttgtgtatgcgtcaagatatcaatagatattttcactgtgttctagaactgggtcccttcattcttggatcactgccagtgtctctgatcgattcagtcattataccaccagactttgctttcctgagtcatgttgaaacattattcacttccctgtgcttagaaactcacagtacttaaagccctgagtgtttatgacccctcattagtgagctccatcctacctctcttgtatctccttgttctgtggtaaagacctctcgcttgggtcatgtccacattttccctcaattccacgccactgtctttgttgcgggcatcacttgcctctgcttggagcccatttctgttctctacctttccaagtcctttaggttggttccactaggaccagctcaactcctgcctcctccttgaagtcttcccacccaacccatccatccctcactgttttctcctttctctaaactttcacagcatgttggagtccctgcagtttaatttagactctatttactacctctctatcctgtttactgcctatttcatgagtgttacaactggactgcatcttctctaagtaggaggccttcagttctttgatgtggtctccacactgcccattttggacaagctgctctttacaggattgtcatatgataggtcaacgcagaccagtaatgcttaagtttaacaactgatcataatttcttggttttgaaaatgtttagtaccaggtagtggacttcctcgtggtggtgggaagagaaatcaatatttttatcctaacagcagttgatgttattgaccatcaactgtgggctgggcactgagctaaccatttccatgtgtgatctcatttaagcatcagcacagccctcctcccagcagacatgaggaaactaattcttagagagctccatctcatatctgtgtcaccacgctcatgagaggtactgcaatctgaaccacaggacagctgactctggggctcatgccgttctacaacaaaaaaatacaatctccatcctcatcttccctatgctttgggtctgtgagacctgtgagactttgggtctgtgagacctgaagtgttggaggacaggttggagcaggtcttctatgtacatcagataccagaatgcaacctgacaactttctcctaattgtgaatgacagaaaaaaaggatgatttgtagagatttgccaaaactgtaattttttttttttttgagacagtctcactctgttgcccaggctggagttcagtgacgcagagtttcactgcaacctcccctgcctgggttcaattgattctcctgcctcagccccctgagtagctgggactacgggcacctaccaccatgcctggctaatttttctatttttagtagagatggggttttaccatgttggcaaggctggtctcgaactcctggcctcaagtgagccacccatcttggcctcccaaagtgctcctaaactgtaatcttttttatttttattttttcccaatatagaaacagtagaaatgttggaaattgaggttattgatggtgcaactatatgatgttgatgttaggattttcatcatgtaaagtggcttagttttatttgtgttgtttgtataactttgactagttgaagtcagacttacctagtgttgaaagtgagacttgagcacaaatttgcttgagttagcactggagaggcactgcaggaggcagccaaaggacagcaaagtgtatttttcttttgcgtgtaaatgttgtaatactgttttgcaataagtgaaatatgtgtgatcacataaaggagcagtggagaagagatactgaaattctttgtcaatggttgatatatagaaatagacatacttccaaaagttaatattacagttatataaacttctataatctaactgattagaaatcttacagagtagaaatgaagcttgaaaatgagcaagatttttctaaagtttgttttctgtgcctgtgtgtttccgtgtgtttcacattctcatggcatggtcaactggaaggtattccattggttatcatagctatgctactaggagagctatactttaaaaatattttctgttaactaacgcagtgaggtgcctttgaagacttgagatagccatgatttaaatggaaaagccaatatgttgtgcgtatctgtaagtacacatgagtagggagagaagtgggctagaagaaaaaaattaactatggaaaaacataagcatatccacaaagtaggattttggtttctcaatctataatattatttcatttccagattgtgaacaggtggcacacactgtttctttagctcttttgtggccaaccacacatagctatttctccatacctactcatatgtcacctaagaaactacctaaattgatctcaaatggatctaatgagaaagacatgcctggcatctttgtaaaaataatatctatacagcaggcaaagttgctttaaagtgtttatttggggagcaatgcaaagtattaaagcatctgttgtctctgcagctgaacttttctaatatttttacaacagctaatttaacctgagtgcacaattccaaagaaggaagttgtaggataaaaaggtagagctgaaatgtacataaatctttagtgtccttgtagatctgatacactgccgtactttcctaagcttatgcaaaacagaaagtgaagaggcattttgcagaaaactaaattatacatgaagtcattaaacctcacccttcacttctgattgagggattgctgcagtcgtcagtgaaagcagaggcaaaatgaaaaaataaataaatgaaagacctgatcacattatacatttcagtggaaatgtaattgcttagaagttcgtttgaagttattgggtatgtgcaaaattgcatgtagctgctgaaaataagaaacgggtcatggcacagagcatccttgtgaacccagaatctatctctcacatgtgtggggtacagagggcaagagggagggtcgccttggatgctctgctacaagtctgcgtatcccaatcagccccaaactctcctgttcattgaaatgtttacttgttgtcttgacttgtttttccacccagagatgtatttatgcacataacacacactgtttacttctttttccaaaggagttttgtaactgcctctttgaaagcatgtctcaagagggggagggatagcattaggagaaatacctaatgtaaatgacgggttaatgggtgcagcacaccaacatggcacatgtatacatatgtaacaaagctgcacgttgcgcacatgtaccctagaacttaaagtataatacaaatatatatatatataaacaaaacaaaaaaaaactctttaggaaggttgtgagatccccttttttgaagatcatatatcctcaaaaatgttctcatccatcaaggatggtctaaatatgagcattgtgaaagaataatgatgtaataatgacctctatcaaggtcatcttccatggtgaggaacgtgaaatggaaaaggcatgaaacggcatctgtgcaagacttcatagctctcaagcctgatgtagcagggctggagaaagaaggaaaggccttttccgacccttaattaaagggacttttgctggctctttgcagattgctgctggcgccccatatagttcttaattaattccgcctgtgtcattacaaagtaagccctactgaagagtgggttaacagccggagtaagctccctggactgcattttctttcacttgacgctgtgtcttgaaggctccagcagtggggtggagctgcctctaggagcaggcctgttttaatcagcatatcacaggtccgtagtcgtgagacagaacgtctccctgctcacatgaaacgtggcttgactaagaactcagtgataacaacacctctaaaaagaaataaaacattgaatgttcactatggagaggatgctcagagaagcagagattgtctgtgtgtatccagcactgactctcagcctgccgagggagagccatgcctgcagagtttgcagtctcctggccctaagatgacatccccagaaagctttctgcttcgtttactccaacccagtgctcaccacacagcctcagctcaggggtctggctttctagatagtgccactggctagggcacagcaggcacaacagacacttggaaagaaaatctccccattttaaattcatatgttggcattcagggttacacatcagaatcgcttccatttaatgtgtgtgcagccgtgactggaaatgatgcatctctaagagtgggaagtgtacgcatctgctagggctgctagactgggtggctcacacaacagaaggttactttctcacagtctggaggctggaaatgcaagatcaaggtgccggcatggttggcgtcctctcctcacatgttggcttgcaggtggtcagttctgcacgcatgccccagggtctctgtgtgccctactcaccttttctaaaaaggacaccagtcatattggattaggatccacccatatgaccttagtttaacttaagtacttctttgaaggccccatctccaaatacagtcacattctgaggtacgggagcttaggacttcaacatattgatatgaatttgtggtcgggggtggggggggggtcacaattcagcctgtgacactgagaaatcatattctttgttcaggaatgctgagaggtctcgcaatttgagacccgaccaaggttgggctgggcaaggcatcagcctcattggtgggtcccctgtgaatcaccacctgagctgcccaaaatggttgctccaaggcacatgtggctatttaaatgtaaataatttacattaaatgttaaaattcagttccttggtcatcccagcctcgttgcaagtgctcaatagccacaggtagccctaacagccatcatatcaggcagtgcagactagaatgtttctgccaacgtagaactgcccttacgttcttgttctggagggaccacgcacaatggctgtgcagtgattaaaagaatcccgcaaccagcaccctgcacctgcctgctttgtgcccagctctgtgcctgtggaagttaaaaatggggatgcaggccccctcttcaggcaacacggtctaattgtgccagtaaaaataacattaaatctcacatattagagatgtgaagaaaacttaaatggcacatattaatacccatgatagacttttgaaggataaaagaccaatcaaaactaaagtagaaaatacatggaaaagatagatttgagctgagttataatggttacaccagctttgcaaaggaagtgaaggaagggccccctgctcaatgaacatcatatcccacagcaactggaacgcagcgggcgtagaagccagatgtcgtcatgctctttatctgagacacacaatgacaccatgctgcattctctccctttcatgttttagtgtctcttgctccttctcagcctttcctgtgcatttatcgctacatccttgggttcttggacatcctggcagatccactgggatctccttcactgtactctcttcctctagaagtgttttgttcctggtctctcctcctccacctacagcaggatgcttgttgcggggattatcttagggactccaaaatcacttaagcatggcccttctacagcaacaaaaatctgtgccgtgcagtaggatggccactgctgcttgtggttctgagctctctctaagtggctgtgatgacggaggaatagggcaggagtgcttgactgcaccataaactaagaacccacagcttcttttgcctcaactctttccgcaaccctgacctttctctagtggatgcaggaaagtttcaataaccctaagaaatgagtgccacctccctgttcactcatttagaggtagaagtggattgaggtccacagacgcatttgaagaaggcgtctcctaacatatccagtattgataacaactctgagatcacagattcaatgttgattattcaatattagctattatttagtttagtaatttaattatcagacattacaggtatttgcaatatttcatatcaagtttaagttattttttcaggacccaaggcttggtggagaattcttagccattacaccaaaagcattctccattaaagaagaaaatcaagaaattagacttcattaaaatttaaaactcttgctgtgtaagaggatgaaaagacaagctgaagactgggggaaaatatttacaaactacatatcaaaggattcatatctaaaaaatataaagaattctaaaaatttagtttaaaaaatccaattagaaaatgggcaaagacatgaaagacacttcaccaaagagaatgtacagatgacaaataaacacatgaaaagaagtcaacacgaccagatgataggaacatgaaaattatgaccatgatgaggtacatcatattagagcagccaaaataaaaagcagagacaataccaaatgttggtgagaatggagagaaactgtatttcttgtaaactgctgctggagtgtgaactggtacagccactctggaaaatctttaagcagttcttaaaaaactaaaacagatgccaggcgtagtggcttacacctgtaattccagcactttggaaggctgaggtgggtggatcacctgaggccaggagttcgagaccagcctggccaacatggtgaaaccctgtctctactaaaatacaaaaattagctgggtgtggtggtggccgcctgtaatcccagttactagggaggctgaggcgggagaaacgcttgaaccctagaggtggaggttgcagtgagccaagatcgcaccattgcactccagcctgggcgacaagagctaaaccctgtcgcaaaaaacaacagcaacaataacaacaacaacagatttactacatgacccagcaatagcactgctgggcatttatcacagagaagcaaaaatttatatccccacaaaactctgtaaataaatatccataacagctttatttgtgatcaccaaaaactggaaacagtcaaattgctcttccctaagggaatgactagacaaactctagtacatccatataccatggaatattactgagctgcaaaaaggaatgaactaatgatatagacaacaacttggatggatctcaagggcattgtgctcaggaaaaagaagccagtacttgatgattccatttgtagaatcttcttgaaatgttaccgaaattagagagatgaacagtagactagtggattccaggaattaggggatattcagtgcctattcagagattccacaaggaagtttttttgtggtgacaggatatttctttatttgattggagatctacacttaagacgaaatggcatggaactatacacacacactgtaccagcttcagtttcctgaggtacagttatgtgaggtgtaatcattggggaaaaccgaggaataaatggaagctctccataccatccttgcaacttcctgtgaatctagaattatttcaaaataaaaagctttttaaaatctatttattagtataatttaaaatttatgtcaaatttattggttaccaacataatgattctttaattaactcactggtgattatcctgataataaggttaaccttcagtttgaaagatgctggggtctcttttcatgagcataatttacaactgtaatgacaaaatgaggcaaggatttatgtcaattaacaggcttacatctatgagacattttgggtaaaaattttagcatggtacttggaacacagagagctgcatttgttatcttgtgttattgttagtattatgttatttatttatgttttttgagacagagtcttgctctgttgcccaggctggagggcagtggtgcaatcgtaactcactgtagcctcaacctgaagagatcctcttgcctcagcctcctgagcctgagtagctgggactatgggcatgtgccactatacctagctaatttttttttttatttttagtcgaggtggggtctcgctatgttgcccaggctgttctttctcctggcctcaagcaaggcttctgccttgtcttcccaaagtgctgggattacaggtgtgagctaccacacctggccaccattgttcttattaatactactgaattggttatttattgtgattttactaaaagaatttttttgtcatcaaaatcgtttgagcctgcatttttttcttatgacatttcttggcaaaaactcagattccctttcaggaattttctttgctgaaacaacagtctagctattgtgtgaaagtccattctggtaatgtgggtcctccaagggcattagctctcggctgtttgcatttcaaaattgaccctcaagtttactttcatttactttcaactctgttgccttcttgaaaatgttttaaggcagtacatctaataagcatgaagcatcttacttttagtttaatcccaaaccttgtagttctaaataaaaaaattgaaccacgtgcccctaaggttttaatctaatatctggtttcttgaactggggccagctcttcatttttcaaagcatcaacagattctaaatacaacttctggcaacctccttttagcatctgaccttggttcacttaaactaattgttatcctttcagcagactgtgattctgaagggggaagaaacactatactgtgaaacattagaggagtttttaacatttggggtataatgccctccatgtaaaatgtctattttcagtattaccctctccctgcctctactaaaaattaaaaaaaaaattagctaggtatagtggcacatgcccatagtcccagctactcaggctcaggaggctgaggcaagaggatctcttcaggttgaggctacagtgagttacgattgcaccactgccctccagcctgggcaacagagcaagactctgactcaaaaaacataaataaataacataatactaacaataacacaggataacaagggcagctctctgtgttccaaacatgatggtaatttatttaaaactagatataagtatatactttttaaaaaacatattcaagaaccaagcctcaaaaatactaaatttgaatgcactcaggatgcatgaatcttctgatttataattatcatgtatttttcctcatacagagctcctcctatgttccaggtagatgctgggtgctgaggatgtggaagactcagccccttcccttgtggagtttatagtctggggaggacagagatgtttgtgactctaatgatatgtgcatttccatcaacattctacaagttctacacattctactaataacatgccaattcagtggcactttatatatgcaagccaacatggttttttccactgacattcacaggttttaatacagaaagcaatcctgttaaacaatttaattataaaaattctactgtaaacattaaaaagcaaattcagtaacctacctgtggtcacacagttaggaatcagtcagagctgggatttaagcccaaatcttctggtcctacatctcattcttttgcctcagcaccacttaagccaaggtgagacagtgaattcagttttccccaagtgtgagatgcaaacaactgatgatgtacaaggtgatttttaggaggcccactcatggggaataagctgtgctgaattgcaggtgagaaagtgattggctttcccgttagttgtcgttcaatacttttgattcgccagggaaccttggtttgaggcaagcgttctctctcagccaaagaagggcctggcctcaggctccgaagtagtcaagcagcactgcctggctggattggatgctattccttcatttttgttgtctcgactttttctattatctttacctgaggaaagagttcttggcttggctgggcgtggtggctcacgactgtaatcccaacactttgagaggctgaggtgggcagctcccttgagcccaggggttcgagaccagcctgggcaacatgatgaaaacccgtgtctataaaaaatacaaaaattagctgggcatggttgtgtgtacctgtagtcctagctactcaggaggctgaggcaggaggatcacttgagctcggggtcaagggctgcagtgagctgagatcacaccactgcactccagcctgggcaacagagtgagactttgtctcaaaaatgatgcgaaatttcatttgcaagtactgtaaatgtatttgcatatacacgagttaaatttacatcattcaataacagagggaagtggtgaggggatgagggaagtgctgaaggtgtacatgagtgactaaaatttggaaagacctcgtgagttgctgctgagtcctcctgactgcctttgtcacttgcctctagggattctcatttgctccttcccatctgctagttgcaacttcccaatttcaaatcacattagtgaaatgagtaacgtttcaagggagtacattcagatgactacgacattcacccaagacctactgtaagatgatgatctctctgttttgagaggtgaattggttcttccaggattcccaagggtggctggaaccacctctgactctacagatgagtgatcagcaccacgtggaaacttccgccatgctgggatttctgctccataccagtgcaggctcattgttttcacttatttagaatctcatatttactcttgtagactaaggctgactgccaaggcttcccttacaagaagtaatccatgtgatctaaagtgagagtattcacattcttcagtaagatatgacatttggctaaaagtcagtctttaaataaaaggagagcctctatgactctacagataactttgggttataaagttccatacaagtgtttgcttttaagagtaggcattgaactttctggcagagtaaattgagatgtaatcattttttgctaaactgttttaaaagatatttctaaccttattttctaaatttctaaaataattatacgttctaaattttgatctttagttaccatgacttaagtattgcaggaagagcctgggaattgtgctgatgggttttataaattaataggtgtcaaaaaaagagtcacaaatatcacattaaaattcctttttctgctatacttattcatttccaagcctgtcatctcttaaaaaaaaaaaagtatccttagattttcagtcacatttgatggagtttatgtgctctgatttccgaggtgaggacatttaaaacttcacagctctccaagaaataccaggaagggatgtttgctttaaaaaaaaaagagaaaagagggacaagaataaaacccccacccaacttccaaatactatatagagtcagtgaaggaaaaatacagacatgggaggaaaaattggaaaaaattttcttggagacaacagcaaaaactggcagtcaagtcagtaaggatgtactgtcatcaaggtctcaggttttcatattagaatgagaatagtaacaggtggcctgatggagcactggctgcatgctgggtgtgtcacacatgttgagtctcaccgcccttcatgtggccatggtgtcaggagggagacttgctcagttttcaaataggaaagtgacagctgccctggtatgtttataacagcttactctgggacaagtttataaactggagggtggcaaagagaccagtcaggaggctactgcaataatgcaggcaagagatgggttggaggctgctctccaaaggaagggagcagctgaatttccacaaaaacatccatctgctctctagatgttttcaagatgccttttccaaggaggtattcttactgctctctaaggatctgggcgcatttgcacaggctcactgtcaaagtcaggtgcagaggtggaggaaattacagctcttgagtagtgtgaacctcccaaactctggcaatatctgcatcagaggcaaaatgaaaattactgtctctctgaaatttggggtgacaatcctagagacaagacctaagcctagcatgacttatagaaacacagatactttcagctgcctctaaaacagagcagtcctctttgggggacctgtgacagattgctcactgacatcactattttgacaccccattaaattaccatggcctctttgggtttgcaagggcactgcagtgagaacaggggcagatccaagttccagaatcttcaaagattgatctcattgatatacatgggaatcaagagataggcaactcaaaaaagtcagctttgaccaagttttatgtaataaatctaaacacatagaaaccctttggtccagcttctccaggacaccatcctcattccataagaagcagcagagagtcttgcaggaagaagtaatctggaaatgcaggctttgacttccaaactgatgaaatattcttgtgatgagcccttgagagcccctgaaggggggtgccaaagaaacaaggactccctgaaatgcagctgagagcttcatcattggcaacatgacagaggcacccagcctcgagaagacattccagataagggggagccccaggcatggctgaggatgtaggtctctgttattaaactgttttttagggaacaaaagaaaagagtagtgccggccaagaaagggttgaatatcccctaacacccaccgtctgcttcttacaattaatgccctactgacactcaccccaattatatcaaaatcatctcctttttggagccaccttattctgcgtcagtctctataatcccacagaacagtggccttgtccaaggaatgttcagcagccgtgaacactccgcagttactgtttccatgactatttccccttgtcactcacttgaaggatatgtttttttgctcttgccacttgatcaatggttctcaacttatttctgctccagtgctcttgagggctgtgtcacttcattagcgggagctgactaccacagtgcttctgaaggtgggaagaaaggggacttttgaaatggagcaaatttgaagagaaagaaaggcaacttgattgaggggccctccagggtgttcatactcacatcaccaggaagcatcgctgtgcaggtggtgataggactgtgccactgaactggctcattccataaaacgtggtaaccagaaatccttggtggcttaagacccatggccagggtgacttcagagtgccacatgcacagtgcaatgcatcaggcacaaagccacaggttctgagccagttttgaggccaaatggaggcgcactaagttcagagtggaatggccttggcttgggtcccagctcttctgtttaccagctgtgtgatttcaggggagccactcaatgtctttcatactaaatttccttatctatacaacaggattaaaatgctcaccccccaatagagcttcacaaacctcataagcatgtatggatcaacaggaaatatatgacattgctgtggaaaaggcacttgtaaaatccctcatacagagtaatattcaatagaataagaaacatattctaaagctcagtcagacatcatggggactgtttataggcatgaaaacattgtgtgtgtgtatatatatatatacacatatatacgtatatatatgtatatatacgtatatatgtatatacatatatatacacacatatgtatatatatacatatatgtatatatgtgtgtgtatgtatatatatacatatatatacacatatatatatatacatatatatacacatatatatatatacatatatatatacacatatatatatacacacatatatatatacacatatatatatacacacatatatatataggcggcaaacctcaatcccattatcaaaagagaaagagctattaggtaaaggaagataattgtacgataacaattgccgagatcatgatggctgctctgaatcctgcaaaacagaaaaattctgcacaatttcacgttggattaagttgcaataaaaagtggccagagattagcagcttctttaaaagatcagtgaatgttcacatttagatttcggtttgtttagaaacctagttcgtgtgtctagattcttgttttcacccagtcctcacctctcttagccgtgaagcatcacatgctccttttgcctgcctttgttcaggacactggagaatgacagtgaccagtgaccattgccatcactgtgcctgaacttctggggcactctgccttgtggcccatcaggcaaagttaggtgtcttcagttgctttagtgctatagcaataaatagtttatatgggatctaataaaatgcgatgcttcgaagcaccagaagagaagtctgagcagaaaacaaagaaatttcacagactttgcatgccccagtgagttcatcttccttctttcaggttgatgattttagtcattttacatgcacaattttattcatatgagaaagggaggaaaaattttatttcagaagcatctaaaaaacttgactctgcactgcctgaaaacatactgcacattatgtacggccttgacctgcatccctttctttctggcagcttttctgttgaataggatttttttctccttttttaatatctaggagttgtggcatttttaacagactgcatcgttttggagtaatgttctcttgaggtgggcaactgagatgtataattatatcctgtggaaaatggtggcggtatgaggggtggggaaggaggttattaaatcacaaaaacatgtttcctattcagaaaaaaatgacagtatgcaggatgttcaatttccttctgctctgtgcccatggagagtacagcatcttcaagtggggaagtcattggtattcactggagcttgcctggtttcatttttattgttttggagacttattactctttcagagtggttcccaggtctgctgcctcttcgcagtatatatgagctaaggtagtcagaggaaacactttaattacattttaagtagaataaaagcataagtatatttatgaaaattctaacagaaggtgcagtgagaccattaacttaaatcccaaaaatacatctagtgtttttttcataataggaagttcatagttggtgtgttaaattatacctgcatatttaaaatctgccctaaacactaaatattgcctaaatgtgcatattatattcaaaatcccacctataaaacttgtgctgggagcaggggccatcattgcctgcctcacacacctgtccttaagttgctgctctgcagatgggatgtcctcaggggctaaatgatgcttttagccttggttccctcagccatccctcctgctctctctcattgggcctcttgttcaaaattatgcctgagctttggtcgaatttgattttagcaagcctgaacataattctgacaagggaagactctgaggtgagagttagaggaggagttggaggttgtgcttaaacttgaatgtaaggatttgtctcaggcatagaaagatgcaaggtgaagataagcaaaatttcctcccagagaccagaagccagtcgttggcatatgcttcgaaaatccttattccaaagaacaaagttcttttctgtcgcactgggaggattcaaaacctgattagctttactttcaacaagtttgagaggaacccttcttttctacaatataaattatttggtgattacttcccaagaatattggttcagagtagaattcttcttaaagcattcaatattcagtttctgtaattttaaaagaacatgtgtaacttttgacctcttaaagataaaaaagatagctaaagaaccttttattcttgcccaaagaaaaatgcacgggtgaacatcttacaaaatgtgcactgactttgcttaatttattaaaagatatttaaaagtaaaaaagtatgtgaaaaggaacataatagaataattgcatagtaaagttacacataacccaatgttatttgattttccccaggcacattttactgttgtgtttattagtgattatgcccatctcatggtcttccaaaaaaaaaaaaaaaggaaggagggtggactcacagggtcgttaagagaatcctcagtctctctagggaaggaagaataaaggaagtgtatctgccacctctgcagctgcacatctgtggcagtcccggctgcaaactagacatgaagcagtattctaaggcactgacggcagtgttcctatcccagttactgtacttgccctgagaattgttagccaggaaagcaaccaggggcacacagtctgagagatcgtaccatatcatggcttctctgaatattcagtggctccagagctacagatgaagttttattttctaactaaaaatttaaacaattggtttttgtctcactttaggcataagagggagtctaaagtaaatattttctcagatatcttgaacgtatatgctagaaaaaagccataacattcaaaactggatccatcttaggaaaaaaacatttttaatctccataacaaaaggaaataaaagccaaggcaaccaatctagaaagcctttcccttttctctctgggctcccataggtttattacttattttctaagccagggataaagactcgtggtcttaataatccaaatgtatccatggggaaattggctatataattgaaggaacacttacggaaaatgcaagacaccatcaccctatctgtatggagtcaggagacagtgacatttatctatggaggcactagttatctgaccttttcctcagagcatttctaattttgttttgttttttaaaaaacacattttgccatttatagtgattcatgtaattcctggataagaagttgggaggctcattgcaagaagttgaacttttcctgcagtggctcccatgcaatgaacacatatcatgtatgagaagaaaaattcctgttttatagaagtaatcaatagttaaaatttaggtgacatttttaatattcttttgttgtaaacattctttcagagacaagcagagataatcttggcatggaaaacaattgttggccatgtgtatttaagttgacttaatagtgttttcttctcaaggtcattggggtaagagtggtagagaaaaagcagtggataaagagtcagaaaacactgacttcggatctaggttgtgttagaagatgttgaggtgtctgtcttcatctcatgtccctcagctgtaagggacagctcatgtcctctcctccagtgaggatcaggtgagaggatggactcattcatctgcacatacttttgatgctctcataataagtgctcagagatggataaaacttgggccccatctgtaggaaaacattctgggaactgtagtgctcaaatgcagtacaattggttattatttcatttgttgatttgtgtctgtttcttggtcaccaattaaatgaaaataatacaactaaaataactatttttaaatacaagggctattggcagtcctgtgataaccacaaatgctgaagaaacacagctgtgatgtgagcatcattccccacaagggagcctctgtgtgtccagagagggcagggaccctcatgtggctcgggtccccacgtgaaggctcagggaatctaggggcattttctgtatgagttgaggctgtggatttactggaagacttcaaggtctcaaagtcacttttcttcttccatcttcctacaaaaaacaaaatctgagaactttttagatgggtggaaaaggcagagggaagtgaaattggtaattaatcatgacaaactcaaagtggaattaaatttttggaagtcaaatagtagttattactcaactataaaattattgtcattcatagagtaacaaagacagtattcagaaaaagagtatctgactttaaaatccctgaagctatttttaaatgcatgttatgtagcagaatagaagctacatgtttgaataaatcccctgattatataaaggtcttgttctagatggaatcaactagcgatttttaatgatagtatttgtattgagttaatttattaataacctgaaagtgtttttatttgtatttgccctgtatcatacagggttttactttttatattagtccattctcatgctgctgtgaagaaatacccaaggctaggcacagtggctcactcctgtaatcccagcaggtgaatcccaaggcaggtgaatcacttgaggtaaggagttcgagaccagcctggccaacagggtgaaaccccatctgtactaaaaatacaaaaagtcagctgggcgtggtggtgcatgcctgtaattccagctactcgggaggctgaggtacaagaatcatttgaacccaggaggcagaggttgcagtgagctgagatcgtgccactgcactctagcctgggtcacagggtgagactctgtctcaaattaaaaaagaaaaaagaaatacccaaaaccaggtagtttataaaggaaagaggtttaattgatgcacagctccacagggctggggaagcctcaggaaactaacagtcatggcagaaggggaagcaaacacgtccttcttcacctcgtgacagcaaggaagagtgccgagtgaagggtgggaaaagccgcttataaaacgatcaaatctcatgagaactcactatcaggagaatggcatggaggtaaccacccccatgattcaattacctcccaccaggtccctcccacaacacatggggattatgggaactacaattgaagatgagatttgggtggggacacagccaaaccatatcactcttcaactagcgatgcatagtgtgagtctgttaatacagctgttcatatatagcacatctgatcctaccatgtttttgaaatgataaatataaggtaaaaactattatgataatgaagtgttacctatgatcacgactaagggaccttaagatgagcagattaaacctcttaactcttaggtttgtagtgttatttttttcagtcttctgtgttgtgttttaaaatggtgttgctcaactgttttattgggtggatgtacaggggacaagatctgaagcctgagggcagaacagacctggggctagggtcttctccagccagtctctgatgcaagctcggttgtatggtaacagcagtgtccatatccaccaggccacagaaaagacatggacttgacaaactatgtaactaattactggattccaaacataaatgatgaacacatagctcccactctcagggagtccacagcctggtggcagagacagacacagaaacaacagaggatgccaggcactgtccacttagtggtcagaatactatgcagcacacaggcaggcagagtggggcacagacatctcgtggcgtctgcgagcagtgtctcctactgcagcagtgctaagcaacagtttacctcatgggggagagttggacccacaaaaaggaataaatacattctacctagcgacagactaatctgaaaatattgtaaatggtggaaatggccaagacggctgaacaccacaggtgagatggagaccggggaggaaggaagagcttctgtttgggagagaactgagagaacttgaaagccaccctggagcacatctgaggacacgagtccctaatgccatgttctctggccccaaagcgttcccaaatggtgctctcattcatctgctcacccttcatctcttcctctttccctctctcttccttcccagtgggtgccaggaagtatgtgagtaccgtggcaaaaacaagaaatagctttactgaatcctgttcacttccatccttttcccataacctcctcacatagttgaccacataaaggtaaaatgtagtgtgaactaaagtggaaataaagacacacattttattttacttgtccactgagagtaggggacattttcattacaacttgaacaaaaaaaaattgaataacctgaagattaaagactccaggcatcatagtgccaaatccctaaataaatggacatctaaactccattaaaaatgaagagaaaactttggcagagtttattacaggattttagcctggaagtcataaagtctcagcttacctactctcatgttttaaccaaagataacctttcttcaattagcaattagggagaaaaagacatcactgtatctcttacaagaatattgaaaaatgacaatataattaagaaattgagtgaaacattaatttctctgtattaaatattcagctgagatggggatgaacatgtgaccatttttactcggttatacagagaaattgtgggttcactcttcagcttccatccctgtgtttgtaaggtactaactaaaggaaaacaaagtttagaaaaagctaaatgaaatatttaaaatataaatgtagtgtaataatcccttgtctcatttctgtcggcattctttccttcttgacccttgttctacgttttttaagaacatcctccatcgttaagatccctctgtttactgcgccaaattgtaattctcagtctcactttccttctagagcttctttgaagggcagtctgcaccatgggactcggctaagaaagatgagaacagaatgaagaacagatacgggaatatcattgcatgtaagtgtcaacagtgtcattgtgctgttgtagaacttcctttttgcatctagtaagattgaccaccaggctcatacagaggaaatttacagtgcaattacctccttcatccttctagaacagctggtgttaacgctcgtactaaagaaaggaataactgtctacccccacttcatcattgtactgttgtcgtgggccctgttttccttttagatttaaggtttgggtaacacaggtaacgttaagatgctgagaaggaaaatgcattttggatggagtaaacattatagtcctaatggttcccagctgctacgtgagaatgaatggaaataatgatgcacagcttgccttaatgcaaagagctcagagttctcagcaaacattaactcattaatcctgtggacactgggttaggtaggtcagtaatagccccattttaaggacaggaaactgaaactcagaagttaaatgatactccccatatcacaacactcattagcaaaagaactaggattatagcttagacattcccagtgcctgtgaaactgaatgttaccaacccgtaatgccttggatggtttctaagtcgagcccagcctcattaatgttgcgtagcaatgctgagacacgcgctagattgatgaaaccccttctcccagggcccgcactatccatcccccacactaaactgctctccgtcatccatgactgcatcaaggcactgacaggcccgctgtagtcgcctaacataattaatactatttataaagatacataaattttaaaaagcaacacaacaatgcagattaggccaagagaacatctcgctcctcgtgtctcatttcttacgagagaacaaacttgggaggtttggttattccagaggagcaatctattagctttattgattgtgaaagtgctgttaaactgtctttgcctgagttcacatttcttagtgtgacagtacagattgtctaccagtgctgcccacagaatttcctgtgactgcagaaatgtttcgtgtctatgctgtcccagacggtagccatgagccacataggagtagctgcactgtgtacttggaatatggccgtacgactgagaaactgaattttactttatttcttgtttttgctgttcaagagtttgacaacatgaattttaaattgtatttaattttaactatttttaatttaaacagcccatgaggctagtggctactacatagggcagcacagatttcagtgtgttgtagaaaaagaaactggggggtagagtggagcttacatatgacacaaaacgtcccagctgagcacatgctgctttccctccggccatcaagaaagccagatcgccagtgttgccaggtataaatgctagcttcatgtgttttgtaggttggttttagagcgtgctgtatttagtagcattggagtggtcatgtcacagtcctttgtaggtaggagatgctgtcctgaggtctagggttgattactcctcagtggatcccatcaacacttgtgggatgcattcttgatactggacactgaggacgcaaaggccatggagatgagatggtgcccctgtccccaggacaaacccaaccgggcagtcagatcgctgtggcagtagtctagcgccgtgacacagggttttgttgcagcctggtacacagtgttctagaggctcagagaaggaaaacatggtttcttggtctatctagactcttccaagttccttcattttctctgggagcccactgaagctttgcgctgttagaagaattcagatttctcctgatggctatgacatcctttccaggagtcccttcagctctgcaacaaactcacagagagtcttggaagtgaagtggggaatccccttccataccaagtggaagagacattgctgagcctataacctcatcattgtggcatcactgatgtggcctcgtgctgagcatacagaatgcaatgaatgtcaaggggtgtagccttgggtatgctgagagatccagctagcctttctccaatacaacattgagtctgcttcttcccaatgtatagtttagtacctcctcatggagacactgagatatatttttgaatcatgagtgaaaaaagctagcatttgctgagcacttacatatgccagacactactctaagcactttgcacatcgaaacccgctcactaacaacaccacgaaataggtagtatttttgtatctattttacaggtgaggcaattgagggataaagagggttaaagagtttcacggttaataaggtatggaggcaggattccaacccaggagcagcttttataaccactgctggatgggtgctgggatgactggtcccactggcttggttttcaccaggtgtggtggctcatacttgtaatcttagcactttgagaggctgaggtgggaggattgcttgaggccaggagttggagaccagccttggcaacaaagcaagactctgtctctacaaaaaaattttaaaaattagttgggcgtgatggtgcgtgcctgcagtcccagctactcaggaggcggaggcaggcaaacatgaggatggccctgtattgattgtttcctttctataaaacgtctgcaggctccccaccacgttccaagcaggttttctcctttaaacctccagagatcctgcccatttgtctccacttggcccgtgtgggtatttggtgtacagctgcttgtcacaggaacactgaattctgttcctgtacccgttgctcgtcacagctggacagagagtatgtacttaaaagggtccaataatccatctcttcattcagtaaatatttattcatcactttctttttgccagactctgtgggaggcactgctataaaaagataatgaaggctgaggcgggtggattacatgaggtcaggagcttgagaccaacctggcaaacatggtgaaaccctgcctctactaaaaagacaaaaattagctgggcatggtggcatgtgcctgtaatcccagctactcgggaggctgaggcaagagaattgcttgaacctgggagatggaggttgcagtgagccgatcatgccactgcactccagcctgggcaacagagcaagactccagaggtctcaaaaaaacaaaaaaaaaggaagataataaaacacaagatactgccctcctagtagttacagtctagtgcagggggttggcaaacttttttctgtaaagggtccagtagtaaatgtgttagcctttaaaggccaatctcagtctcagttcagcttcttggctctgctgttttcatgcaaaagcagccacagacagtacagaaacagatgggtctgactatgttccagggaaactttttctgaaagccagacagtgggctacttttggcccacaaacagtagttttctgactcctggtttagtgaagaacagattccacaaggggaactttttcttaccccccagggcacatttctaccaccaggatagttttcaactctcaggaccctgaacttgggatcaattttttcagcaccccaaacagaggtatcagatgtgatttgtgtgtctggcacaatgttgtcagaggcgggatgggtttaaatctacctcctaccaccatgaatttgcagtctgtggccagatcaggataagacatgcatgaaataatagatctcaggtccataaataaatggagaatgtgttgtgaggacaccactggggacttgcaggagaagggtgagtggacgagtggcagactaatcaggaaaagacctctcaggcaaaagagaaggtcgtagggtttggagataggaggaacagtttggagtccttgtcctaccacatactggctcaatgaccttgggtgagtcatgagccttctcaatgtcagaatttcctgacaagatcacgtgttgtggaaatgaacagaaatgccacattaaaagaacattgatcgttgttacctgaaaaaaaatctcacttcttcattacttctgtgttactcatcttgagtttagcagattcattacttcattaaaaaaaaaaaaaaatcagcatgttgaagtctccgatccaagtgatgagctggtaggtaattcagggaccatcctgctccttactagtgagcacgtctatgtgcagtggcccacttctgcccaggcgggactctggcttctgtttctgggcattgcggtgggctgtcatttacccatgacctctggggctacgttttctagcccccaccgccctccatcccatcccttccagtgctcttttagtgtttctttactgggttgtgttatttttgtatctttctagggacagtgtcaaaaagagacttctctgtccagcctcctaatcttcctctcaccttccatggcgtcctgaagcccttccctgggtatccgtgttaccccttcctctagtttgctgttgcttcctgtacccacacacacataatgacccacgcatacatcatgactcacacgtacatagtggctgtttctttatgggcatagtgaatagtattaccatcccctgcctaaaaattatgtaactgtagaaaagtcagttccactgcctgtaaagtctgcttcctagagcctcggacttgggataacaccactaactagaataaggaattgggaattcagtcagcatatcttagagattcttgttagtgcttttcaaagaacacagaagtggtgtaatgatcacattcattgtttttgcagcagtgtttgcatataaaatagttttaatggtccttaaaactgtttattggcttttgctcttaagtaagttaacttttcccttatttacactataaatttgctgagctagccccttccaaatataaaccaacaccctacccaccattaccgcccctccacacacaagcatagccctcctaatactctcaacagttcctaattataattaactctaagcttaaggcacacaccaaatctccctgctaacgaggcagcccccttgcagccggctcctctttctagggactggcaattggagataatgagccagaatctgcagaagcttcccaggctcccttcctcctctcttctgatctttattcaacaagtatatattgatctgccatgtgccaggcactgtgccaaaccacagtcattctttcaacagatatttgctgagtgcctgttatacaccaggcactattctaggtgtcagcgagagagcagggaacaaagcagacaggatgctatgctggtgtcgtgctgcaccttcttgtggggaagacaggagcaattgctgagtgcagggtgtcaacacccatgttaggaggtgagcacccagcaaggaaaatgaagcagggaatggagattggtcagggtgggtgatgtttttagactgtggtcaagaaaagcctcccagaggggatgagatgccaaccaggacttgaaacaggtgagaagacggaggagtgtggccgcccaggtggccggtacagcagggaaggctgtgctgccggagcagcgggagtggggtaggggcagaggtgggagatgcagggactctggggtgaccacaggagcaagagctgacagggcacctgccctcctgaagctgatggtcctggaagatttcgtgggggagaagggggtgatgtaaatgattacaaaataaaattcaagttaagggcacagaaggagttaacatggtaccatgagaactcacaacgtggggactgagtgaggaggtatgggaaggcctccctgaggatgggacatggaaaacaactgaacaagaggggacggagcagggaggatgctgcagaattgggaggggttcatgtgaacagaccctgtcatgccggggagccccttgggtctgaagaactaaaggaaggctgggtggctggagctggaaggacaggggttgggcaagagaaggagggaggtggaagccagacctacagagccttctggggcaggttgaggacttttgtctttattataagaataacggaaacttcattaaaggggttgggggggtgttaataaaatttcattggaaaatttagatctgactgcagagaaagtaggttcgaaagggacagctgttgaggaatttccagtagcccgagtgtgacacgatgatgatgttggctagaaagaaaataagtagatgaattcagaagaagtaatggacccaaccgaaagatggatgggagacagggtgaggaagacagaagagccagagatgactcctgcgtttccgacttactggaggatgaatggttagatggatgatgggcagttgaacaggtagacacatggaaggatggatgggccattcccttccagtattatccaggatggataatactggaagggaaccagctgtggagaggagctcaggttggcatgagatcaacagcagcttatgagtttgatttggggacatattgagatgcttttgaaacatgcaaatgcgatgccaagcagacagttctgtagactgctgtgaaatctgaaagagagggatctgggctggattataaatcagtgacccatttcatgggtcatatgggtggtggtagaagccattggcaggaggaggtgatctgtggagggagcaaggagggcatagagagcccaagacccagctaaaggggctttaataatgggcggtcctgagacagaactgctcagcggtgcagggagcactctcatggagagaaggggtgctgctagtgtcctgttggtagatctagtagatctagtacagcagagactctgatgtagtgctgaggacacgaggtcccttctgaggtgggttaccatgccctcctactccatttcctaacaacgaggtgtgactaatcagtgactggagctttggacctaccccagattcttctagccagtgagccaatcttggttgctcacattgaaggcttcacttttctaacattttgttttatagcagtgtgcttctctctgctaattgagtgactccaacagcgtctttgaacgaagggaaccagagtttatagttaggtaagaatggcctggcagagcgagcttttggcattaaattcaggtgggcacgagcaagagagaagcagatggacacaatatgtttaggaaggcatagggtagaataaataaatccctgccaggattctgaagaataaagagagagctctgacacagggattagtcagtcagaaaaagagttagaaaacaaggcaagacccacatgaaaccaacaggaagaggaaaattcatatggagccaccatcatcgaactcaaacttcctgctcagaacctgcatggcagagctgggaaccgggtggaaacaagcagggagactgcactggaggtggcatctccaccgggtaaggcgccaagcacttcctgagttgcaggcacactgggtctcctgtagaccctaccttgaaacaagcacaacagcaatcctcagcccaaatgcagccacgggaggagcaaatccattatttgcagaaatcaattgtaattaaaattaatttccagccttctctcagaggctaaatattaccttgataattgtgattccaatttaccttatatatgtcaccagtatgtagcagagagaaagaattggttagaggtgaaagattatcagtgatacactctatttctgccgctgtgggaatatctaatcacacacaagttaaaactgcatgactattgtcaatatccgtcatgtttaatatggaagtgttaaaatatttgaagttacttagagatatttttaaacgtaatgttacctgatggaaagggcagaaataccatgttctacagacttagggtggggcatagacctgccctaaatctcgcatcaccccagtccaatgcatgcctatgtacacggggggaaaacctcagcggattataattcttcaacgctaagcactggtttgttgtgacaaggtctttatgtgcctgtttcttacccaaaaatatctgcttttctctgtttcatctagtaaaggctttttttgagagatatgagacaaatagcaagtcgtttttatgcagatggagtttctcaaagtggcagagtttgttacatttcttgatggggtaacattgagttgtgattatgatataaacatgagtttaattttgatcatattcaagtcatgcatggcaaatagatttctttttctccaattcatacacattaaagaaactttgtacactgtggaaaacttggggaacatatcccagaatctcaccatccagattcaaaccctgctaacattttttttatgtttcattccagtcttcttatttttctatctcttgaagctgttgactttattttttttttttttttgctctttgtttttcaatgagaatagatgtgttattctctttctaattacaaagataatataaaccttgtggaccattaaagtagtacgtaaaatcataaagatgataataaaaatcactccagattttatcccctgcagaaacctcattcttccagttgtcccactgtgcatacctacacgtacaccaatgcgtttgattatttcatgtaaatagactcttattagacatgctgccttgtagcctgctcttcttcactctgtaatatgtcccagagatctttccaggtaaataaattaaaggcctggtaatccttttgaatgattttatcagattttttgcttgtttgctcaccattcttcagtctcctgtttatatcattgaatggttaccaaggtggtgttaggaaaaaaacgtctgttttagaaaaagcagtccttggcatggattcactagtgagggaagcaactagaggcaaaaatgaaatagtgcagatgaaaatgatcaggtcttgaattaagtcattggcactaataagacaagtgatagctaactttcccttacttcttattgtataccagctacttactaatgattacttatattaattcacttaatcctcacaaaactctataatataggcagtattgttattcccattttacagttggggaaactgaggcacagagcggtcaaataacttctccaaggccacacaactagaaagcagcataactgagattcatacagggattctggctcgggagcccgggatcctaacctccgtgctccactacacagaaatagggataggttgttgagcagataccaggagattaaaatgtagaagttattgaagagcattcagcatgtcttcaaacatttctcctgtttcctttttaaaagtatctccacctcctcttccctgaaagattggctgcttccagttttcagttctgccctgctctgctgttccccagtaagcatactggctctttgtgctttgaagattttattggtaaacttcaacaaagatgttgcttttattcacagaaaaggggtaatttttttttttttttggatggagtttcacccttgttgcccaggctagagtgcaatggtgcgatctcagctcactgcggcctctgcctcctgggttcaagtgattctcctgcctcagcctcccaagtagctgggattacaggcgcgcatcaccacacctggctaattttgtatttttggtagagacggagtttcttcatgttggtcaggctggtctcgaactcccgacctgaggtgatccgcccacctcggcctcccaaagtgctgggattacaggcgtgagccactgcgcctggcagcgtaattttttttaaggggaactaactgtactgtgttccaggcacctgataatactatgcattatcttatttggtcctcccagaactcctaggaaagtagccccttgtcacccctttttacagatgaagctcagcaggactccaaatttgtgcagatgcatgtgagttgtagagccagcatcaaatcatggtcttggacaccaaagcccctgttagtttcatttcctgcaaaatgtgaatgtgaaatggctttggaataatcaaggaaaagcacccatgctggcagagaaatacagatggtaattaaaaactacagctcaggtcttctcaaacttagcaggctgtgtgccccagaaataccaagtcctcatagtcttgaccccgtggttttcatggttagtaattgacctgttgttaaccacaaaactgattgaattctacagatcttatgcctaggcagttgagttttccaaactttttcctcccttcaaccccaatggctagaccctggccctgagagagggcccctcccagctggtaagccttcaaaacaaacctgcagaacagggcttatcattggacaattggcatttctttggattctttgtctgagtgtctcccacatttgccagatgccagaaatgtctgtgaggcatttcctcataaaaatttgatatgatttagcctcaagagtaccccaaggaataactgagttttcctgaaagaatggttgatacatatttgtctttgtaattggcatctgattcaaggtgaatgatatttcaagaacatatggtgaggggcatccatatactgatttatttgccccaacagtctatatctgttgttttcatagtcatctgagagctttgtttgagagaggacgcgtaagaatctgcagtttctgtgccaagtcattcttagacgtccaagcagcagagcatgggggagctggaagagccaatcatttcacttctttagcttttacattcaccgacttaatgtgagtgatggtgatacttacctatttcttgtattctggaagacatagggattaacttgagaagtgctgacctgtttcagccaggaagtgcaatcatgtgatgatcagcctgctgctctccatggcagaacacatgtcccgcgttctccaccccaactggaccctttcttgagacttaccccacgctcactgctaacacaggtatctcctgggcttgaggtggattcacttatcagtgttcaccttattttatcactaaaacaaaaatacttcataaactacataatgtatgactgttatcctctattagaaagctatagaggccaggcgcggtggctcacacctgtaatcttagcactttgggaggccaaggcaggcagatcacctgaggaaaggagtttcagaccagcctggccaacatggtgaaaccccgtctctactgaaaatacagaaattagctgggcatggtggcagctgcctgtaatcccagctactcaaaaggctgagagaggagaattgcttgaacccaggaggcagagctttcagggagccaagatcgcgccattgcactccagcctgggcaacaagagtgaaactctgtctcaaaaaaaaaaaataaaaataaaaaaaagaaagctatagagtcaccgtcactcctgccttgatttcatcagggaaagggaactcaccatctcaggaaaatgtgcctagcaaaagaattcacagggctctaggctgcaagtccatgaatgccctttcctaggatatcagggaccagagtggaacatgagctattattacaagggagggatggaaaaattagactttttttatttttggaaaaatacacataaaatttaccatcttaaccatttttaaggtcagtgccattaagtactgttaaaagaaaaactttagacaaattaaatttagccaggtttatttgagcaaagaccaattcatgagtcaggcagccctcagaaacagaagaggttcagagagccacacctacaagtgtgagtggcaggcttttgtaggccaaacagagaagcaaagtagagaaatcacctaattggctacagctaggcatctgccttatttgagcatggtgtgatgagtttggagttggctgcctgattggttgaaacccttcctgttttatgtattccctagcacatggtccaatagaaagaaactatgaaatataaatgcaagccacatgtataatattaaattgtccttaaatctaatagccacactaagtaacagaaaaagaaataaattacttaagtttagtaatatattttattaaatctaatatgtcctaaatgtcaacttttcaacatgcagtcagtataaaaaatataaatgaggtattttacattctttttatcgtgctaaatattccaaatttgatgtgtattttacacttacagcacaattaggattagcctcatgtggctaacagataccctattagacagtacagatctagacaatatagttacattttgcctggcttttaactttacataagtaaaagtatgtaacatatatctctgttatccagtattgtacctactaactacacataattgtttaagttcattaaaattaaattaaaatttcagttcctttgttactccagccacatttcatgtgctcagtaactagtgtggcctttgtactggtgagcacagatatagaatgtttccatcagcacagaaagttctactggacagcgttggtatatactcttctgtgtattgctttttttgttgttcaactatgtttgtatgatttgttcaagttgtatgtaaatgtagcttgttcattttcattactaaatagcattccactttattaatatagtacaatttatgtctcccttctgttgatggacatttggattgtttatagttttgtcaattgtaaacagtattgcttcagtacgtttcaagatgcacacagtatccatttcctcatggctgggtcataggtcgtggatgtcttcagctttactaactagcaaattgtttcccaaagtgattgtactaattttcatttccaccagcagaatctgtgagtttatattattccacatcctcacctgaacttggtgttcagacttaaatgttttgcctttctagtgggtatgtgatggtatctcattgtaagctgggctttttttcacttactgataaaaataaatgtttattgattatatatttatcaatatatatttatactattattttcatagaagtgtgcacacaggaggtgaagatgaatataagacacagctcctcttaaatagtttttgtttttatagagacagggtcttgctctgttgcccaggcaagtgcagtggtgtaatcatagttcactgcagccccaaaccactatgctcaagggatcctcctgcctcagcctccctaggactacaggtgtgctccaccatgctaggctaattcttttttcaatttttattttttatagagacaaggtctctaaaaataataataaaaatgtcatgttgcccaggctggtcttgaactcctgagctcaagctatcctcctgcctcggcctcccaagtagcttggtctgcaggcatatgccatcacatccagctaaggtatttttgatctgtaggagaaataagtcatgtctatagataaccatatataagagcaccaaaaagtgaaatcaaaggactattgacatttaaggaaggagaatttatacccaacaacctactccatatctctattcagatggtaaacacctcagattaaatatatccaacactgcgtgcctcatttccatcacccaccccaagctggcttttctccatggttcacatcttagtcaatggcaccatcttctgccctttttctcagatcagaatcctagaagtcaacatgatacctcttctcatccacaataagtgaactgatcattgtggtcagtcctaccacctaaatacccctcagattcagccctgtccactagccctctctatgctaaactgccattgatcccctaggactcttgcagtagcctccccattgtctccccactcccacagcccttccagttcgtcctcaacaatagcgggcatctgatgaaatgaagcacgcccctgcctgtggcttcccacggtgctcaggatgaaggtcctaatgacctggccttccctcctctctgttctcatttcccaccactctcctccctggcttctgacagcacattcaccacaccaaccttctttggtttcctgaacatactagatccttcctacctcctggcctgaatacacactatctcctggacttgaaatttaggagttctgccctctccactttccatcttcatggtttgagcttcaatgtccctttattagggaattgtttgctagctcttcagagtaggtcaggacccatgccattcactctcatagctctctgtcctttccaacttagcacttatcaaaattgtatttaagtcattatttaagcaatgactgtttaatgtgttttccattgccttaagtcccatgaactcaagcaccgtaaatctaatttgtttaacactacatatccccaacacttagcatagtgtttggcatatagcagatactcaaaaagtcactgaataaatgagaagaccttactgaggaggggacatctgagttgaatactgaaaaattggcagaatttggacagttagagatggttaggaatgattaggtaagagatttctagaagatgaaatagctcagtattctgacaatattagacaagcctgtattaaaactgaaatttaggctgggcgtggtggctcacgcctgtaatcccagcactttgggaagctgaggcaggtggatcacctgaggtcagtggttccagaacagcctggtcaacatggtgaaatcccatctctacttaaaatataaaaattagccaggcgtggaggtgtgtgcctgtaatcccagctactcaggaggctgaggcaggagaatcacttgaacccaggaggcagaggttgcaatgagccgagatcgcgccattgcactttagcctgagcaaaaagaacaaaactccgtctcaaaaaaaaaaaaaacctgaaatttaaaaaggcactgtggacccattcaaggtatcttggatgatcctggaccaccacccattcattagcatggggaagagttcaatccttgttgctcacttgctgtgtattaggcagggccccacacatgggactgcagcctgtgcctctgtgctgtgaatggagtcttttggagttaggcatgtgaccttggggaaaggtactcttagggatgttcagattatatatgacactgtctctgaccacaggacattgtaatctagtagaatcaataaaagaaaaaagatactaccatgtatataaaggcaaaacccatctcattctgttaggaagtcaactgtacatgtgtcttacaggtttctccatcctgaggggagtaagggcaattgaatctggagaagtagcagccaagttaaattttggggtgtggataaactgaactgtaggagatgatggtaaaactctacttcagaggctctgttgataggaaataggaattcagtcctggtggagattgacgtccctaaagagaaccctccagaatagcctgagcagcccatgggtggtaaatcacagggaatgagcagcactcatcctgaggagctcagagaattcaagcacaaaatagacaggaatctgacgagggggtacaacagatcttcgagacaggcctgcttagattgcaaggttctaattcggtcggttgcctgccttttgaaaacctgcccagggaaagcctgagtatccaggaaggtgaacctgacctcccttcagaggagctgacgaaagcccagtgtgtgtggagtagccgtgattcagttctagggtgcatctttcattcttgaagttcaaatggcattgccggtgcttgtggcacccttctgtgcagtagttgcatgtaggcactggctctcctaagatacacaaaagccataacaatctacacatgtccagtgcaccagctcacctcccccaaacccccaacagtggaaaacatatacagggagccactggttttaagcagcaaaatgtgtcctaggaaattggttcttaaagcagatcaccatgaggaaacattctgactgccggtgagtctgttcctggggttgctgttatctgcttggacatcatctgtaaaaacagcaggaagaaaaatgtggctgtccattacatagcccatgacaataataactgacatctatccatcgcttcctatataccaggcttttttatgatctctttatgtgtattattttgatgctcacagtaatcccacaaggtaggcactcttcatctccattttacagcgaaggaagcacagaaagattaagtaactggcccaaaaccacacgtgaaggattctaacccaccagcagcgattctcacccacacactcgaccccagaaattgctcatcccatagtctcctgtgagcagagcaggaagacatgacctcctctcagcttttctccttctctggcccagcttgtcaccacattccagataaacttattgcaccccaactaatggtaaggcactgacatgaaataatgtgactacctgtcatgaagtggaaagccccgtcaaggaaggaaagttagaaaattgacaccgatttccttctgcctgtgctgttgacaacaaacaaaacatttactcgacaggaggttaaactccagaaaccaatatgaaattttgactttcacccattagcatttcaaggaatgggtccaggtcaatagttgctccagtgactgaggataaaagggtccgtcatctgcagctcccctggcttttatctcaaaagctgtgggcttcatttctcacccactaacccaaaagaaatgttgagtaaagttagcatcagaaaaaggcagtagcagtttagaagcagggtttcccactgctctagcaacattggaagtgaagttttgcaaaatgttcttatcaggcccccctgtgctttcctttcagggcagctggcttttatctgttctgaatactgagttttagcatacactttaattggaaggaagggtccctctgctaaaaggaacagttatttaggtaaatactttttaaaggacatatattttcaaaaaacgacaatgcactttttatttcttcaaaagttattttgggggtaaatctgctatgttccaggctctaatctaaaggccagggacacagcagtgatcagtgcaggaaaattctgcccttagggtgctattagcacatcctttcttttttttttttaatttttagttttttatttcaataggttttgggggaacaagtggtgtgtttggctacatgaatgagttctttagtggtgatttctgagattttggcgcacccgtcacccaggcagtgtacacggtacccagtgtgtagtcttttctcccttacccccttctccccctttcccctgagtcctcaaagtccactgtatcattcttatgcctttgtgccctcttagcttagctcccatttatgagtgacaacatacgaagcacatccctttttaaaatatggatttggggccaggtgctgtggctgacacctataatcctagcatttgggaggttgaggcaggagaactgcttgaagccaggaatttgaaaccagcgtgggcaacatagccagaccccatttctgaaaaaaattaaggtaacaaataaaatacaatatacattttcaaggaaataattgagatacatcaatagtatttgcagataattttttttaccctggaaatacttaaatataactaattaataccataaatatgagccctctatagtacttatgtgtcaatttgtgttttcattgaatcctggacacagcccactttgaggcaggtagtgtcatccccttctccagatgaggaggctgaggcttggtgcctttatttcctggcctgtggtcacatgatggatggtgacagctttgctcttgctggctgatgcccgcagatacagataggacttagggaactcaccagtgactaaggctaggatcacatctgcacatcccagaagcctgcaccgtgagtttgtaatcatcatttgtcaaggtgggtgtcacagccttcaacatctcagggtttgtatgtgatttagtgaagttgctcaaacttccagtccaagatctacttatgtttgtggttcacaggattgtatgtaaaagtgtcaaacctttgtcaatgctttaggcccgtcaatgatcaaagaataagttaatgagatttactgtaaaatgttaaaaattacaaatccttcccaattttaatagcaaaatgggaagtagagggtgtgtactatttaattctttatctttaaagcagagtgtctgtgggtgatctctatgtaatatgcttacattctggggctcagagccacctaccagattgcttttgttaatcgttattttctgtcccttttcctttgcagacgatcattcccgagtgaggctgcagacaatagaaggagacacaaactcagactatatcaatggcaattatatcgatgtatgtattttattatttttaattgatatataattgttgtacatatttgggtgctatgtatgatattttgatacatgtatacaatgcataatgattaaatcagagtataaaactcagtaaacccaaccattctgacatgtaccagattgtgtgtctgctgaacgattgttggacatacattgggctcaatctaaaagcaaacacatgaatattaccctgcacaccacagaacttaacagtgaagacacggtcactccttttctcaaggtagcccattcgttggtgaatttctctgtaacattctatgccttctttgccatctcatgcttatgtggactaagaaaatgttatttccatttttttgtcaacaactcatattattcgacacttaaaaaatttgtttgcatattaatgggacaaaactctctaattcctaatacggcgatttgcaatcccttgtcatcactgcacttttaagttgtcttcaaagtagtctgcatctgttcaccaggacttctaatgcaagcaagacatgtcattaaatatgtaggctgtttaattattgaagactgcctctttgttcattctgcatcatgttaacttaatgttttacattagaataaattctttaggagacagcatgttttcagttgaaagaatgaatgaaatcaaaagtagactgaaaaatcaagggaaagttgctgttacctccaaggcccgagtttatattaaacagatttctgctcccttgtggttccgaaggcatactctgtgcttggccttcacactattgcttagtctatcagtacttccatagacaggattgatccatatatatggattgttttgcttcttgattgaatattactgagatgctactaaaagtaaatagcatcacaatctctaagaaagttatctaaaaataactatgagaatgttatctttagtgctaattagacagatttggcattttcagttatagatttttgggtagggactggggtatgattatttcaagaatagttcatctctcattcatcaaacgaagacccctgcactattttgataacaaccaaaaccataccctctccaggttccatttattttttattaaagcaagctttcttcataaggtgcattgcacttactcttttaatcagcacatgtttagtgagaacctcatgggagtactcagatgttccagaccagttatctcctcctcacagtctcccaactcagaagctgagaagctgaaatatgagtgtcttatccagtccacttacctccaggccaactgtagcacaccttcccttgagaggctccaggggacaccgttcacactccagtcccagctcctgcagtctctactgggtccttgagtacagggacagtgtcctaggcatcttacttcccctgcacctggcacatgcctgaatatagagagcccttagtaagtgtttcatgaaacacccactgaaggagtcattgtgatcagattaggcatcatagaggatgtaatttgaataagctttaaccggtgagtaagtggaaatgcaggagagaagatattccagctcaaggaggtcacatacatgagcaaggctataaagtaatgaaaagactggattactgagtttgaattgtattttaagagagaagagccaatactgagggcctctttattctcttagtcaatagatcttattgagtacttgtgcgttatttacctttctaggtgctagcagaaaaactgtgaaccgttcaaaccaaaaccaaaaaaacctctgacccagtggagctgctgttctaattaggagaaatgggcaataaattaaaaagttaattctgtatggtcaattagaaagttgtatgtactgcagagaaaactaaagccgtaaagggggactcggagcgccagacctggaggccctgatggcaattttgaatcgagtggctcagtcccactgagaaggtagcaagtgagcaaggaagacaaggggttgagctatatagatacctggaagaagagcattctgggctgagaaacggcccaagcaaaggccttgttgtggaatttgtgcctggcgattttgaagaaaagcaagcaggcaatcattggcatggtgtatgggggcctgcggagttccatgatatggggagaggtcatgggccaggtcaggtccacagttgtaaggactttggcttttactgtgagtgagatgggcagtcgttagaggtatctgagtaaagccgtgatctggctgctgggagggaagtgaactgcacttggccaggagaggaagcagagaagcctgctatgtggctgtgggaatcatcagagaggtggcagtggaggtgagaaatggcgagacccttgagctgcattgaaggtagagccagtaggatttgctggcagattggctacggggttcaggagggagagaggggtcaaggatgctgaggagaagatggtgtgtggaacagattcaggtaggggttagggaggaaatgaggagttcagtcttaggtgtgtgaagctttaaatatatattagacctcccagtggaggtgttgagcaggcagtgggtatgcatcaaaattcccaggaaaaggtctaggctggaaacaagaatataggattcatcagtgtacagacgagcttgaaggccatggggctggaggagctcactcagagaatgagagcagatggaggaaaatgtccaacaaccaggccttccacatcaagttgaaaagggagaaccagccaatgaaattgagaacaagcggccagggaggtaggtaggaagaaaaccaggagagtcacatcatggaaccagggaagaaagcattttaaggggattgattatactcatgctgccgatggccaagtagataaggactgagaaatgatggtgatgttcagcaatacaggccactgtggactctctgggtgacttcaccatcagatgagtccctcctaactactgggcaccttgttaggccctcggacatatagtatggataagtcaagcaaggttgttgcccttgtgggacttagcagccagtgagaaatgagtgatggtctaaagagttctatttaatattggtcatggctctataatttgagacctacagcaagtcaattgtataaaagaatgtgtttgcttttgttgttcattgttttcaacttgtttttaagggcaaaatgatctaacatgtgcatttaagttatctgagaaatctgagttttctcttcaagtttcttttttctgttttccaaccagttttgggcatggtattttgggcaatcttgggggacagaaatagaaaatattaagatccatggtgatatgttagctggctgtaattttctctgagtggatattttctttcccagatacttatcctacaatttttttgtttccttctttttttttttttttttttttttttttttgagacagggtctcactttgtcacccaggctgaagtacagtggtgcaatcttggctcactgcagcctggaacccctgggcttatgcaatcctcctgcctcagtccccaaagtaggtgggactacaggtgcatgccaccacacctggctaatttttgtattttttgtagagatggctttttgccatgttgtgcaggctggtctcaaactcctaagctcaagcagtctgcctgcctcagcctccccaaagtgctgggatcacaggcatcaaccaccacacctggccctttttctttggcctcaatttttatctgtcttgtttcttatagggtcatgataaaaggaaggaatctttcagaacttctgcctctttaaattcctggcccttgctacagtagcatgtcatggtattagcagtgtttaagaatggttttgaggatcactattgatataactgtctataccagtataacagaatgtgtgttaaacccttggcatattgccaatgacatcccaaacacaaatgaaattctgttgcaaattctcagtttgtttgcactttgtaagagtaatgctcatgttatttcagagaatccataagttgttagtgtttcttgctcatccatcatctcatagccagttatgattaagttacccacacctttggtgcaagcatcagaactgttgtatttgatgcgccttcactaattaagagaaactcagtggtgctgggttggccatttaactttcaggtgatgcagctattggcgtttgtgtgcacattcctttcagcaaagttagcatgcgacttatctgctgtttatcgattttatgtttatcaaatattctcttttatttatttttagggttatcatcgacccaatcattacattgctacccaaggtaagtttatttctactttgttgtctttctttgtttcttttgcccacttcctatcattttgtacccacttcaccctccttcaggaagatattgcacatttattgcggttctagccatcggcaggtacactcttgccttcccatcagacattctggtcatgtaaatcatttagttagaacttcatgttgagatcattaggagaaatgtgtccatcaattccttattgaattcaatatgtctaccttaggagtaagttggacatttgcaaaagtagatgtatagatagccattccatcaatatacaccagctgctctctacacagggaactgtgctggttgctgctggagagctaggctgaatccagcaagcacccccttctcacagtggttgtgtttagtggggaagatgtgcagtcacctgtatgtactttagtaggtacagtggcaggtgacatctgtgagaggaacagatacagataaaacattagggatatttggagcaggaaggggttgctttccggtgggatgactcaaaaaccgttttgtggcagaggtgagattgggaagagcccttgtgaatggagaaacatcatgagcaaagatgtggaagcagaaagttagttctcccaggtggaaagcagctggtgggtcaccttggctaaaggaaacagaagagctagaggacatgttgaggaagctcatggcagtggtttttgggtgattttcccagcgtatgaagtgggtcatctgcagatggtgggggtcatgagggagcgaggttttagagaatgaggcatcctaaaggatgagtcagtgagtcaatatgggatgaactgaagaaggagtaagaagcagagaagacccagctaaggctgaacagcacatgttctccccattttattattttatcattgttttcagcaataggctacatcccaggaacagtagcagggaagtgaaaaggatgtgatctgccaaaggttaggcatgggggcagggtgtacacagacagtcagtgacaagggaatcaacgatgccaagataattggggttggaaagtccaggcttggacgaagggcaatcagaggtgtccactggaccgtgaggagagggaaggagttaacagattgaggctgggtcccattgatgagtcatagcttaggaaaagaggcagttgtagccagagagcagaattccaatgcttggatctgcctgtgcagtagaactttctgcagtggtgggaatgctctctatctgcactgtccgatatcatagctacaaatcacatgtggctcctgcatacttgaaatacagctactacaaatgaggaactgaattttaaattttaatattgatagaaatagctacatttggttattccctgtggtggcattggacagcaaagctttggggtggaaaagctccagctatggctgaaatggagccactgtggaaactgatcctgccccatgcccacagccaccccaagaacctgggtgacaccacacagagtccacagtctcacatcaccactaggttactctgcactcaggtctagatgacctgctggagctcccactgtctttcatcatctatgacttgaagttggtaatggctccttccaaggtcactttgctagctagatgcaaagttgtctgtagagtttccagtatgaacctggcacaaagcaggccctactacatagaggttgctgaggtcttcaggaagcaaggctcagcttgagctcttacatatgggatagaacaaggatgcatgtcagagtctggtcctagacatctcctaaccctgctgcttccaaacggaattcatcaatgccgttagaggaacctgttgttaggggtttgaaattcattctgatggctttcagaatgttctgaattaagcctcacaacatcagatttaatacattctatgataatttgaaattaacagtttttgtaaattcgtgtgaaaatttgattgtaaaatacccaaaatactcccgagcttcatttctctccaataacttgattagcaagctatgttttcatagataacaagaacattaagttgctcttatttgtattttcaatattgaggccctctagattaaggtgactaaacgaacagctaaagtagagactgaaactgccaagtctagacatggctctttaccaggcttccttccctttgtccattctctctgcccctctccccctgtaagagattattctttaaagagaaatgccaatagagaagtcactttctgcagaattcatgtgagtgatacttaatagctcagtaaccctctctggcagcattctagtgttaatgagcaaatgtatttgtaagcagataagaaatagcaaatgtcatcagtttgcagtagacaatcagtctgcccttaatggagaagggcattgactaatgccctgtttaccaggtcgtggcagcctttccctggtacaaggtgggctgcagattggacttctcaaactggcagtactaacatcactgctggtggcggtgcagggagaggagggaaaatgaatgaatatttttaatctaacatgcagtcaagaatatacatatcatattaagaataatacattcataccatgatgttcagatgagaaagctagaatcttctattatataccagaagataatggactaatagccttagatcaccagtaatcaagatcactgatgataatcttcactaattggcatggacaggtagaatatgttcgtagatcacctttgttgaaaaacaaacaaacaaaacattaatacctccaagaggccaacaaaatgggcaatgaagaccaacaggcagatgcagtctttaaatgtcttcttgctctatttgtcctgtgttttgcactaacataattctttaaaatatattcacagcaggaacctatgaaactatacaaatggtgcaatttgctgacaaccagttttacttccaagagttagtaatgcacagatgttcatcaagttccttcaatacagaggacatattataaatttaagtattgggtctcctcctcccatccaccctcaattttattgatttttctagctgtaactgactttgacctttgataataatgggtgacgtttctgcaaattgaaagcatcccattcaagccagatctgttgcttttttagtattaatatgttcttcctatctccccttggtttaattgtcttctgtctggccactaatatatgatgacccaatattaacttcatcatgtctgactgaccagacattagtgcaacagtaacattcaagatttatgatttagcaaaccaggagctcaaaggagaggaagtcatgtccactactgcatgtctctgtatgtagaggcagggcagagtgaagatttcaaaagcaggctcaagtgatgggcagaagagcatgcaagtgggtaggattgcccagaagtgatcgtatttcacaatcaaaatgcaaccttggagattatgtggcctgcaagctggatgaagccacacacataagaaccgactggatagaacacctgctggcctcatggtggcagccatgggggccctggataagtgttcttttgatttttgtttggttttgtttagagacatgatttcactctgtcacctagactggagtgcagtagtgggatcatagcttactgaagcatcgaactcctgggctcatgtaattctcccacctcagcctccaaagcatctaggaccacagttgcacaccatgcctgactaatgtattttattttattttttgtagatttaggatctccctaaatctgtgttgtccaggctggtctcagactcctgggctcataggagcctcccaccgtggcctcccaaagcgctgggattacaggcatgagtcattgcactcggctttgtttagttttaattttaaaacttacctcaagagtcagataactcagggaaagaccatgcaaggctgttactgaagaaagtgctgtgagtgtgttctagacatggcttgcacagtcctgagcatccttcctcacttctaagtgagcattttccagagtcatttgtgcaccgggatcccccaagaaagaggctcaggcctggtgtggtctttcctgtgtactgcatgctcaccccccaaaaccatatggttaatccagatccagcccctgctttctaagttatgatgcttctcatgacaacacaataaaaagcaaatgttcgatgatagtcatgtctgaaaatacatgttaattattattgtcttcaatgttgtaacctgagctatagattgttgagatgcacgcgttacttttttgagtttaggtgcctcaatgcccacttcatcatttctttctttctgaactgtgctaatttgacagggttgactacctgattggggttccgaacttagccttcatcttgccatatatagtttctttttgtctccatcagcattagctctgtacagcaccctgtagagtccaggactagagagaggatctccaaacagaagcccccatgcccacgtgagaacagggagacgcttgtgcccccaaccatgttttccataggaccgcccagccatgtgcactctggcccaaatgtccctcacctttggaagacacagaacttccttcaaaactaatgaaatatcaagatcgtttccccagaaagaaaatttcatttaaggtggttcatggactacccccaccccccaattttactcatgaattatagtaattctatggacctcaggttatgaactttactttggtcagaaacattaaaagctatttggggataagacagaaaccatagacttaattaatctactttttaaaattatactttaagttctgaggtacatgtgcagaacatgcagttctactttttaaaaaaccatacttaggggttaacaaaatgtcacagattgtttataactatgtgaaatacattcctgaaagcatcaaaatttttactaactttaacaaactattactaaaatgtttactagcctaaccctgtagtaaaataccctagagtattgttataatcgttagtattttgaaccatggtcagtttgggttttacggttcatctcaggctgggttttctgcctatctgttattttgcattcgtgctgaaaagtttatgcctttgctcacctttcaacaattttagcaattataatatattagaaaatgctctctctgaatgacagagactagagtagcaggtcccatagctgatgtttattttgtaaaagcaggatgtagtagaaataacacatgtaccacagccagaaggctgggatccaaattcttgtgctgtcacagaaaaggtatttgaacttcctaaacttatttcaggtagagtcctggtgtttggtaaatagtaataatagtcaagaccttaccatgtgccagacagcattcccagcactcacacatacagagctcatttcatctttaccacaaatatgggagatatatgggattgtccccaatttataaatgagaggaaaggagacaaagaaacttgaaataatatgctccaagtcacagacctaaaagtgcaaaggccagattcaagtgtagccactgaactccagcatcaaggctcctccccacctcactatactgcctcccataggtgaccttggggattactttaactcatgtatgtatcaatgcttagagcaattcctggcatggagcaaatgccatgtatgcgtgacctgttactgtttttgagaaacagcacagaatcgcttaatcattaggaacacagactctggaactacattgtctgaactcaacccccaaccctggttcctccattggcaacttgtgtgaccttggacaagttacttaacatctctgtgctcatcataaatgaagatgaaaatagtctaccttgtagggagctatttatttattttttaacttttaggttcaggggtacatgtgcaggtttgttatacaggtaaactgcatgtcatgagggtttggtgtacagattattttgtcacccagataataagcataatacccgataggtagttttttaatcctctccctcctcccaccctctaccctcaggtaggtcccagtgtctgttgctgcctcctttgtgcccatgtgttctcagtgtttaactctcactaacaagtgagaacatacagtgtttgatttttccgttcctgcgattggtcagttaggataatggcctccagctttatccatgttgctgcaaaggacataatctcattcttttttatggctgcatagtattccatggtatatttgtactacattttctttatccagtctactgttcatgggcattttggttgattccatgtctttgccagtgtgaatactgctgtgatgaacacatgtatgtatgtatctgaatcacgcatgaatcatatagaatgatttatttttctttgggtatacagccaataatgggattgctgggtcaagtggtacttctgttgtaagttctttgagaaatttcccacactgctttccacaatggctgaactaatttacattctcaccagcactctataagcgttccatcttctccacaacctctccagcatctgttattttttctttttaataatagccattctaattggtgtgagatggtatctcattgtgattttaatatgcatttatctaacaattggtgatgttgagcattttttcatatacttgctggccgcatggtaccttttcaagtgtatctgttcctgttttttgccaaatttttaatggggttatttggcttttgcttgttaatttgtttaagttccttatagactctggatattagacctttgttggatgcatagtttgaaaatgttttctcccattctgtaggtttttctgtttattctctggatagtttttcttgttgtgcagaagctctttaattaggtctgatttgtcaatttttgtatttgttgcaattgcttttgacatctgaggaggtgtaagatctctacagcgagaactacaaaacactgcccaaagaaatcagggatgatacaaacagtgaaaaaatattccatgctcatggataggaagaagcaatattgtttaaatggccctactgctcaaagcaatttacagattcaatgctattcctatcaaactaccaatgacattcttcacagaattagaaaaaactattttaaaattcatacagtaccatagaagagcccaaatagccaaggcaatcctaagcaaaaagaacaaagctggaggcatcactttatgtgacttgaaactgtactacatggctacagtaaccaaaacagcatggtactggtacaaaagcacacacgtagaccaacagaacagaatagagagcccagaaatggtgccacacacctacaaccatctgacctttgcaaagttgacaaaaacaagcaatggggaaaggactccccattattaatattattgaataataaatggtgctgggataactggctagccatatgcagaagattgaaactggaccccttccttataccatatacaaaaatcaattcaagatgaattaaagaattaaatgtgaaacctcaaactataaaaatcctggaatataacctaagaaatagcattttggacataggccccagcaaaggggccttttctttttaatacccagtaagttgcccatttacaaaataatgtccttttttgctgaccttgaaaatatactcagacaaagcagagtaggtcttactaattgcatatgttcacatttcaaaatgtaagtagtcttatgtaaacccctaaatagctagtgacatgaacttttcatttctcacatgtgaacaaacttaaactgtgcatagttaagaagccttggaacaattcatagagattgtgatctgtggagaactggctatccagataggccccaccacatgccattgaccttatcaccgccatcactgtcttccttttatgctcagaggatccagatgcccagtgtcatctttgaggatgccaggtcacattggcaaagaccacagaaactgatatggagaaccagatgccagatagtcatttacaatgaaaactgtaaccacccatcagacagaactgccaaggtcaggcaggggcattctgtgtgaagaggaagatgccttggcagaagatcacttcatcatgaccagggcatctgaagaaggggtcggagagtttattcatgattcaataagtatgcaccacctgtcttgtagtgagttggcataaaacataagctcagtaagaacacaagaatgaatgagtgaatgagtaaatgaatggattgggacttacgatgtgccacgcaccacttagacagtagaatatctcagccaggtagagaggatggctcatgttggcccggcaaagccaaaatcctggggcagattttggtggcattatctccaacatctctgactatttctgtttcaagttaagggctggtcagcttctattcttagaaacactttctttacatatgtcagtaaatcaaatcctgtatttagagacagtccatcttgttaaactaactttgcttggctctaccctgaccctgtttgtgtaacccctgtccccatacatataatcagttttgtctgtagttataatttgtccataatttgaaaaagagaagcctaaaaagttccctccagacactttcagctaggaacaaacttttatgtgaaaataataaaaatgtggggagtgaaggtttatagtggaaatatttacagagcctcaaacactgcacaacagttcaaactttgttgtagtgccttcattctttttgctgtcagtttgtttttcttctatctttattccacatacttctggtataggtttaataaggatttttcaaaaagataaatatggtttatattttcccagctcaaaattccccttcaggcctctgaagcaataaataatagtgctttgaatgctgcactcactttcctgggcaagccattccggtagtggagggttctcagagcgtcagtgtaacttctgcacactctgtaaagcagcttttttctcttgcattctggcctccagatggagatgaacacttgaaattatttctcagtagaattgaaagaacttttttttaaatcaaaagctcagccttcagtaaacaacttttgtttttattcttccaagaaccagtgcagcttgcacttcaagtgcaaattctgtgttagctagcactgtgcttcctggcaaagttgttcctgcattgtcagtgagttgtaggttatgttttggattcatttgttatgtcctatttgagactaatttaaaagtattacctagtgaagtggagtattctctggtttccaaatttaaatagggatgctttgagaaaatgtgatttatatacaggcgaacagtgactccataaaagtcactgtcgtaagtattccagcgacccagggccaagtttatacagaccctgcctgcattttaccaaccatctgtggttttacaagagagaatgaacaattgcaattagcagcttatccagaaacttccttttaaacaataatttctcttcactagattaatttcaaaagatagttgccaattagccaaatggtcactttcatagacatttctcatccctgtgctctaaataaacttgctcattagcaatgagaacatttaaaggaagagttaaagttaaaagatgaagtaaaaaatagagcatgtcaggtaacatccacctatgttgttatagatgccataaggaaaatgtggccctctaataagagaaccaaaattaatacagaataatttgaaaataaatgatgtcctgttgttaagcaagcactcagatttaaggtgtcttaaaacaaatgctttttaaaccttcaagagtatttagaggggttcctcatttgaagtagaaaatttgtagaatcttttagaggtgacagaaactttaagaagctcacagtccagtttccttgttttgttattataacagttggcacttaaagcagaactatatttaagtgaccttcatccacataagttcaagtgagtcatatatgcaaaagtatttgcaaactgcatggactaacgttcatattttaatagagtgtgtgcaaagttcaacctaggagaaacgtcatatgttaagacagacctgttcccccatagggccttttattcaacaggaagaaaaactgtgaggttacatctttctctcaggttcagccctttaaaaggagagagctgaaactaatacccatgtactttccaaagtgctggcttccccgtgcctctggcaacatgagtccttgcaaagcaaagctactcctttacagcctggttcattcaaaattgaacaaaggtttctgtgcacctgtcacttgccaggatcagcacacgatccggaatataccagtgacttcagaattacccagtgtggagtataaataaatgatacccaactcttactaatttgtgattttaatgcacccacagatttggggacttcattttgatttttaattatttagatttttttcaagagacatggtctcactctgtcacccaggcaggagtgtagtagcatgatcatagctcgctgtagcctccagctcctcggctcaagggatcctcctgcctcagcctcctgagtagctagaactacagggataagcaaccacacctggctaattttttattttattttttatagagacagggttttgctatgttgctcaggctggtctcaaactcctggcctcaagcaatcctcctacctcagcctcccaaattgctgggattacaggcatgaggcactgcacccaacctaggaacttctttaagccatttctcttctccacccctaccccattttacagaagaaaaaataagaccaagtgcagccctagaaccacttttccagaaatctgggcaccaggtttctttttcacccatgggcacagtttaggaccagtttttcaaggcagcaaacagtttaggaagtttctagctataaccagtgactttttttcttgccttctcactcaaaaggaagctgctggaaatttcctcatgcaacacccttcactgccatggaaaatttgagactgtctgcactgagctatgtctagggagccaatttatctgtatttcattcatttattagatttattctcttttttcttaaataaaagaggattccacttgtgtactgagaagagcttaattaaggaagatagagactaatgaaagcttttatttctctggcagtagcccctgaagcatatgaatataggctgttcccttcactttacttccttgacagaaggcagccagatcctttgggtcaccaaacccctccattctgaaggctgccgttcatttttttttttttttgtccttgattgccgtctctctgttcccctctttacagcatgcgcaagtacccaagctcagtttctgagcgttctctttggagaccgacactgatgaatgctctgtacctccgccagcaggatgcttctgtgctgtggacatctgtcatgttccttccttccgaggccacagcactttctcctgcgcctctttttagctccccatgcatgccgccattcggtctgtcccagggatcagggactgaaggtccctctggaagcagtgtctctatctctgcattgtatagcatattgttgccacacactacctacccccattttattcttttctatattagagatcctctttggtgccctaatccatatcccatcactcaaatctgatgggtctgcctttctcgacctgctttctgtgtcaagaataatagaaacctttttgcattccttttcacagtggtaccactgcaacctgaaatagtttacgtaactgctagggaggtccgattctagaagaggactgaatatcgcccaaaaagaatgaaatgcaaataatggtttctttcggtagatggagtttccagaaatgctttggaacatttcaattctaagagcaagtcatgctaggctacaaaccaccccattattggttttacccatagatatctctttgctttatgcaacatagtcacaatcagatctcttcaacttgttcttaaaatttcttccatatacaaccatgttttatgtcagtaactaggccaggactgtccgctccccactaaaagaagataggcagaatggttaatgaaagcctacactctagagttgcacagcctaggctcagatagcagctctgcaagtaacctctcaatagatattagctacttattgttattatcattttgtatgttccaaaagacatatctctcaatagcagagaagcagttcaggttttaaccctagtataatgtatactcatatagttttcatgaaagctgatacatcctacacctgttaatgcttccttccagaaggatgtatcaaagggagccacttaagtgtgcaccaacatcctgtactccctccagagtacaaagagtgccatcattgttcactgttaaactgtagacaaacataggttggaaagacaacagctgcatcctaagctggaaaagcatattttccttctgtttttgaagtcttgctgaaattgagcagccttgatagcagcgccagctccacgtcttggtgttctgaaggcttccctggtgcacacttaaagtcagatgacatgtgagtgaaaacagcttaattccaaagaccagacaagttccttcctaacaggcttcattgaaagcagttcctgagataagaattacacaggggtgttttagagaggagctttaacatggtaagttccttatatttcttaggaagaaaatggctattgattaaatttatctttattataaagacatactaaataatatctactatgtaattatttgtcctttttgtttttaaacatttcataatcattttaattgaataaatgattaaaagaaaagattattaaccagaaaagagaaaatagatgatggttgaagggttgtatagcatattatagacagaggtttcccaggctattttagtgtttatttaaaacctgtccgttaatgtttggtttatgccaattttctcttaatgaaatttgacataaccttttggtgtccaatcaggatttcatatgttttagaaatacacccagaaacaaacattccatgaaactaagtatgtagagaaagccacaaatagtcacatggtttatattgtcacactttcttacttcagtctgaaatgagaattttggggaatggaatgagtgaaatgtaagcatcaacatgtgggttgtgtgcgctggagaaaaggctaatcgtggatacagcggaaagtgtatgcctgattttaggtataagaagagtacacacctgcaaggcaatttagaagaaattgggcaaacagcaagtacccgccaaccagagagggccaggtgaggggaaaagactcttgtcacaggaaaccctactccagttgagaagagatgtgtcattgtgtggcatcactgtaatttattaacaaaacactctttaacatttattatttaagtcatcactttcaacactacttctaataaggtatattttattatagcttttctcttcttttactgtcaccaaattgaaattccagtggaccagtgaacacttctaaccctattatgtaattctaggcataaagagtttttcgtgtgagagttgtccttagaaaatgcgattttaacaggccagttatatttttgattttaggttaaagtattgccgagttttccccatcatagaacaattctcagtgtgtttgcttgtaattcattagttgatttccattgtttcctttaaatggtaattttcttgggatattcttagcaattcgggataatgagcaaatcatgtcccttatacccacccatctcaactttgcttttccttttctgcagctgaaacaaaaaatatttcatgaaagttgcatgattttaacataagtagcctcaggggagaacaaatgcaactatcaaataagtgatgttaaggattattaatgctgaagccaagtatattctgtgtcactgttaccacttctgtgacacatgaggcagattcagtttgtaaagcatggtggcatattttaccgtttacatctcactactgtaaaaatgaaaagctactcaatgtaaaattatagacttaagtgttatggaagcatcatattgaaaaatcacataaagctttataataaaaacttagaaaaccactgaagggacaactagttctctaaatgttgagtaactgacttcgtaacccttattatagattatcaccaacagcaacaggagcaatcatggatcaaaaatttaggaccacttttattcctgtagcaagagctttaaaatgaatgcctctcaggctcatcgtcttctgtggttaagtcccaccttcagccatcttcattgctgatggagggaactggctgccagtgcccaaaggagggagcccaggtttcctgcagctgctttgccttaacatccctcccctttcccttcgcacttctgccattcagtgtgtacccccacccaccacacactccctccttcaggtcccagaaccacgctagaaacaaacattctggtgatgcgctcaaacgggccctggtctcgggcagttcagttcattctgcagtcagaatagtggtgctgggctgacctgaattggaattccagctttgccacatactggcagtgctgctgtaacaaaggcacttcatctcctaagcctgtttcttgggctggagtaggtgcctcacactgctgtgttggggaatgaatgagatcgtgcatataaagagcagcatccagcacctgcctggcagggagccatctagttgtacctatttatttgtccaacacccttgtcctgggttccccttattccagcctagaagccttggttctcttattgctgacagagctttagggatggcaagagtcccccttggttttaacactgtcttcctagtacagccccagtcctccctggtctgaatcaagaggtcagcctatccaccaatcccctggttcctgagcccacctgagcctcattgccacactggggagccttggagcccacgctggccctgccagccacacgtggccggcttagggcctgccccctgccctataggctctgaccttcctgcccccaggctctccctgtgctgagccatcacctgcagccacattgctgctgtctgttggattcccgacccatcaccacctggacatttctgctgcagatctccgccagccatttggatgcccagggagctgttcttgccataataattgtaaaattataaaatatgtttaaactttgcctctcattaatcaatacggaccatctttttgttcactgttctttactgttcacattcaacatattcctgtttcttaggagttgttttgttcaatggaaagagtagacccttctgctctggacactggcgtctgtccagaacatgcaggagagctcagtgggagcctttggacttggctttggatagctgggctcagtttaccatttctctcagcccaccgtaccttgctcctcctgttcccacttcatcctcagctgctgatggctggtcacacctaaggctgagcccacacctgatcaaacctccttgcagtacaggtgccccccgtagagtccgttccaacaaccaaacacttcttcctctgttttctttctctgatttttcccgagctttgattctaaaaccggaactttccttagtcatgttttttagtatctgtcatggttgtcttccactcctaaaatctgaacttgcaaatcttatcagaattttacatttcctacaagagggccccatgggagtctccttccctcccaagtggcaacaagtggctcctgctggaggacctgctatccccaccctccctcccctctcccctccttcagagtcataccctgtcctttgagacctatggcaggtacctgacttcaacaatgctagtcctgctactgcgtcgccagtcagacctaagctcttcctgactttgactgccacaggcatcctcatacatcagttaccgaccctggccttcagacttttcttcttgtgtatccccaaaagaagtttgaagaaattatgcacctgctctaaacatttgagtttgatatcgaaaactttcatcacatgtttatgtaagtgtatttgttaataagagatagacagtatgaaatactttctaagacaaaatgaggattggtgtaattaagataaatattttatgatatgtggtgttttttaactgccttacagattcaagcataccaaacctgaaagaaaactcatgaaactttcacttacgggtttcatccaagaaaatttggctctcctcgaaagcattctggttccatttaaaagagtaaatatggccaggcgtggcagctcacgcctgtaatcccagcactttgggaagctgaggcgggcagatcatttcaggtcaggagctggagaccagcctggccaacacagcaaaaccccatctctactataaacacaaaagctagctgggcgtggtagcgcacgcctgtagtcccagctactctggaggttgagccaggagaatcacttgaacccagaagccagaggttacagtgacccatgatcgcgccaccgcactccagcctgggtgacagagagagactctgtctcataaaaaataaataaataaataaataaatagtaataaatattaccaacctctactgcttcaagggttctgagttcagaacatcttaacataagccaaaatgctaagttttactcctcacagaattgtttcagacagggaagtgagtttctggagccagaattccagcccaaacctgtaggtttttacacctgggcagtgccccatggtcatatttgagataggtggtttttcaagtgtatgaaagactattgtgaggctggacacagtggctcatccctgcaatcccagcactttgagatgatgaggcaggcagattgcttgaatctaggagttacaaaccagcccgggcaacatagtgagaccctatctctaccaaaagtacaaaaattagctgggcatagtgcctgtggtccaagctactcaggaggctgaggtgggaggatcacttgaatcaaggaggtcaaggctacagtgagccgtgatcataccactgcactccagcctgggcgacagagctagactctgtctcaaaaaaaagaaagaaagagagacagacagagacagacagagagagagaaaagaagagaggaggagggggagggagaggaggaggaggaggaaaaagaaggagaagaaggaggaggaggaggagagaaggaggaagagaggggaaggaaagggaaaggtagggtcacacctgtaatttcagcactttgggaggctgaggcgggcagatcatgaggtcaggagatcgagacgttggtgaaaccccatctctgctaaaaatacaaaaattatacaaaaattagctgggtgtggtggtgcgtgcctgtagtctcagctactcagaaggctgagccaggagaattgcttgaacccaggagatggaggttgcagtgagccaagatcacgccactgcactccagcctggcaacagagcaatcgtcaaaaaaatgtatataataatacattttaaaaagaaagaaaagaaaagagaaaagaagtggaaagaaaagaaagactattgcatatggaggctggagactcctgcctagggaataagttttggcagagtccttatagatattaagtatctggaaattaatacttgaaaaactactcatatatgccttagatcgtctttatgtatctccaagggtatgcatagctcagtttgaggaggtttttttcaattttttgagacaggtatgttgcacagactggtctcaaactcctgggctcaagcaatcctcccatctctgcctctgagtagctggaattacatcagttgaggtttaagtgtcccaggatgtttgccttactgtactttacatgagagtgtgggctgttcttatcttatctctacctcagaaaatttcaagcttctggatggtggagaccatgtatgtattactcacctttacatctctactatacctcacagaatgcctggcatttaacactaggctgagtgcttaactgctgcacgcaggggtggccactcatacccactggggccaggacagtggtataaacgaacaaagcaagttaggcatgaggccacgttaggaaaatgtgcatggaaaacacactggcagcacaactcactttaaacatcatgaagaaacagggagcctccacttgggtcttggaaaagtgacctgaggaagtgacttttggactgctcagctgaaaccagcaaggagatgtgcaggctttaagtgacgcatcagcagaggggggtcttgcgggaggacgctgggaaggagcgtgagggagatagatggtcagggaggggcaggtgccctgacacagtccaggcacagactgtgtgggaccgcatttgccttattaaagaatttagggcttactctgagagcagcggaaagctgtgggaggatttatgcaggaaaatgacatgtggggtttacagtcttcatagatgagccctggctgagggatagggaacggattcaggggaggccccatgtgggtttggggtgttgtattcatccacttggtaaataggtgagttgtcatggtggctggggtttggagggggacagaaatggagtggaggaaacagggtgtgctgtgctcttgaagtagtcctaccgggtaagcacagacgcttgggggctggctgtgcttgtgaagctgaatttgattctgtatcagtgggaggcccttggattggagtagttaaaggagggaagtgacctgagatcatgtaccctagaacttaaagtataatttaaaaatatatatatatatatggaaaaaaattaaaaaaaatgaaaacctagaaagatacaaggttctatgtcattacattaaaattgtaatgcttaaaaaaaaaacacctttaaagaggtggtttcagtgtggttaatatgggttctctcctgttttcttcttgccgggattgtgaggactgtgtggtacacacctgtctggtagagcccttctgagttgcttccgatgttcaaatgaggcggtatgatgtaatgcagtcagacttctggttcaaaactcagccctatagctcactagctgtgtgaccttagacagcttgtttgacttcccagtgcctcagtctccatcagtaaaatgggggtgagcaataggacctatttcataggatggtgttttctaaatttaatgcaatagtacatgtaaactacttcaaacaggacctgggaaacagtaagtgtttaagggacattaggtattattctgtttatgatggaatgccaatttgtacttatattatctttctttacttcaaaaaactcgaaaatgccactgtgagcttaagggaccttgacttctcagcagctctagttaatgtagaaaacatagtgtatagaaattcaaatgtgaaaagcaggggtacaagtcatcaaggtttgaaaatgatcatttttatagatgtaggggtacaagtgcagttgtgttacgtggatatattgcttagtggtgaagtgtgggcttctagggcacccatcacctgaatattatacattgttgaaacgatgatttttgatatctctcacttcccatgaactagagaactcatcttatacaataaagcccatccttgaatgtctttcattaatgcttttcattgcttgttaaaggttaatgttttttattgaaaaaaaaaaacgttccgcccccttttttttccctttggggcttggtggtggcaggaatggccccctgcacctttccttctcagtagaggtctctgtgtgcctgccagctggaggagacggaatgtattactggcctgatattatagaaatttctagatgttacctttcagatttcccacagggggacaactgctgagattaaccgtgttgcctattgtgcaaacatctgtaaacgcaccaccacagcaattgcagtggctcccccccagccagaaactgcggaaatcaaatgccctgtcttgcaaacacatctgttcacaccttgagagagggaggcttttcagagctccttgctctgaaaaatcttgggagtttgtttgtttgtccactctgtgagcaatccacagtgatcttgggagtcagaggtcaaaggcaaaggcttactgacctcccatgctgttccccctgtctttaggtccttcaagggcatgggtgctaagaggagcctccctgtgtaccaggctcacatctttggacttgtgatgttggctcatgatggtcgtggtcactcagaccccaccaggagctgctgaatccaaatggagtagctcttggtgacagtaaagtccacccctcccctggcctggagggtatgttctgattttgccaggagacaggtagctgagtaatacttgagatcttgggaaatgatttgaaatatgtggaagagaaaagaaaaaacaggattgatacattctgcattaaaaaccttatttgggcaccttccctattttctaccctcaaaaaaaaaaccccacaaaaaacaggatttgaatgaacatttggaaaaatgcctggaatcatcagccacgaatcaccagtgcccacccctgagcaattttactgtagagccaccacagtgaccaggccagggagggagccatgcgtgtggcagaaggaacggccgccaagtgttggctgcacagcgccccgcgcctgcaggagagcggagacaggagaaagcgaggccagctgcactgcagggagatgtctctgcctgtactttttttttctttctgggatctatttagaataatctttgtgttcaatttcatttttagattttaacaccgaattctttttgttcttctggatccacatatctaattttagcattgaaaagaatttcacctagtttatttttgtatcctaatctttttttagcgtaggtcaatggataagaaaatcacaaaaactaagtgtatattatcagccaagtgagctgctagtgcttataaacaccctttattttaaagacaatgcgaatttcattatgtaaacatgtaaaaacccaggccatcttaactgatgcccagccgcagaggtgaggtggcatggtcatgttcctagatgacatgttatgaatggagttccttctacatccaagcaaaacaggattccatgattcacagagcttgcaggcaaggttagactagtcaggagattcagaacaaacaaatctttggtgtttcacagttacaactccataggagagcacctgatggttatactggaagacgaagccgatgtccttgatgctatagatcaggagagatctgaaaacacacccagacccacctccaccccaacccagttcagtcagagtctcttgggttaggacctgagaatttaaaaaaatctccacagtaattttaataagcagctagagttgagaaacattgcctcccgtagagaacagtcactgggaagctaggattgtactgtggttacctagggtgatggactgagctaagctgaaagcagagccttgggtggggaaactgagaggagtgatctgtatagtgcttgggagcagtggtttaattccggctgtgctgtgaggacagtgataattatgctccttctgaagaaatccttgcagaagatgtcacctttccatgaattgaaaaggaggaaaggtgctgtgttttcaagcttctccagataatcttagaaatgtaagtcgagaaagggaatcatacaaacatcatgtcttaatttgacttagtacctagtatgggtttaacataacactgtcataataatatggtttacacacatgcatacagacttaccatccattcattgattcactgggttcctgctatgtgccaggcatttcctagggcactaagaaaacagcagcaaacgaagaaggctgagttcccctccgggaggggtcttacaccgagcaatcccagaatgtcggctggcaagaaggggtgagtgaggaatatgctggaggcagaatggggcccctagcctagagtgcctatgagaagacccctgttgggccctgacaagggaagtggctttgctcttcctgcaggcacaagctgtccatgatgctgggacctctgattcatccactagagccattgtcatcagaactatttctggaagtttctgagtaggtggcacagccctgtgtacctagtgaagcccccccccctttgattcaggggtcacattgggctgtttgcgcaaagaaggactcactgcttctttttccccttgtgaataagtaacaagctgttaagtacacaatgaatgtacctctctgcaagccagaactgtagtgattgatggaatccgatgtttacttgtcccctctgtaaccttagattaaagtcactgaaatcttcagcctctacatcaggagaatggcacgcacatgccaagggacgtggccaaaatggctggtggagctttgtgggaggcagagtgcatggtcccttccccaaagggattagatgcagagacatcaggagagcaagtcagcttttatggggagggtaacagtgtagtcagaagcggcaagggagaaatgataggaatttgtgttgtggagagaaaggaaggaggcctggacagggaggaaggagaagaaacattacacaagaaccgattgctaattggtcaagagggatggggagtgactgaagggccccttgggtgtgtcactattattcagtgtccaggctgctgcaaaaggacagctattaataaacatcgttaaatgcatcttgttttctttctattgctttgttgtttataaaatgcctgagtatacattaattccaagaatcctcaaaataactttgagaggtgttactgtgatcagtatataaagaaagaagacattgaaactcatagaggctaagtaacttgcccctaatcacacagccagttaaaaggcagaagcaaatctcaaattcaaatatttgagctccagctccagcaatctgaaatgtcaagatacctagtacaattgggttctggtcctggatgtgcctgaacatttttatgatttcacatatatcatgtgactctccaagcctttgaagttgcatttctctcatttccttgcctttctacatgtcttataaagatttctacgcttacatttataccctcaagtatgcatggacacaaagtcgagtttgggtttttttaaaatctggattaaaagaaattttaaattccaactttctttacctgattctctctgtagcactggccttttgtaatatatatttttccagccataggaaagagctttttaatgctcagatcccaagagctaaggaagtagatggctatttatgttctgccaggaatctttatgttcagtgagaggaagtgcaactgcttaaaactcttaacttctctctcttactttagaaagtcaagcagaaaaaaaaatggattaatttgacagatagcacagaataagaaaaatattagaaacaagaagaggccatttttcctatagaggctcatttcattctatataccacttccctgggatatctgctaattgttagcagaaagagtaatgttatctattttttaaaatttcactcttgagtactatggagataatagctaaatgatggagaaataactttctttcacggtagtagtttaagaagggtaaaaagagctcaaaggcagatgtttgatgacatgagaaaattcagcgacaaatgacaaatttgatatttctataggtgcagttttagaaagagtatctttttgcattgacactagagacctgtgtccatctgtacaagtgagggaactgcatgtgggtattaatagatgtatttgtaagccccggaaattttccagttgaaacttacaacaaaaacaaaaagtttctgttgtgttttgctgcagggccaatgcaggaaaccatctatgacttctggaggatggtgtggcacgaaaacactgcaagtatcatcatggtgaccaatcttgtggaagtgggaagggtgagtggaccgtctgctgcaaatggccattttgttccttgcttagttggtaacagaaagtaaggcatgaggcaagcttttgaactattatgtgtactccccaaaacattaactactccagctcctcctattgcttgctgcacttgcttataaattatcagtaaacatagcctgaattgctttcatttgttgcgatagcaacagacaggaaaggcactcaagatttaaaagcagttgttatcgggccatattgagagcacaaaaatacctctaagcatgaatgctgattgttgagtgtcaaaactcaatgggtgctgcattagacatgactaccttcccaaactcccaaaattggctctaaaaacagtgtgcagctctagattcaatccttagattagaattccagcatcttctcttgcttaaattggcctttcctgtgtctcagtttccaaacctgtggaatggaaagcatcatctttctgaaggtcttgtactaccttctccgtagtaactgtttatgagcagtgcttttatttaaccaggaaacttttacatagttgtaatctcagtagtagtatgctataggattatttccaaagtgaaattttaaaatgagcaaacacacagcgtgcagttgccttttttacagtaggttgaattccatggttgtgctaactgaagagaagttggcatcatgagatttgccctcagcaaaggcagcctagaggttatcctagaattgaaacagtgagacaggagccataaagggtttgtctcttaagattctcaggtttcaggaggcacaaaccaggaagaagaaagacatcacaattctctcataatgagaatattcagtaagtaggatatatatatatatacatacacacaatataagtaggagatatatatatgtgtgtgtgtgtgtgtgtatatatatatatatatatatatatatctagcaaaaatggcacattaacctgaaaatccccctacagacatctggaaattctagataaaaatataaatatgtattttaatatgtttatatgtatatcacatgcatatgcaaatatatatattttaaatgtttagcttagcccttaataaagacagctactacagaccagaaataaagtgaggactagagatcctagggagtgtagcgcttgcatgcacccttaggaggctgggcagggggttctgtgtgagtgttgggggagggtgggcagcaccagtctttgtgatcttggatcccgggttttaaagcccactgagggcaggaaataatgtggacacgtacaatgctaagaatttagatgttgactgccacacagaaccaaaacccacaaacagtagaccctcagagaaagggcaaactggggaagtggaggtagggagagggaggagggagaagggagaggagcaccagccagcccagggaattggcaaggaagttacaccattttcacttaggtaggatctgtgggggtaaagcacttcggccaactccagggtcaaagtaaacacctaataaaatcagaaaataattagaactgtgaatcataaagtatcatgatagtgttaaagttgtcacatgcaaataacatggtaccagagaaggaaatacatgtttttaaatgttgttattagaaaagaagaaataccaactaagcatctaattcaagaagatagatgaagaacagagcaaaaccaaagaaaaaaaaaaggaaataataaacatgaatagaaatttattaactaaacagcacagaagcaataacaaagttcaacaaaataaaaagctggttttgtgaaaaggttaataacatggacctctggcaacagatcagaaataaatagagaaaaaccacatatagccaatagcagattttttttgtactgcaatagaataatatgaataacaatatatttgatgaattaggtaattttctagaaaaatatgactttccaaaactgactcaaaaagaaacagaaattctgagtagataataattatcttaaactcgaattctggttaaaaattgacgcatggaaatgtaccagtgtatttataggtactaaatattcaaggaacagataattcaaatgttgtaaatgttaaaaatatataacattttataaatatataaaaatacataaattatatacattttataaaaattattctaagagaacagaaaagaaaacttgttcccccatttcattttaagaggttagtataacctcaatatcaaaaccagacaagactacagtaaaaggtaaaattataggtgccacacatagataggaagagatgaatagaccagtaggtccaagcaggccagatgtaagacaccaaaagcccaacatattaaggaataggataggaaaatgtatgatagtaagatttacgtaaaattatctgtattacaaagggtataataagtgaccagacaaggggggaggtactatggggctattatgcaaagtttaaacacttccagagcaatattttatatactaaaagtatagaaaccatttctttctttcaatgatgtctctgccgggagccagcatgggagtgcaggtgagctggtgaggaggctactgaggcagggaggaccaccagcccggcctagaagagggtgctgggcctctccttccacagacctttctctggaaagaggaaactagcagtactgtgtgtccacctggttgggctgccataaccaaatgccacaagccaggaggcttacacaacagacatgtactatcttcctgttctggaggctggaaagtcccaatccgggtctggcaggattctgcttctggtgcaggccctcctcctggctttcatgtggccaccttcttgcggcaacctcacgtgtcagagagagcgcacgctctgtggtgtctcttcttacaaggacacgaatcctattgggtgagggccccaccttaatgacctcatttaaccatcattatctccttggaggcctgtctccaaatacagtcacacttggggtttagggcttcaccatttgagttttgggggtacacaaatattcagtccataacagcctgcttaatggggttctcgtaaagattcagtgagtttccacatgtcaggaggttagagaagttcctgcccattccgaggactcaataatacagctattagtgtaaccgtaggtttccaccaacaaacctaagactgaagaaaaagaccctttttgttccgcacaccaaatctacctacttttactatgaaaacattaatgactattgaaaaaaaaaaggccaactccactggaaagcaagttccttgaagggaagagatggccttgctcagcagcctctccctccaggcccagggccctgagcaaatgcccagcaaggtgaataaagagagtacctcgccatagtgtcacggagcacaccagagccacctcatgtagcctaaacatttcatctgctttcatgtgcttgtgtttcttcccctgagaggtatagtcccatctgactccttcatttacttcacacatccttgctgaccacccacatgtgatggggagaaagaggtacctggagcccactctcgggtgccttcctttcacaatcccagcactcccagaaagttgtgcacccgtgcacacgttcaatatttgcactggagctcgcttacaggaagagtcctcagtaaattattttgaaaagtagataattgctaaataacaactattactggatttttaaaaataaaggcacatgtattttttgcttaattggaattccaaaggacaccactgtgtctggactcagtggcttaaaaggttaagctgattttgtatgatacagccttttactttaaggaaagatgaggacagcatagtctttggttgaaaagtcaaaagaaaattgtgctgtaaaattactgcagcaaaaaataataattacacactaaagcccactgtgtctgagacatggcacaattttcagggagccaggtttcattcagagcgacctgggtttagaaaaggaatgaaaatgctatgcagtggtggtcgctgttccttccatcaggcacctggacccgtcacatccagggtagtcactggtgatttttatgacagcaactattccttctgacaaataaccatggaaattttgtttccaataaggtgtggctgaagtgggtggtggtaactaggtttctggtttacccataaatctaagtccgtagatttaaagtaactcaaccatttcaggtctggtaaggttattaaaaaaaaaaatttcttccaaatccttaccaggtttgtggggacacgggtaagctctgaagaggccccacctcattgccatcagccccttggatgggcctgactttagtaatgaaattatggcatctgtccttgaaatgtctggcatgatttgggggttttgacaagaggtcatgttccctcatgggaaaagcactctccttgttccaggctgtttcccattgttaatcctgcacatttgtttacagatagctcctccatttttagcttaaaaacaacaacaacaaaccacccaagaaatcaaaatgacatggtttttaagggcaatagctacctacttaacatgtgtaccgcacatagtgcgtccttcatgcattaagcatgagctaggcggatgcgtgtttgtttacacagacttgctgccgattcattaaggcagagctggggacctgcttccccccattttgccctgaagcgctctgcattaggcggccctaattgctggtgttggagccgccaggagacctttcctgtcgcagcacctggtgcagaagacatagatgctgcacttccctccagcggggtccccggtacatctgacaggacctgtcattatctaagacttccttgtcaccaccatgcctccccttttagcccacgtgttctgggaagagacccttgtcagttttcctggcacctgccaccggctgcacacctggcattgaaatggcgctggaacgtgttgtgattattttccctctttaatgaacccacctgagggacatttagtttcttaatccagtcgcctgtttcccaggcattcccatttacaccgtttgtgtggagattcaaaaactctgttgtggtattgagctgttccatctgccagaagtcttataaccaaatctgcaggactcccaaaggagactttttacaccggtaatttaagctaattatttctaaacatatttagtcagttttatgaagacctcattagaatgtgactgtttattaaaaatccaaatgaggtctcacagtcacttaggaaaattattgttgagtcactctgaatagttctgataacagaagataaaatgttttggagctgagagaagtggggaccagagctgtggacctctatcacagtaggggatgggaagaaaccacctacatggattcttggatattttccacccaaggagcctgccctaaaattcctctcacagtacttgtcactaaaagagtcatgaaaggaaaagtttactatgaacactagacgtcagaactaacaactttctaattcacatacaaggaaggtatattaagattccaggtgcccctctcacagccaagaaaaaaacatcttcttttgtgcaacagccaccagacccaggatcaatgaggaagcaagagagaggcaaggttgcccttttataaaaagtgtggaaatactggttaattataagaataaaaatattagtaatcgtttttactacaaaatctcttgagttgttccaagacatcaaactcataagaaagggaagagggaaattgtttttatagacattgctgacagttttccgtcttgagcactcactgttactttcataggtcctttttcataaactgatatttaagattgatcttttgtgacctgtgtaattacagtcttagcctttgaataatttatgctcattcagcaaacactcctcatctcaatctactgtcatcctttcgcctatcataggatgaagctgacataagccttacctccctcctgcatgttacccctgggcatttaactgctcattggccatctctacctctgtgtcccacaactggcacaaaccaagcaccttagaaactaagcttgtccattcatcttcagactcctggtccccagtacctattcttatcattcaggcttgaaaacaaatttcattttgtactcagcccaatccaatgtcaagccataaaaacaccatgtgaacagcacacctgcctcctgttttcaaggtgcctccagtgcagcttgggaattcacagtctttcatatcagtcccagtagcagcgtccccactggtcaccctggtgttcacactggtcaccccagcatccacagtggtcaccttgtgctgttgtggtctcagaggccaaaatggatgccccattatcaactaagacagaaaggtgaaggaaacagagttacctacaggttgaaggttcagggcctgtcggggcaaatcctctaagttcctatggccaaactccctaccaataggagctacagctctgagtcacaacccagaccactgcaactctgactggccagaggaccagccttgaaaacactctttcctgataagcagctgtagatcttgagcccatttcggcagctcatagaggctgcatacagactgtctttgtgtcccatagctgaccttttgatgtaaagagccaaatgccattttcttttcatggtaaaaaccccaccccaaagtgaacatgggatgtatggtacatgtatgtttacctattgcacatgtgctcagctccccttataaatatgtatagctttccccccaaacctgctgatatgtatgactctgttgtgtgatacagacctggtgaggcataaaagccaacctgtccttctttctgaagagagagcaccttcagtccatgctggagactcttcccagcttgcaaaccgataacccccataaagctctcctttctactgtccagccatcctggtggtcttttagacaacaccatcttctatccattccatgtgtcagtgctgcattaatttttataaacattggctcctgacacaccactcatctgttcagaatccttcagtgattcctgtcgaatccagaacaaagcccaaacctcaagatccctctattctgtgccttcacagtgtggctctagtctacggcaagcttatttcccagcattctcttacaagtgtttgaagtgccaggcagacaaagtatttgccatttgccacacacgcccagcactgcattccttgtgcttttggtgctgtctggcccatgcacagtggagctctccaggaaaacccctgccagtttggaatgctctaggtctacacagtcgcctgcagagcctctagtcgcaggggtctactgagtattttcagtgtggttattgtgactgagagattgacttctgaggtttatttcatttgtattaatttaaattgaaatgtccacatgtgactaatggcttttgtctgggacattgcagggacagcacctccttgccttcctccttatgcctgcttaaccagggcccttcatttaatactaattgaaaattccaccctttctaagaaggaaacccgacctgattattcaactggctattttatctccctcatcagcatcctctctgtatgtcacttgccatattctgtcctttagtataagttttagcccttcctcatttatagtaagtcagtcagagaatcagaaggccttggctcttcccatgcccattgcaacatctctgagccccagattcgtcatctgttaagcatagggaatgatgcactaatacccttctgtgtcacgggattactgtaaggattacagaataaattgagcatctgttgtgcctgtttccacttctgcaaactcaccttctcagccattcctgtgcacaaccaccaggctgtgggtccttccaggtaggcccagtagaagcaattggtcaagaacctttccctaaatctggccacagggacggcctctctgttgtcagagatggtggagtttgcaccttgccttgaattccttcaattctgtaggtcatgaattatctgtttctgctggaaatagcagcaattcctaaactagaattgctgtaactttaacacaaaactagaagtcaaagaggagattggcagtgtggcctgtgatgattcccatccagacactgccaggcttcacgccactacccccagcacatcagccaagaaaggaggcactaacgaatactgagctatcagcagcaggagaaaggccttctacagactcctcaacaccagctcctccaggaaagatggttccctggctgccctggtgaacctggaggttttctctgcctgaaaacctcagttcccctctgtaaaaagttcaaccaaagagctcaatttgtcatgttcacaaattagcccaaagataggctttttaatcccttctcagcacaatttaacccaacatttagtgctgtacttactgtatctatgacactaataatccaaagatagttataattcacttgtcctcaaagaatatcacctgtggtcattgagaaccgtatatcaacaatgaactgtgatacatgttcagaatgtgatagtaccaacaaagggactcattctgcctgtggcaatctaggtcttctcggagcacgtggtaaagagctggaccttagtaggaggaaggattttattttgtctttattttagatttagggggcacatgggcaggtttgttaaatgggtatatttagtggtgctgaggttagggcttctaatgatcccatcaaccaaacagtgaacatagtccccagtaggtagtttttaaaccctttccctccttcctctctcctcccttttatattccccagtgtttattcccatctttgtgccgtgtatacccaacgtttagctcccacttacaagtgagaacatagtatatttggttttgtttctgagttaattcacttaggataatggcctccagctgtacccatgttgtaccaaaggacatgatttcattctttttcttttcttttttttttttttggtttggttttttttgtttgtttgtttgtttgttttgttttttgagatggagtctcactctgtcacccaggctggagtgcagtggcacgatcttggctcactgcaacctccgcctcctgggttcaagcaattctctgcctcagcctcccaagtagctgggattacaggcacccaccactacgcctggctaactttttgtatttttaatagagatggggtttcaccatcttggccaggctggtcttgaactcctgaccttgtgatccacctgccttggcctcccaaagtgctgggattacaggtgtgagccaccccacccggcccgatttcgttttttatggctatgtagaaaatgtgtatataccacattttctttatccagcctaccattgatggacacctgggttgattccatgtctttgctgaggaagcattttaaatggcaggagtgagacagtaaccacttcagcagcataaggaagggaaagcacaggaaggggaggaaatggcaagatggagaaagagctagtggcctgcctgatgcagctgatgagggaagaactctgaggccgggaagctaactgcaggcttgttgatgaggatttgaaatgtgtttctaggaaggaaggagaggtagcaagtgggcagtgtgtgtgtttgtttgttcactttaatggaaggcattgaggtagtgaatcgtgttctaattggtattgaaaagcaatcttggtgaccattaagaaaaggctgagaaaggctatggaagagtatggagacacgtttaggaggttagagcaaggctctaggtgaaagatgatgtgggcttgagtttgggcagaggtgttgggagcttatgaggagtatacagtttgggtgttatggtgggtaggtggtgctgataaggaaggaggagaacttgagaatgaaccagggtttctaccactgtgacttgggttgctataaaggatattaaccaagaatgggtatctctttccagcccacccccacacccccaaataaaagtaggtgtaaggagaggcaatgtgtttcatcttggacatgctgagtttaagaagctgaatgagcaataatgtggtgctttccaggaagctcaagagagagatgtgagctgaagacacagaaacaaactatgaaatattagcgtccccctttattcacaagcatctactgtgtgttaggctttggctgcactgaggatatcaagatgaaaagacatggcacaaactatgggacaaaaaggcaaacaaaaaagagtataatgcggctgggcgcagtggctcacacctgtaatcccagcactttgggaggccgaggcaggtggactgcctgaggtcaggagtttgagtccagcctggccaacatggtgaaaccccatctctactaaaaccacaaaaaattagctgggcgtggtggcgggtgcctgtaatcccagctacttgggaggctgaggcaggagaatcgcttgaacccaggaggcggaggttgcagtgagcctagatcgcaccattgcactccagcctgggtgacagagtgagattccgtcttaaaaaaaaaaaaagtataatgcaaagtgataaccactgcaacagaacagagttcttgggagaaagtggaaagagaaaagaggaggactcacaacagaacactggagaatatctgtttctgggggcagtcgggaggaacagctgggatggagtctggaaaaggaaagcaagaggaatagggcgagaacaaagagacccagatcatgagaacgaagagaagacagcatttcaacaggaaggggatagcgaccaggtcacgagctacagaaaggccaggtaaacaggaatcagagagcaaggtagagagaaagaatgtactgagtcaggcatcctgctaaatgtttcacaagccctattgctcttatcacagctaccctgagtacatttaaagattcctatttttaaactaagtaaggcttggtgtggttaaataatttggccaagggcatagagctagaattgaaactttggtctgtccagttccaaagcccatgctctctccccattccacagtgccccccgttagcactggagatgtctttggtacgtaccaagttcccatgggatgatagaaccaggaatccagcagcagtagaacagtggctaagtgtgcagcaaagatgcaaatgtagcttgttcttggagcagcgagtcacaggagagagatgaagcagcacctagaagggaacagggtctagacagtgattataatggttgggagtgtgtttttagtgatagagtagacataagagtaactgggagtctgaaaagaagatgtaattgccttctcaaactaaaggtacaagaaaaggggaaaagtgacagaggaaaatcacagacaagacagaaggggatgccttcagttcataagcatatgctgcattcacaccactcaatgtgcagtcacagaaagccagggatgctaagacaaattaagtgtgtccctgtacacagggagggggcatcaagcaaagggatgaaattccgtgataaaggtttcacagcatgctgtggaagttcatgaaagaggcacctcatctagctgtggagttgagtggaggttgaagggatttgtcaataaatgcatctcagaacaaggggtgcctggtgctgagtacaggaggtgggagagcaaatgaaaattaattggcaaaggagggagggaaggtgttccaggcagaggcaaccacaggaccctggagggaagctgcagggattcagtatgaaccaggggagatagggaatggggattctagggagaactgaggccttgtcatggatataccacgtcaggaattgggcttcagctcatgaatgacagagagccccaaaggatttgggtgtggaagtgacaaggggaaagggccacactggagatactgcagagacagagtggatcatccaaaggcagaacaatcagcatctgacttaacaaggaaaaggttactggcaaccttttgcctcagtgttttcagactgatggcctatctgagttctttgattacatgcaacagaaatcaactctggctaatttcaggaaaagggaaaagaatattataagctcaaaatgttgatgtgaagagtaaggcttacaaaagataggaaagaaggtaacagctccagagggctagtgagccaaatgggtctcacagccagacagtctagtcaaggcgctgatgctaagacagtgagctctctggtctctttgtcactgtgctcaggattctaataacaaggatagaacctccgactcccaaaggttggttcatgtgctcatccctcgctgtccagggcctctaattgacaagccacccaatagggaagaagtaattccccaaaaggaagtcaaggatccattaggaaggatgaatggatgaaatggatgttgacagaccaaatgatgcattcagtacaaacggcaagcactgaagccagcctgcagcgttgaggcaggagtagcaaatgaggatgcatagactgagtgtggacttgacagaagcttagctctgcagggaaaagagaggagtgcagctgtaaacagaggagcatttctgatcaaaggatatttataaggtgaaagacccttgacagtagttatgtgttaaggaaaagaatcagaagagagggagagactggacatcttgggaagtggacggagtctttgccagggagccaggagggaagggaccctgagtgcaggtcctccattcaaccttacaagagatgacatcttttcctctgagcctgcagagcagagacaggcgtggacacacttaaataaattgaaccaaacagaaacacactcaggatggcaccctctcctggtaacagtggttttcccagtgtagtaaggaacaaggccatgggctgagaagctggacgaaaagggaagtagctattttagggatgcatcaaggacataggtaaaggtgttcgcctggaatgggagtgacctcttctctggggagaaggtaaggatgggcagatataagtgagactccagttggcggctacaggatgcaggtaggtggaatcccaggacagccaatagcccaaatcctccaggtactagtggcaggggaatgtgactccaaggagaatagggtgttgtgagcgtttctaggtgaactgaaaaccaacccattcttaccccacaccttactttttgcaaccttggaatgaagggaattatccatatgaactctaaaattccatgtttatatgagagatattttcctgtttgctgtttacattttggtgacgggatccatttgaataacaaaagcatctgcactccagatccagtttaatccacatgcttccagagtccttgatgcttcctgtacactctgaataccaccaacagcagaaaacgattgagtgtggattgttaaaggggaaagattcaggacaaaaacatgaggactgtcactcccttgggagagagccctccgctcccatgtcctctgcactgttttcacatgaattgtgtagaggatctggaatggaatgttgccatgtgatcaggtaccagtgagacaaattctgtcagtgatccttctgtattttaatttatgcagaccataaaagatattcagtctgttctctaatttatagaccttcttttgaaaataatctaatctgactacagtaaactaagatttttgaagaaatatatccttttcagaagttctcaaaattacttaaagctatccccccaatttgtcaactgccacaatcagtcgcacccggtgagcacatttccgtgtctttacctagtgatcagcagggccgcagcgggttcctgcctgcagtagggagggggtccttggagagaatgtggtttctttggaggactctcacgatcgtttaatgaagatatctatgcatgccccgttgtgttctgtataattgcaagtgtgactgttacctctggaagatctccttaggcaacgaaatggctattttactcaaagtgtttaatcaatagagaatcatcgtttcacatccgtcaattcaatttggacagcaaatccatttaattaaaggtaaactgtggtttaaaggagatgcaaaaacatatacaattataaaacaacttcatttaaccaggaaacacttaattgactacaaactgggtaatgattttgaaaaatatgagactaaaagaaacacatactcgcagactaaagcaaggagaaaaccatataacttttttctccaatcttattgaaggcttattcagtattttaaatactaagttctgcattttataacttagagtaatgaggtttcttatataaaacttcatatcatatgccaaccccaacctctgtaaactttattctgatagtattcctgcaaatacatacatacacaacatatttacacatgcacatttttgtttaaggctagctattcccccccccacacacacacacatttgcctgcgtgagtaaccagactagatctcttttacaattttcacattccccatatctgatcagaggttcttcccaaatgtatgcacatgacacgcacacacacacacacacacacacacatgcatacacttggacatgcacacacacacatccctatctccatttcagaaatgttctttgctttgttgggagcaggaagccactgtttgttctgagtgcagaccatggtctctcttgttctgaattctggtgagttgtcaccatgaatgaatgaatttcctgtggggaagacaggatcatcttcctatctgtttctcacgcctcctgtgtctctgctgttgccagtgttagaaaccttaaccccttggagtctgttcatctctcttgctggttctgctccctggtatgcgtgcagctagtgactgtgcaggcatcaggtgacctctccgcctactttaggcaaaagccagagaataaaagagaggatccttcaagacatgtacaacccaattatagaggtattacataaggttgtacacgagaaggaacaaaacaccttcagctgccatgttgccttccctgccagaccataggcttctgtgagcagaaccccgaaaggctggacacagagaaagtatgagtgactgtttcaggagaggtggaagaataattacaaaggaacatgtaagctgctgcaaaataactgagtgcatacgaagggaatttctgtgtactgccctccttctgttgatttcttctacattggaagaagagacttgaatctgaagccatacaaatatgtataatatattcactaaggatgtgagtgaaggtcactacacctgtttgaaatgacagaaatgtgtctacatttagcctacccaattaatccttttgtattaaatacttggtaattcagcctaatccattatgtccctttaaaaagacaaaaaaagcaaaagtcgttttcactcaaatatcgatgaaatacaaatcaggcttcagagacaattctttatgtgctataagtcatctgacacttttgtgtcagccatctctcatgctgccacagtggcaggatattacaggatcaaagcaaatttgcaggtctgaataacaagtgctgctctgagcacgctctcctggctcctccaggtaactgcgagctgggtgcagatcagctctttcacattgtctagctgagcctatggagacacctgtgcctgggcacctgcctccatggtcacccctgcggagccctgtcgctagccttcaatggacactcttgctgctttgccataattggctgaccctggaaaatcctcacttacatctgtgcctggacttcttgtctctttgccattttactggcctgggcttggggcctctgttgtgtcactctgtcacctctaactttgtctgccacagtctttggggtacatacaggtggtcacctgcctttgtatctaaaaagtgcttcagagggcagggagcctgcatgtgtagcagatggacaagtgcacctgggaccgatgcatcacagcctgagcggttttacagtgtggttccagcacattcctacctgctcgggtgtgcacagctggagtttcccggcaccatcattggacgcaatatgggacagtctcagagctgcaatagtctgccttccttgttctgctcacgagcccttgaaagtcagtttttctcccgttttgcgcacagcaggtatatcctattcttgaacaatttgctgaaaagcagtaaatgaggtcctttcttgaaggcaggattcttttctcctttctctactttccaaatctactccctgagcccttcctctgccttagaaggcttagggttgtctggccacataaatacatgagtaaccactggggcctctcccaggaggataggaccaaagaaacagaaaaatccagtaactggttttagatagagcctttacacaactgcgttcagactaacaaagtggcaaagacatcagtatctctactttagtttcatgaactaaggaaataaataaggagaaatgtaattcagtaggctacagacaaccagaattcactgcctcagaattttttcactgaaagtgcctgccacatgtctaagaccagagaaagacagcaacttatgcataagctaccactccctgtctgtaggaccaggtttctagcagtgagaaggtggaacgggtctggacacacctctgccgtgaaatctatgcaaaaaaaacccttcatacccgacaagaagatagtgtgtcagttgcttccctatgcctgaattacaggtttgtagagctcaggacaaggaacgtgcatttgggtaacattatttgaaaattgtgggggtgctgctgagttccaaaagtggactggtcaccttggccaatactagctgaggaagcagaggtgagttagccccctggtattgcactggattacttgctaggactttgtataaagaagcacagtctgaaacagacgcactgcaggagaccagggatgaacagtggggaacactgcctgcagaaggggatgtgaaaagaagctgggagtagatgtttcaacacccgacactgtttggatttacatcttttagctttagagtgtctactgtaaaatagaagcagaactcttatcacttaaaattgtaagtaaacagatgtctttattctagagtaacatagcacatttgttatctcaccaaaaatagattcttttctgatgttgtagagtagagaatctgaaaccaacagtgtacgtgtaggagcttcaatccattcaactggtggcatcatatacttcacatccttaggactgcttatgtgatgtgcagtcaaggattgggcaggtcatatatcatgtcactccatccttcaatgccttttgatctgtttagcagctccttgtgacaacctaaggaagagggtgagggtggtgagactcagattgacccgtgtcttttgtaaattcttcttcctttcttccttccttcacccctagagccctttatttcctcaaagagatgaactgggacaggtacgcacttcagactgtctcagaggcatttagccctgattaatgcctctgaaattaaagcttgttatcttcctaatactgatacagaccataaagcattgtgtgttacaataaatggagcacccggagctctatactgagtgctgttcccttctcgatagcagaagtgctgggggatggtgaccaccactaacagttactggacatttcttatgggtaagtcaatgtggtgagtctttagctcatcagagtgattaagaaatagacatgattgttattctattctccagataataaacaaacttaaaagacattaataaattggtccaacttcatacagctagttaatgtgggacccaggatttgaactctggaacccatgctcctgactcctaaggcttccaaagaaccacattctagaatcacataatcagataactgtaggactcagaatacctttaacaatcatatggtcttgtatcctcttttgccagtaaggaaactgagtactagaatggttcagtgacttgcacaagatcacagagctagattggaacacagctaggattagccccaagccctcctgcctgcctgccaggcttctttctgttacagcacactgtgtcatcattaaatgttcatttttaagataggctacaaaaactttatccgaggttcttaaaaataaaatgttatccttctatctagaagaaaagaatatcgtgtgtgtgtttcaagaactttcccaggtcttgactaagtcagagaggtcacatcttggcaacttgggagacacaggagacccagtgcctgagctcaccagctctaggaaccctgatatgtgcctgttatcctgccaccccagtcctgaagctgctgccctcttctcaagcagtgtgaaggatccaagcaagccgctggtgatggggttgccagacacctagtcctgggtgatccccggccccaactgctcccagctctgccatatccgacctactcacacatcccttgtcgcaattagttcgcaccttgcacttagcagcccatcccagcagggcagctgcctcagctgcagagagccccatggtggtggcagtgattacatacacctacacaaaggaactaggtaccctttaaaaacactgctcctacagaaaacccattcctgtgtcttcctgctcctgttgaatacaaactttccttcccaatacaattccctttatttcaaagtgtagcatcaaagtgcagcaagaagggcctcagaagcagctgacggtcacaaaatagtgactgcttcctgctgctgtcggaggatcgcgccctcccagcccccacctgccagagcctcaagaccactccagctgccctctgccaactccccaagtctagaatatccctctcttccatatccacccatagaaacagcactccatatttctgtctcatttgtaaggtagtttcccttatgaagctttgcatacctttctttggaattagcatacttctgactgccaacagcagttttcatttttaaaattttaatgaacatttacttgtgctgagcatgttctaggtgctttacaaggaaaagaattgagttaatattcataacaactctcttagcccattttacagatgggaaaatggagccaaagtcacacagctaataaatgggacctggctttgaacccagacagtgcggctccagggaatgtgctcttgaccagtcagcttgccccttattctgccttgagttgagtttgttgtttacacatctgtctcttagtgactattagaactatgtctccttgctctctgcatccccagcaatgcccagtccgggctctgcttgtcatgcgctttcagggctgtctgaatgactggcaggacagcctggacaccacagcccggagctaagcacaggatttccctcattgcagccacagtgttggtcccttaggtctcctatctcttaatctctcccagctttacgttatgtgtttgtaaaataaggataatagtacttaccccacaaagttaatgggagcgggcgtataatcagatagcgttaggagttggaatcgttttcaccagcatgtgatctagtctttggcacataaggaaactgagggccagaacggttctgtgactggcacaaagtcgtagatctatactgtgaccctgacacatgtgaagactgacaatgacagaaaatacggatttcttttctcaacagatatatcatgtaccactctaagaaatgtcctctctgatgtacctggtggcatatatatgtattctaataatgtcattgctcaaaagatttctgaagttcttatttcagagtaatctgtagagtagtatgtgacactctctgtttattgcccttgctggtggcaaatctccctcccctggcaggaggacttacatttggggaatagctaaaagtcaagctgaacctcttgaataagatggggaacaagcagtggaaataacatgtctcctgaaagtctggttgtagtttgagtgatgctgctttctgattaagttttcatcaagatgaggtaagagagaaaagtaacaagacagatttctcgtgtggtttgtaggataacacttaaaattccacaaggggaccaggctgcatgtttctttacagctgatgaaaaccagcgttgtgggtacagatgcggccttgtgcttataagtattgtatgcccattaaataacaacattaacgaatagatgcaattggaaaacagacgctttgtgagggtactttaaggcaggaccgtaaaggcatgaaagagggatttacttatgatatgaagttatttcccaaactgaaactatccagacttccagaagctcttgatgtagtgccagttttgaaataatcttcaaggatgtttcccaaggaaggtcccccttccaaataaagccagtatgaaaggaagaatctaggaaagctatgataagccaggtacttaatcagcaactttatatatactttaaaaaatctcatctaatcttcacaccctccctaagaagttaataataggatctcatattatgcatgagaaaacaggctcggggtggaagtcatggaagtcacctgccgcatgagaagactgaggctcagggggtgtaagtcacttgctgcaacatcacaaggtagatggaaaaaaaatccatgtgcatcttactccatcacactgagaccagagcaatctgtgttctcaggatatttaaatgagtaatattttattcctgtgagacctctaaaccaaaaggtttggggatacaataaatctgttatcttggaaacaaagctggcagctgctcttggctgggctctatgtggtagctgtgcttcatggcagtgtttttgctctcactatccaatatccatccaccctcttctcagcgggcccaaacacaactattaatagaagtatggatactcggtttggatatctctttcaaaacaaagaagagtctcttaaaaactcttgagaaatcaaaacttgtaactgccttattctttttcatcccttcttcccctttaaagttgtatttattggatcacattatggtgcccccaacttaagagctaacaagtacatttcttagtccttcttcatcatgggtttcttagcaaaatgagtactcatgcgcatgcacataaacacaccttcagttctgcccagactccttcctgtggatggggagagttgctgacacaggaggcagagtagaaacgcagcagcttgtgctaatggaaaaaggaggatgatggtttcagagcatgcattctgctctcctgcccacccctccacccgtctccagttctgcccccaaaaaggcagctgaagtcatttcaaggcttcctactttgtttctgttccagaggccaagcctcctggtaagactgaggaaagcgtaaagcaccttgagttccatcctcccaaagggccctgtagctggagtcagagcctgcgtttcagcctctccttcaccaccatctaatttattgccttgagcaagccacttgcactccctaggcctgcctgttgcttcttccttccagagcacgaggaaatacaaggaatgaaaaggatcgagaccagcctggcccttgctaggtctcttctgggcaaatcacatgctcttccatccactaagtgaggccacagatgtcagaatgcagccatccagtgtgtccagttcaaagtagaaactgctcggtggatgggagttgcaatgatcttgaaaatgagtgtttggaaattgactgtctctgagattcctcgcagctatatttgatttgaatccccttccccaaaaccacctattgtgttgggagttaatcaaaccacactgataggcaaatggacatgccaatctctctctccctctctccctctctctcctcttgtcagataaggtttgagggagagaggaatcagcaggggttccccctagctgtccctccaccatcataagccatgcacaattgtcagtactcacctctgccctcctccttctccgggacaccctgcctcctctctccaggcctccatgggctccttggcctctgaattcctgtagacatctagagtccagatcacaaaacaatcacttaatagtcggaattttcatttgttcaatttccatttttggataaactgggcacatggctaaatgttttcatcacattgtatcaattaatccagtggttcccaaatgtatctacacttcagaatggcctggggagaggggggcttcaataaactactgatacctctgtcccaccccagaaattatgatttaattagagtatggcctgggctgtagaatttgttaagacctccctccccccagctaagtgattctaatgtgcaggcaaatttgggaactgctgacttcttagaactctctgccataggacttataatcatgtcctatttacagatgaagctcctgcagttgagcaaactccagtgagcccctcaagctcacgtccacactgcgtgagagccagcactccagcctggcaagactgcagctgtgctgtctcaatccttgctacccacagtgtggtccagagaccacagcatcacctgggagcttgttcaaagcgcacattttcaggccccacaaagtcagacctaccgaatttattcagaatccctccaagggagtctcatgcctgcttcactttgataacggctgctgtagtcatgtcaaatgccctgaaggttacagtcatgtgctggcagcctcgggagccacagctctggcccctagccatcctctgactttaatttacctgagtattatctgggctgctggtttaaaatgacccacctcaaagatcttttttcaggaagttagaaatcctggagttatagcgtttctgtgctgtttcgtgtttgtgagttttaaagccaataaggatcacccctttggagcagggaccacacatctattcctgccgccctctggcagtaatgagcaggtggcagggctcgggactgttagcctgattgatggcctggtggaaccaccaccagggcactaaggtaattagacgatctgtttctggaccttgctttctgggctggaggctgccgccttacgtgattaggatgcgtgggaggcgccgcctctcctagaagctgtgcaggtagcgctgggctgcaggaggcagccaagccaggcgcacgatcagagcagggacgcctcccgttccttggttcctgggctccaacgggcacctccaaaccaatagttccagcatctctgtatgcagaccttagaggacaggaagcgactgcgagccccacactctccagacacggaaactctaaatgcagagagaacgaagcatattttgtcttccttttcctttttttttttaagcaaaataataacttgacacaagtccaagtagttaaaaagatactaaaagaaacccaatttagaagggcttttagtaggctgaaaacagatgtggcaaaccatttcgggatattctgggagatgagatggggaggaccggattcgaaatgcctgggccgcctgttctgggcccgccccgccaggtgcctgtgctcgggaggggccttgcccagcacgcattctagaaggaagcggccccgcgcctcctccctcgcaattaccgccgggtcggaggcatccgggcggtgcgaagtcagcaccgtgccgagcagttgagagcagacggtgttttcttttcattgttccctcgcttcgctgggagagcggcggcacctgttccgcggaagcgcggccaaagttggaagccctggcggctgctgcctgcagccgacgcgcgggggcgcccggcttcatccggccgcgggggaccaggagcctgagagcctggaactgggtgcggggggacagccagcccgagagggcccagggtcggatttcggatggaaccagagctcgctccagggagttgaaggagttgggagcgcatctcccaataatcccaaagaaaccgagctttcagtgcatgcaaggggcatttgatttccctcatttctgagcactgaagcactccactgtcatatttttgaaattcgagaacaaggaggttaaagagtctaaatggaagactaggtgaccatccaaaatatcatacatcaattgcatcttgtaattagtaaaatcatttttattacttaaggtaaatcttgataaggtgtttttattaggtaagataaacctggtataacatacgttgcgggtgtgtgtgttttgttcagttgtcattttcagagaaataaatgaatttttaaagtgtatatttattcatcaataattatttttaaagtgtgcctgtataccatatatgtagttttatatctatcccactaccttctgcttgcataactgaagtcacaaaaaggtaaaaactaatcccccaatatacagaagaatctagtatgtcccataaaagcatctttgctaactggcatcgtgaaagtatggtgctggacactcttgaaatgaaatcattgttactgtcaaattagacatctccacaaatatacatgatctgctcaaactgactttacatctgggaaaggagaaattgtaggtctctcttactctgggatatttttgatagagcaaaggtatccatgatgtaaatttctgagatattatagataagccctttataaagtcacaaataatattcccataatgaggggggaaaagattccaaagaaggctgagcacttactgagggcagggaccatcattgtctcctgctttacagtatctgcaactcctagcatatctggtttacgtcttgccaactaaaggtaatgaggcttccctggaagggcactgaatccatggccagaaagtttcacaaggaggcagctgaaataaccagccacatagctcatgggggaacatcagtgcacctcagggggttggcattctgggagaggtcctctcagctcagatttcttttgtaaactttcccagtctgggactttccttcctacactgatcctatgactctgcataaaattcagttttatatgtatacattgcatatttagtgcacacaggacacagcgatcaggtgttgcagggtttgcagaaataagcaaaacaacaccctttatgtgctggccaggaataagtttacagtcaaacagtgcaagaagggcatcataccagggtcagaacaagcatgtttcatcagggcagcaaaaagagctcacatctatggaggagtctttgaaggagtgcagcgtgtgagatgtactttaaagaatgcaaaaaatcttcaactgggaagaaatggatgggaggagaatattctgaacagaaggaatggtgcgagtaggagtttggatcatggggtatgtttggggaacagggcaaacacttgtccttgaacataaaatatatgtgcatagaaaagagagctataaaagataaggctggaaatgctggttggggccatatttaaaaactcgttcttacctgcctggccaaataatttgtatttagtttcagaaagtagttagaaataggagattcttgagcagaacaagtaaatagcactgggattacacattgagagagtttttgtggtattgggacacatagaatgcccatgcaggaagacagtagagcctgaatttaggattgtggcagagggattaagaagttggaaaatacactttgagagctgcttcaaagacactcctagccttggcaaatggttgggtttgcgagaaggaatgggttggttaagggaatcatagcagtcacataggaagtcaggaagagcgcagtgactgtggggcaaagaattctcttttagacttatggtctttgaggtgctggcaggacctccaagggaagatgctcacagaagaagttagaaatcaaattcagaaggttgggcacagcggcccatgcctgtaacctcaacacttttcgaggccaaggcaggaggatcgcttgaggccaggagttcaagacctggcagcatagcaagaccccattgctataaaaaataaaagattagctgggcatggtgacatgtgcttgtagtcctagttacttgggaggctgaggagggaagatcgcttgagcccaaggattcaagattatagtgggctgcgatcacgccactgcactccagcctagatggcagagcaagaccctgtctctaaaaaagaaaacaaaacaaaaacaaataaaaaacattaaattcagcacatggagaaacagggctagagttacagaatagaaattcatccatggaggggcagggacaggaatagatgaaaatgccaggaatcctggggaggcagaagaggccaaggacagagctttgaggtggtcacgtgttcctgcccagcctctggtcctgctctcctctcgttgatgtctagaaaaacattcttaccaaaaaaaaaaaaaaaaatacaatttgctaggagaatttcaaaaatatgacagtggagtgcttcagtgctcagaaatgagggaaatcaaatgccccttgcatgcaaaattcttccacctgagattagttagaggcttcagacaatatggaaagacaatttcagattttaggaagttttgtttattgaatttatttatactaaaatgaatctgtagttctaatttgggaaaatgacttagctacttccttcagaaaaaatataattctaatctttagtgttcaatctgattttctgcccactcctcctaaaaagttttcaatcactttctgaaactagaaataattcaaaagaagagctaaaatattgcaaacttccttcacagtttatttttgcaggccgttctctgagtagagatgcacaggaaatgaatggttacagtaactgggatgtttgtggtaaaaatacaattttttaaacttagaccatttttccaggttttacgtctcccataactcaaatattgttttcttctgagaagaataaaaacacaggtgatctacaaaaaatagaccttcctcttgagtatacaattaacttttgtgtgcaaattttgtcctataaatcatagtgtgacccatcatgggaggaactccaaaaaaaccaaactgtaaacccataatttcttttatgttttctaaaggtcaaatgctgcaaatactggccagatgacacagagatatataaagacattaaagttaccctaatagaaacagaactactggcagaatatgtgataagaacatttgctgttgaaaaggtaagttttcatactgcttttaaaagctatggtcagacactagtggtaccatactagcctcattaacttacctaggatactttacacatgctcatatctcaatgcaggtaggctctatctgatggtttctcaagattgcatcttgctctctgattctataacagctcagttccatctttaaaacaaatcattctcatttcataagaatctatattttgcaagtaaaccaaaagttaatgtctatttgtttattttctttccctggttgatattgttctgcccgtctctctttctttgttcacagaacaaagtttgctaaattttgataaatgtccttccagtttggtaaatttccttcatggtgtatgtcgatatgcattttccagtagggagttagtatcagtgttgagacacaggtcctaactcctcctggaatctctcacttccttgtggctttcgaaacctctggtttaatgtggactgatggattttccaggtggaagtgacctacctggaaacctaagtgactgatctccatcagacatgggacactcttgcatgaaccagcgcattcattcatgctcactcccatactggttttccccttttgtagttgctggtgttgggtcggtgaatgttctgctttggttctgccctgcctcatcccatgtgcatggatggggcttcttctctgggatgcactgtagggcataacagggaatttccttattccccctctttctgctgacatagggaggggccggaggtgaagcaaactgcagtccatccagagaagtgtcacaggtaggctctggggaaagtggaggtgatgtggctgaggaacactctgccttccaaagatccacagacttttctatccagagttgattctccataaccgagccctgcacagctgccctggacttagggatcttggtgtgaatttgttagcttctactcatgtaatagtagcaggtcttcttggaagacctgggttataggcagattgctagggaattggattttggccttcctctccactctatattcttttttttttttttttttttttttttaagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtattttttttagtagagacggggtttcaccttgttagccaggatggtctcgatctcctgacctcatgatccacccgcctcggcctcccaaagtgctgggattacaggcgtgagccaccgcgcccggcctccactctatattctcactgcatctaaatgcgctttttagatgaacaagaccagttttaggaaatcaaggaaattgcaacatctgcttattggctaatttagtctgatgttttgaactacctttcctggtttgcagatccaaatttgtcatagaatcacaaagctggaaagactttattttaatctgtttctcatactatttagcattttttttcttagcctgtcttttttaataagcaggcagaaagcttggagacttcaaagaatgaggagttctggttgactcagttcttcaagttctgaacctcacactttgatgtcaattttttccttcttaggcagaattggaaaaaaaaaaaaacacatggaggatttttgtatggctgttggcaagagcactcatgaataaccgcattaaaacagcgataaaagaccctcaatatttttttctttaaaaaaaaatccaaaagccatcatttaaacatggagtttttttgaacaatagtcagctctctaataagctgaaaatgcacctctgtagctaaaggaagggtttgtttgtttctttcctctttttttttaacctcttattgtactcccctgaattcccagctgcacagaaatgtgtctgaaatatccagtcattttagtcactagacaaccagtgaagaggtggtggagggaagagaaggaataaggagcttgttaatgcatttggggaaatcaaaatgacacattagtgattttctaaccgggcaattggaatctttaaggaaaacaaatcattagtacttttgtagagcatttcttataggttttaaactttctcattagaaaggaaagaagagaacaggtaagcatgtactttgagatgcctgcaattctgattctattttgagagcatgttgcatcgagggacctaaaggtgaaagtggattagggctctgctctgcaaaacaagcagatgcaatgcactttggaactcatgaattcctgctttgcatctgattgttgtcttttatttcccacatagctgatgattccaagctaaacagattttaaataatacacagtacccagagtgtcagaaggaagacacccctgaagtctccatgcatttaggctgtctggtgaatctatccctgactattctgggagaaacaaagttgacaatggtcactgaattctcgctacccaggagctgcctaggattcagaaagggcatgagaagatgatcctcctgtctccaagacagaacatgtattatacaagacagaacatgactattcatttcacaagtatttcttaagcacccacttcaggccagggactattgtatgacttggatcaaaattaagtgactaactgggtgtggtggctcatgcctgttaatctcagcactttgggagactgaggctaaaggatcgcctgagcccgagagttcaagactgcagtgacccatgattgcgccattgcactgcagcctgggcaacagaatgagaccctgtctcggaaaaaaaaaaaaaaaattaagtgactctcacatttttgtatataacattaatgcttgttatgatgaaaaaccaggaagtaatagtatcaaattgggaggtatttgggctgtgataactgatgacatctatgatgttcttccccaaatgtattacattccaaaacagaaaaaaggagacactgctatgtcaatgaacaagaatgaaaactggatcagaagccgtttcctttgccactcttgtcaatagcaaacatattcaagggtggaggtttaattttgagaaatgttttctactttccagaaactgatatttaccttgctcagaaaaagagtcttagatcagttaagagctgtagttcagcacttgaggttgctggaactgaaatctaacaaagctagagagagaagcacaccccatgctcccactccccaaaaaccccacaccccaaaaacccaccaggacatggagaaagatatgccccttttttcccctttggaataaagtatttaccgtcaataagctttcccagttcatatatgggaatgcataccaccaaaatgggatcactcctatgtgggtcatcatgcagaaagctgggggagctttctaggggttttgagggtgacacagcctcagctgtatgttttctaagggagaccatggcactggcaaacattcccttggttttagggataaggaatttgggctcctaaccacctaatcatactactctgggatcacagagcctatttagcagacaacaatattgatttgcatttgtgaatccccgactgcttaattccttatagcttaaactctagtaaagaatggcattttcacagagaagtaaagcttcagcatttgtgggttattaaatgaagacatgttaacacatgggtgccaaggaagtcttatctcgaaatctgcagttgtttgcttttctggtctttcaaagcacataaaaattctgaatttcttctttgctcactaagtatgtgtgaacaatgattgatggtgaaagtgatgaggttaatgagtgtttacttttaagatacaataaaaccaaatgcagaaatggttcagaaaatgatcatggaatgagagaaggaagaaagtctaatttgatcctagatgtacatccagcgttgattccggttttgttttcaaaacagtcttttgctttaaaacacagtcttaatatataggcttatacttagaaaacaaaattgacaggtataaattaccttaattattctcaaaacaaaagtaaattaaaaccaagagcaaaccgtaaagtctctttctttctgccttcactacagttgagtggcaggcagctccccttcgatttactgacctagcctagaattccagcaaaaatatctttcgattcccatagtatgtattggcttacatgcctgtttgccacaagcagactgtgacagccactcaaaaacatatttctgtagccctagcacctcccataatgcctggggcagtgtagtcactcagattgctagcaattggatgaatgggtaaaatatttacccacattaaaaagagaaacctaacaaacagagctgtaaatgcaaatgagctctctgacctgtctagttggaaaggtgtcctcattcattcctactgcaagcatcatctgagcatgctcagtgagtgtgcaccactccagtccctgctgtgagaggtaccaggatgccggaaagccccaacacggagttggtattgagcacacagacatcctttaatttcttcaggcccctcttctgtgcctctttctctacagactctcacctcaccagccaccttgtgatctaagtgagacaaacctttaacatagtctactttttagaaaggaatttcaaacaacccaaccaattcatccatttgctggaattacacctaaaaattagcattttccccaaacatcatccccctttcatacccagacatcttcctaagggtacaatgccttccacattgtgtgtgagatctaaggatggcctctttccccagcagtccactgtttcctggccctagacttgctacctggggactgtttccactcccccagctatccctgcttatttgtggtttgttttcccttgttctcttccttgttctggctaaccaactactgcagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcaggtaagcagagctccagagcctcttgaaggaaacgcagtgggtgatgggtgcagggccacctttggggatgatgagtatgttttagaacttcagaggggtgatgattgcacaacattttgggagcactaaatgccactggagtgtaccttttaagaggtttaattttatattatgtaaatttcacctcgataaaaaatttaaaaagcagcagcagcagtgtggtccttcttcctccactgacagaccccccttttcattcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggtactcccgctcatcacctagcctggggccttggtccctgggctccctcctgcatctccccatttcagggccaagggcacaaggaatccaggcaattatctgttcaagtgatctacctggcattccctgttccttccctccctccctcccttccccctttttgtttttcctctcataaacaaaccaaacaaacccaggagttttccaggtaacagaatcaagagcccaaatttgcacacttttctgtattaagggacccaaaaaagtctctgttaagtgctcagactttcaataccatttccttttattatctcttttaaactagctggtaaccagagcaagaccgctcctgagaatagtggctgaagggttatctctgtgcactttgttcttctcccagggtcctgggaagaacagaagcctcctgaccctaaaaattctgcccagtgtctggcgtcctggggatttgcccattttgtgaagtactgtatactaactagtaactctgtaagtggaaattcaaggtatatcgggaatttccattttttcagaagcaatgttacatcctgctcttaggacattcgtatttttactcatatttgattgttttaagtaggcgtcacaccgaccacctggaaaatgattcatgaagtgaagtgaagaagaagtaagaatcccttacatttagatggtgcatttaagtttatgaaagcctctgggaaacctaatcccatttttttagctaacataaaaataacagaaactttaaatgctgctttcatgggttcttttccttagaaaggggatactgtgtttgaaagataataatcgtaataatttatcttttaatgtactttatagtcaatcaaatgttgccactcgcatttctcacttggatcttccattttcaggtgttgtttactggtagtgtgctgtttttgggaatcaatctgttggacaagaggttgttgaaaaaaaataattaaaggtcatatttatgtatagaaaaaaccgaattaactgtaataagaggctttttaaacttcccatataactaaagattaataataaatatgataagactctaccaatgaattttaagaaaagtcagtgccaaatcagaattagaggccccatatttacactgtgaactcattgaagatatatatgagaacagctctctgtacttctaagaggtttcataatcatattaacttttatgttctgaaataagaacttctaagtacttttatgttttgaattaagaacttccagacttcttgtcttcacagtaatgccaagtttttctggaccttctttgcactattattttgaccagcaaatcctaccatagacaaaattctgctcattcctcatgtgaaatactgagttccaagtgagtaggatcagaatgacagaggtcttcagccacagttttcatggtgctgcagtgcgtgtggtggtttgtattgggtccgattggttttaatcaatctgtgtaatatttggcattgcaccccagtctcctagcacttgagcccttggaccgtgtttctctctggaggaactgtctccactctcttgatgatgtggggctaaaattgataccgtctttcctccttctctggttctctaaagttagtaactcgttccatctccttctccaggagcagtatgtgtttatccacgatgcgatcctggaagcctgtctttgtggggacacctctgtgcctgcttcccaagttaggtctctgtattatgacatgaacaaactggatccacagacaaactcaagccagattaaagaggaattccgggtaagtgatgcctaagggaggggcactgcacggtgacttgctcctcaagaaggatttcaaggtcagcacctgagtgagcccttgaatcacaaggttccttggcctccatagcactgttcgtattcagggctgggtaacccagagctctacccaggagacgtctatggtatcaccaccacacaaaaatgtgtgtagacattgccaggtgtccccctgggggacagaaatacctggttgagaaccactggtctaacaaccatttccactccttccctctgaaggcagacatggactagtccccaacaccatggctccttgtccacagcataaccatggcacagttacaccatggaagtgtgtgttcagactttccaaccaagagctctccattgtattcctcacatatgcattttgtccagatgtacccgagtcaaggccagactcttcccccacctctgacctcccaaatccccaggtgcctcactccactgggacttgagggctcttaattctagggacccacagtggcccttacgcctctgcctctggcccctgtgtctgatgggcactgtcagtggacgaaatccaaggagcaaaagaaagaaaactcgaactatggtgggttggggagggagggggaagggaccgtcttgcagtcagccacaggaagtttgcatctttcgaaaactgcacgtgagaggagtccgctgccaaggcttcttgtcctcatgttcctttcttttctcacgcagacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagcaactacatcaatgctgccctcatggacgtgagtgccccgcttcccgcacgggtccgaggctggggtgtttggggagactgcagaacaggcttgggtcttccccattctgctcaccagcccttttgttttttaagacacaaacttttttttccaacaaaaaatagatttcagattccacgtatgtttttgtgtcggggctgatatccttcgtttctcaaagaccaccaggccaggagtatccgtaaatgcagcatggcacagttgccctctgagagctgagacttttaacctgctggctggggaacaggggacaccatggcaggaaaatgggttaatagatttgcagcattattttagttcattttcctgtaatttagcctgcagttaacataggggaaagttcaactcattacttcctgccagtctgttttcttattgctattccgttgatgcaaagagtgaatgggtatgttctgtgctaacacggaaattttaattctgttggtgtcatatcataaaaggtacctgaacttttttgaagctcttcagagctgtaaaaaaaaagtacatgtattctttacggcagaaataagaacactgtcacacatacaaattgctagcaaacaagttttagaaaaagcagaacttttaattatgtgtaattttaaaagtaaagttaaattttctccatcaagataattatgtatagattcgatattgcctctctaccagaaatattttaaaaattgataagagatactaattaagttttcttggtatcaaagtaagacttttatcactattattctgcagagaagtttatatttagtctatgttggtgctgacaatggtgacagaattcaacagctgttaaacatgttcagtgttttgtgccacaagcttccttctgcatgaaataacctagcttcttctcttcccattttcctgagtatatttggagcattcttgtttgtgtttgcagagctataaacagccttcagcttttatagtcacccagcatcctttgccaaacacagtgaaagacttttggagactggtcctggattatcactgcacatccgtagttatgctaaatgatgtggatcctgcccaggtgagacccggacttcttacagtcagaactagtgccagggggtcaagtttgtttttacactgagtttgtttgcacccgagaagtgcaggccctagtgccagatctcaagtgccagttgaagttgagaactggggatgctgaacacaacggttaaaaatcaggcggaattaggggttagaaagtcagttgaaaccagaaatacaggctgaaatcatagatggttgaggtgacagggcaagacacggccagaagttgagctgttcctaaaagatggaaatactcactggaggttgacaaggtcgcagaccgagttggagctcagcaggaacctgaacatcgcagagccaaagcagaatgagcaaaccagaggacagtggagaagggaagatagcgtttgacccagcccagatcccattcctggagtgactgtgtgcttcctggcacagctcaccgggagcctacaggtagagatcgtcatgcagggcaggtagagattgtcatgcagggtgacagtgtcggggtgacagcagagacaggcaagcaattttaaggcacagcaattagttttctcaatgctttagtaaagatattaaaaagaaataatactgggacttggagataagagaagtttggaatgataaatggggcttttgcatagttactcttaaacattaaagagaaagaattggacagtgatgactcaatgttagtaatggagttagacacattttcttgaagcaggttgtcaggcaagcattagcacagtggtcctttaggagatgaatttattgctttgggatgtgcctataccaatcatagacaaccaccatgacagtaggcattatgggaagtttgaccttagcgtgttttaagaaaaaacttgttctggaaatgaattaatttcctgtccagtagacacaaattctttttcttaaaaaaaaaaaaaaaaaaagtctgaagcatttcggcatcccaactggacatgatggcaagatttttccttcctacaatctgttttcttgccatcatccagccataaatggcatggacattcaattcagttctataaggtttttaattatgtctgaggcactgcattatattgtcaaagctcttgcctgaaagctggttaatgaaatagtaatgataatctttgttcttatccagtccttttggcttaagaagcttaaatattttaaaactcttccccactgatgctctgagaaggttagcttacagtcatttataaagacaagcagacaccacggcttgtgaagcttcaaagacccaactcaaaatagaaccaagggtcctgattttctcacttacagtggcacggccgaaatttcactaattctagagtcttaagttgcagacacttatagaataagggacttcttccttatttagaatcatgatggtttttttcttaatgtgaatcctgaaatgtggagatatttttgttcatattagtgaacaagacatcagtgattctagtgcattctttttgaaaaactgcattggaattctaaagccgcattctaaacccgaactatctggactcaaaccaagccttggctggctcatgggtaggagagacaaaaagactccagttctattcagcagacagagctgattttcagagtgagagaaaagaggctcctgggattcagtcttttagcgaacactaaactgagcatttgaatgtaaaggctttgcaattctacaagaatagcactcaactattttaagtatttataggtccggttcacggacgtgttatgcaccatttaagccattttctacatggtttacttgggcagagcatagaatgcaatgtgccaagaggcaagtgcaacccacgtcactcatatttctttggtgtaagtggcaagcttttggtcaggagcttgaactgagaaagcaagcagaaagcagagtaagctcaggcagtagaaaaatgggcagaacggttcagatgtacatgttacagcttttattaacatctcggcttcccatcataatgcctattaatttcaacagtgggtacactttgggcatcaaaaagaacataaacatcacatgctattatttgacaaggcagttttataacttgtcaccaggaagtgctggtgaggaaggaaatatttcacggaagcattatttaaaaataaataaatgtaatttttaaaatactgtcagcatagctaacataaaaggcacccttggttaccctactttcattcttacttataaaatcccaaccttaactgttctgtgatggagagagagatactgctgttttgattggcccactgctaactgaaaactatcctgcaatcttgggtataaatcaaccttagcaacctttgacaatgagattttagatcctttggaaaacagaagtcatctagaaattcagccagtggatcctcctttcctgacacatcattctgcataaaattaggtgattgtcttcctctgctcttggcccaggatagaaacaggttgtataataaagtagttctccccttgcctttccataggccacctgtccctcagctaaatcagaaagataaaagttagatgcggccaggcgcagtggctcacaccagtaatcccagcactttgggaggccgaggcgggtggatcatgaggtcaagagatcgagaccatcctggccaacatggtgaaaccccctctccactaaaaatacaaaaattagccgggcgtggtggcgcatgcctgtagtccctactactcaggaggccaaggcaaaagaatcgcttgaacccggggggcggagtttgtggtgagccgagatcacaccactgcactccaacctggcgacagaacgagcttctgcctcaaaaaaaaaaaaaaaaaaaaaaaaaaaaaaaaaaggtagatgctactcaaaaaaaagttataggaataagaagtcccaaaggaagagtaatttcaaactttaaatgcctgttaaggtttcggggctttgagaagggtttttgaagaaaaaaatcttagcagttcttccttcctgactatttccaagggtaggaattttgtggggtgctggctaataagcaccttcataagccaccatgcccagcaccactcctactgccctgagttgtgcatttacattcatgcaaatgttttagttactcagtatcaacaatacctagagtttgaggctgtaggaaattgcttttttaattaggccacttccaggcagaacagcaaagcatttattcttattacagcagatttgctagatctgagctgcaagggtttggactggaacataaaaatgcaacccaacaatgttatcagttccaaaccttgtcacaaaatagccttattcccaatagtggttataaatccacatgcaatcccagccagcagagcgtggagatctgggcattaagagttgtatagccatcttgagtaccttacatcctggggtggcacctagtgcctctccccggggcctgatgagagttcccttcaccatgcaaaaggggacatggcgactgccatccacatgacctcgttggaaagcagaattactcatggcttaaaaggtgctttctgagaaaatgaaggaaaaagtcccaggaaaaggacaggtggagttgaggaatcagccagcaaggaagtccaaaagcctacattgctgggaggaaaagagaaagaaaagaaaacaaagggagtcagtgaaatcttcagaattcctgaatgatgtctccaaacacagcatcccacatccgtaatcccagcaatttgggaggctgaggcaggaggatcactggagaagagggcttcaagaccagcctgggcaacatagcgagatccctgtgtctccaaaaatacaaaaattagccaggcatggtagcacacacctgtggccccagctacttgagaggtttaggtgcaagggttgcttgagcccaggagctcaaggctgcagtgagccatgatcgcaccactgcactctagctggggagacagagcaagaccctatctcttaaaaaaaaaggattactgagtgtcaatactaaccttatccaaactgttaggagtaaatttcctcttataactaaccttgtgtttatatgttttgaattcagttgtgtccacagtactggccagaaaacggagtacacagacacggccccatccaggtggaatttgtctctgctgacctggaagaggacatcatcagcaggatattccgcatttacaatgccgccagagtaagagacgggcctgtcatgcctgtgattatggtttcatttattttctcactcactgaatacttggagcactcactctatgtcagtcactgttccaggagtttggagtatgtcagtgaaccaaaaaaacatagattcctgaccttatggagcttacattctaataggagcagtatttagaaagtaatgatacttattaaagcacggcaaggcagattttattcaagaccatcacgataggtgcagggacccctgtcacaggaccttgcagtgggtgagagagagtgggctcaactccgagtgtggcatgggcaggcaggaatttatagccagcaggcagggtgggggtcagtggatggaaaattactaaggggaggcatgaagagtaaggggggttctggctaaactgacttaacaggattctggctgaaggcaggccaggtgaccagacatccgaggaacctgatcagatatcaaacatggtcaggtattaagggtgggtggttcttgcccacggtgacttaacagaaattgctaaaactggattttacaaggaagttcatggataggcctaggagaatattcaggagcctgacgaaagtttggtcaagcaaagaattattgtcagaaatcagacaataaataacagatacaataatagatgtagtaagttaggaagtgacaaattctacaggaaaagaagtactggggttagaaagtgctagggccttacagtggggagcaagctctgttgtaagcatgtgtgccctgtgagccaagacggaggagtccagggagcaccgaggctctctggggaggcagctttccaggcagaaggaagggtcagtgcagaggccccaaggcagggccttgcatgtgagtgccaggacagcaaggaggcggcatggcccaggctcagtgagcagaggcaagagtagctgatggggagtgagcagttcacctggaaggacagtggcttgggggccccggctggaagggcctggcagtcactgtcagcatttggacttttgctttgaaggaaataaggagccattacagagttttgagtgcaaaaatccaatggtgtaatttacattttaaaaggagcactctggcacctgtgttgagaatagactggaggagagaggcatcaggaggctgttgggataataatccccgtgagaaatgacagtgataggagaggagatcatggtgagacgggagagagcaggagtggaggtcatgagaagggggaggttctgatattttctgaaggaagagccagcacaatcctggggaatggagtgggctctcacggttcctgtcctgagagctaggatgatggaatggacactgactgagttgttgtccaggctgcccgtgtaaccggattgtttgtgggtggggggcattgtggagagaggatcagaagctcaattgtagacatactaggtttgggatgacttttaggcccctaagtgggaatatcaggtgggcctttgaaaatataagggtgaaattcaagagagagggctgaaccagatatatgagtttatgacttattgggatattggtaatatctaaagccgtgagcctgaatgaaatcaaatgagaggcagaggaagaggaagggccccagggattgagcctgggggcttctgtcagcaagaggtctgggagaaggggagactgaggcagagagagagggagggactgctgtgggagaaggaccagccagtgaggaaagcgtgttgacaagaagagagtgtcacccatgtcagatgctgctgaaggccacagaagatacagtccaagtgatttagccgtggccagattaaagctgttttcatgtttctatcataagctaagtaacacttttttgaattctgcaattctatttcactatgactaaggattaattaactattgctatcttagcaagattcaacatcaataagcaaaaccatattatgctcacaggaagcagtgttctctatcttcacactgagctcagagacatttccaggttataaattattcattacctgtaatttacctgtaattgaagttattttaccacttaacatgacaatgtggtcagtgcttatgctgtgttatttttctcttggcttttgcagaatgggaagcattctgcctcactggcctgtcatttgtctggcctgtcatttaaaacccctggttgtttttaactgctcgagattaaaaaccataactcttcaggccagcagaagccacgttggtaatttgtaggcaggactcgcctttaataatgggaagatcaagtaagtggaatcagcccactggaattcagtaaataatgcctgttttctttccactccccgattgttgccttgttcttcgtagccccaagatggatatcggatggtgcagcaattccagttcctgggctggccgatgtacagggacacaccagtgtctaagcgctccttcttgaagctcattcgccaggtggacaagtggcaagaggagtacaatggcggggaaggccgcacggttgtgcactgcttgtaagtgcttgacagagctcttcatttcagaacagcgaggccccacactcactctcacctcctagttctctgacttttgtttcactagaaatggagaagaaataagtaggtctaggtgaaggggtgatcatgacactcagtgagggattggttggcttttcaggaaacaggatatgcacattctgcatttggatggtgtgccgctgccgcacaagcaagcactgaccgtttcattaggacccctgcctccgccgcccactgccaagaggaaaaaaaaaaaaacactggctcttgagagccaattgttaagttttcaggaattttctgagctgggtcttcaactgttggtaacttgaattcatccatggtagaaggatttacatcatggaaatcaacaaatgctacaactcagggctccttcccaccagccaaaggccagtttaccaccacattacttgattattcaattggaaatcatgtcaggtctcaaaggacctggagtgtgtgtgtgtgcgtgtgtgcgtgtgtgtgcgcgcgcgtgcatgctttttgggagaatgtgtatattgggagcatttggttacagccagtgtccccagaatgaggcttccaggccagcaggttttgcaggtgctaaatatgggcacccctgctacacatagcccgcagccttacctgcacattgagaattatttggggagctttacatgaaaaaaaaaaaaagcccacacctaggccacaccccaaccaattaaatcaaaatctctgggagtggggcccagacatgggtgttttttttaaatgcctaggtgatttcaatgtgttgagataataaggttgagagccactgaatggagaatgccatgtttctcaaagcactttcacctgcattttctcattggcagtgatatgtagctaatcaaccagctgcaatcggcttaatagaacaggcaattagaaagtcacggcagataaggaagatgtttagagaatttggggaaatttaaaggataagcgaatgtcacttttcagtgaagtatcattagaagtacacaatgagatctctcttaaattgaaggcaaaataaagtttcactccgggtagatcaagcctagttaaagttgcagacctggctcagggcgtgggttactctccagtcagtgcccttgtctgatgcaatgccacctcctaccccgggcctgcaaagtctccctggaagcccaggactctgcctgcctctcaacgatcaaaacacgatagtgtctcatcctgcaggaaactgatattcctttggaaggagccttaagaacctacccacagttgtcttcaaccagaagttccaatcttttgtcctctaaaaagcagtttattaacctcacctttctctagttgctgtcatcccccctttcttctcatggacccagtgcattaaaaaatctctgttggccaggcgcagtggctcacgcctgtaatcccagcactttgggagaccaaggcaggtggatcacgaggtcaggagatcaagaccctcctggctaacacgttgaaaccccgtctctactaaaaacacaaaaaattagccaggcatggtggtgggcacctgtagtcccagctactcgggagactgaggcaggagaatggcgtgaacccgggaggcggagcttgcagtgagccgagatggcgccactgcactccagcctgggggacagagcgagactccatctcaaagaaaagaaaaaaaaaatctctatcaagaaaatgacaaaaagaattcattagcagtccacatccctatttttatttctcttcaatccagatccaacctctgatcagaacaagaggctcacgctgagatgatacaatcccagcaaagaatattaacattgtagttcgtttgtattagatatatcagatttttctaaaatactaaaaataggttgcagttacccctgcctgcatctggagacccccagcgtctggagctagatgtataatgcatcgctccccccgggattagcagctttctaaaaagggtcagtgctttaacccacaggactaagttactagtgactcgaagaagttgaggcaccaggacaggcctaacaagaagacataaagacttcttaaatcactgcaccttgtcaacaacacacttcccagaggcagctgtgaccacagaactaaccagtgacattgctgttccatgtaaaacctaaagcaatcagccgttcttcacagtggacggtgggaggcatccgttgtttcttctctcctgcctgtgcagcatctcttcccattttccactgagagaaccttgattattctttggaatactcccccctccctaaagccccgcctctgttcatgtggggctgtctcttgctctcttagcatcaaggtgggcatgagacctaggcctggtgagaatgtttatttttgtttacatttatatatctaaatctaaggctttttttagctataagaaacaaagttagtttacattggcatcccccagtactggccaggaaagaatcaaaccactccagtcttcctcttggaggtaagagcatggcattcagcatagtgtagcgccacctaacggctgtgggtggagagttcccggctgagacaagacctgccggtgctttgaagtgaatggttccttgagccacagatattcaaggtaggcaaatagagagtgtttttctttatatgtgtctcccagctaataaagctagattaaatggatagaattaagatttcaccactttgcaactcttgatgaaaataatagattagacagtggtcttcaacagctgccgaaagtattaggtgcaaagctgataggaaaagcggtgtaatggtaaggcaaggatagaaaacagctaatcttctaattagcagaagagacagtccagggacagatccgtacctcagcgtcatctgacttacaacaaagatgccattgcaacgcagcactgcagtgggtggggaagactgcctggacacgttggtctccctcactccatgtacagaatcccttctagatagatggtagaccaaaaggggaaagtaaaataacaaagcttctagaagaaaacataggagaatatcttcacgaccgcgggtagatttgttaaacaggacacagaacaatagccttaaaagaaatattgacaacgtggactttcattaaaattgagcccttctcttcatcaaaagatggcaataagagggtgaagaagcaaggcagtgggaggagacttttataatacatgtgtctgacaaaggactcggccacaatgtcgaagaactgctgtactgcaagccagtaggaaaatgatagacaactcaatttattaaatgggcaaaaaacttgacaggtacttcactgaagacaaaagatgtcccagcccagcgcagtggctcacgcctataatcccagcactttgggaggctgaggcgggtggatcacgagatcaggagatcgagaccatcctggctaacacggtgaaaccccgtctctactgaaactacaaaaaattagccgggcgcagtggcaggtgcctgtagtcccagctacttgggaggctgaggcaggaaaatgacgtgaacccgggaggcggagcttgcagtgagtcaagatcgtgccactgcactctagcctgggcgacagagcaagactctgtctcaaaaagaaaataataataataataataataataataataataaagatgtcccgaatagccaatgagcatagaaaagttactcaatattattcatttttaggcaaatccacattgaaaccaggatcacatgccactgtgtactcaccagaatggctgaaattttaaagacagacaaataaatgataatcccaagtgttagtgaagctgtggagtaactggaactcttatacactgtaggaaggaagtaaatactgtacaaccatttggaaactgacagcatttaccaaagctaaacatatacgcagtctgaggctgagctcttctgttcttagagaaatgactgcagaaatgaatcatctaccaaaagataagcttatcacaggtttactcataatatttaaaaactggaaacagcccaaacattcatcagctgttggataaattgtacagtgggtattcattcagtggaattcttcttagcaatataaaacaataaactaccaatataacaccgtgggtgattctcacacagacaacacagagtgaaataagccagtctcagaagaagacatagtgtatggttcatttacacaaagctgaaaaacaggcaaaaacaattgatgatgctaggcttaagaatggattctctttggtgatactgatggtattgttgaggaaggaacgtgagggagcctcttggggactgaacgtggtttgtatcttgatctgaatggtggttacatggtgtatgcattggtaaaaattgactgagctgtctacttacggtctttattgtaggtatattatactttagttaaaaaactgattcagaatttcataatgggctgatcaagctgatatccgaacacgatgatctctcttaaaaccataaaacaagggacaaccagatatttttggcttgcttcctaatgaaagtatactttaagtatccttgtataaataaatcaatcttgaattcttaccaagccctggaactacctaccgatttacaggaaatacagagttagaaagcagcatattaaataatatcacagagatgtgatgaatgagaaaaatctaggatgtgggactctctacaggacacagatgaacttgtttcctcaacaaataaattctcaagaaaaaagagagagcaaagaggaactcacagagtaaaataaatttgcaagacataccaaccaaatccaatctgtggactttgcctagatgtggattttttaaaaagcatctgtaagaaacaatctgagagtggattttttaaaaaagcagctgtaagaaacaatctgggaaactggaacactgactagaaatttgataattttaaaacagtaatgttattattttaggtatgatagttatactgtgtactgtgtttaaaaataaaaaggtcccatggccgggcgcggtggctcacacctgtaatcccagcactttgggaggccggggcgggcagatcactaggtcaggagattgagactatcctggctaacacggtgaaaccccatctctactaaaaaaatacaaaaaaattagccgggcatggtggcaggtgcctgtagtcccagctactcgggaggctgaggcaggagaatggcgtgaacccaggaggcagagcttgcagtgagccaagatcgcgccactgcactccagcctgggtgacagagtgagactccatctcaaaaaaaaaaaaggtcccttatctccttgaggagagagtgactgcagagttgatgcagggatagtgcgggatgagcctggaccattatgtggttgcagagagtaaagaaataaaacaggctggggacttgtcagaaaagaacaaaagagccagcctgacggagctcccactggccaaagctggaacaatgtgaacaaaatcaatattagtacccttggattttagctgatagaataaaattattatgtataagctcacactgaaataaacaaatcataaaataaataaacaataatagggaagaagagacagctctttcttagtgtagaatgttgaaagagagggaaacaggaaatcaccattaggcaaacaccacagtgataattaattgttgcagacaagatccaccaacggatgctcaaatcagtgggcgagaaacaaaatatttgcgtagtcccaaaatatcttcctcccagatatttattgactgcaaagagaaagatgataactttatggtgagaaaatctggcagacaccatcttaacaagtgagcaagttaacatcaccagtaataagacagatggacatcctgaacccctgggaggagggaacatcccctctctggttttcttaccgaaatgcacggccttgtttccagtcatgagaagacatcagacaaacccaaatgaagggatggtctacatgttatagtttgtgatgacttctcagattgcggctggggacgacagctactttctacttctgtgttctacattctttatattctacaaatcactgatcagtgctcttcaaaagtgtcaaggtcaggaaatacaaggaaagactgaaggaaactaaggagacaggacaactacatgcacgactggatcctggaccagaaaaaggacattcgtggaggaactagtaagatgtgactacagtctgtggtttagttaatagtattgtcccagcatcacgttcttggtttgcataatgcgctgtgggcaagtaaggtgttcatatcagggaagttggatatgcattctctatgctatttttacatttctgcacatctaacatgggttcatagtaaaaagttttctttaaaaagagcctctatgttttatagataaataatgaaatgccaatggatttgttgttgttgttgttgttgttgtttgagagggagtctcgctctgttgcccaggctggagtgcagtagcacaatctcggctcactgcaagctccacctcccgggttcacgccattctcctgcctcagcctcccgagtagctgggactacaagcacccgccaccacgcccggctaattttttttgtattttttagtagcgatggggtttcaccgtgtttagccaggaaggtctcgatctcctgacctcgtgatccacccaccttggcctcccaaagtgctgggattacaggtgtgagtcactgcgcccagctgctaatggatgtttttaaaggccagatacgtctttgaacgtaacccgtacttgtcacagcaattttcctggcagaacctaaataaggttcattgaaaattttctaccatgggcccttatcgatgaattgctgtatcagagaatgtgaccagggctgaggtgagctgggaaaggctctgcagtcaggtgacctgtggccaaacactgcggatggcttgctctgtttgctttaattaaaagaatctgcccaggtaagaggtcccccggcctcagagccctttgttgttactgttccccagggtttagacagcttgtttccacaggtgtttgcaagatgcagtgtaaagacagaccgagtgcagtcatctgatctttttcacgacaggaacgggggaggccgcagtgggacgttctgcgccatcagcatcgtatgtgagatgctccggcaccagagaaccgtggatgtctttcacgctgtgaagacactgaggaacaacaagcccaacatggtcgacctcctggtaggacaccccctctgagctgttccatgagacaccccattagcattagaatccactccagctcccagatttgcagggaaactgatgcgtagaggaagagactcattttcaaaatcacaatgtaatcactttgcttgtagggcttttttcttctttcttgttctccctcttcctctctttgttcttcacacggagactttgtctccagctcattcgaaatgcggaaatagctgaaactcacaagtgaacatccttattaacttcccttcctggcagtgccttccatgtggctaagcacttagtcttcacagagaagaaataatcatagtacgtgaaatgccagattttcaaattatatattttataaatagcttaatcgcctaatatttatcaaagctgtgaattttagtttgacatccagaatattgcatttaattatggtggccatatctgagaaaagtattaaaggagatgagaaacaaaggacaatgtacaattattttcttaagagtattttatgaaatctctttttatgtggagctgttgaaatgccaaccaccgtgactctagaatagtttaaaggaggaagcttttagattaggtttttgcacttctctgtgagtggaggaaggatctgtaggaaacagcaggactaatccaaggttggaaaatggcttgggggcaggagagggaggaagagatggccgatgggacaagcgccaaagccaatgttcccaggtccacagcatcacaacactggggttgatgttaaaaattaaaataaagggacttaagagggagttgagagtcaagctgaatttgaggaagtagccatggtcctcatgcagtttaagaagtcataatagcagtgctccaggctggctaatagtagtgaccaatgacaacgagctcccaaacgtgtcccactcatcacgaaccactctccagggcatccactttgcccagatacatgtctcgtgcctgatgagctgctccatttccaagaagcatggctgttggtcagaaaatttgtcacacccacttggttaggcacactctcacccatcagctgttagcatgttggcttctagaaggggcagaaaggactgtgctccccagactcctgcgcccctcctccccaccctacggggagcccatggaaacccaaattctagtctcaactctactactaattctagttaggtgaccccaaacacattagttttgtcatttaagtgtccttaagcatgtcacttaactcccttaggttttagttttgtaaactagggataccatgagctcactgaggtacccagtgtgcagagagatgtgaaagtgttttggaaattgcaaaggggagaggtggttgtagagagtgtaggagtctgccaggcgtgatgccatcagtggcctggcagaagggctctaagtgccctggatgtagtaacggatttcctgtgggttgttgaaaggctggtgtggggcttcactaggaccgtctccctccctgcaatcccacctgaatggtaaagagttctaccgccatggaattcccagtgttccaggatggaggcaattgagcaaagagtggccatgctgtcggcagaggcctgagtttgggctagcagaggatagaaacaaatgcacaaatgaaatattctgcctgtggctttgtgaggtggttaacctcactaattcagggacaggtatgtagcctcgagactctggttggtacttgggcacagctgaccttgatcaaaaaaaatgtcacttccctctcactgcagcctgaattaagcacatcattagaaacagacccttccaggcctttcctctaatggctccagctgcagctttcatcactcaccaggttttatgggcaggagtgatggggctttttccaaatcagtggtgcacgctgaaggacaggggtgatttttcgtgaaataaatggaggcttagatggccgaaccagaagggagcttgcggtcccagcccacgattctatcgtaacttaggactttttgtattatgtgtgatcctgagggagaagatgggatttctgggtgcccagacctccaaagtcagcagcaggtggaggataaggtcagggtctgagaaatgtaggaaagttttgcaatgtctggagaaaactatgtgacatatctgtcacggggctgttagcagggtattagataatatctggtgacaaagaaaatctcaccatcctcttttcagtgggtttgaagcttccagaactgaataggacctgttgtcatttggttttgcctgtaaatacgacttctgtttagtttggtgttgatacctctgtatgttgtctgagagaattaattagcttaggccagggtgataaagtctggtacagttttattgggcatcacaggccatctgaggcctgagtgtgtcctaagcacagaatgttgtgccagcagctgaaaagagcagtgtactgagtctacttagccgcgtcttcagaggatgacgagcatgtgccagacagccctgggggcacttccgagtgtctgcagaggcaggctagggtgcaatagaggggccctcgccccagccccaccagatcacatgtgtggctgcattccctcatggtcccttccgttcagaacaggcaaatgctaccgctctaccctccctgccagggcgggtgagcacacagagggacgctgtgtctctcaccatctccctttgcagctctgattgttctaaattgcttctgagtgggaagattcgtcggttcgtgttgaagcatgacactctccagggagatccagaaagccctcaagatgtatttctgcaaatttttagctttgggagctctggagaaaagccagtggattgccaggaggcaaaatagtttctaatacaagactagatttttttgtatccagcaggggcagctgcatttttcctgacccctttttcagcccgcttctaagttatccatctcttcaaccagcctcaagtccccatcaaagaactgggtccccagaggatggacaaggacagcacagcctgagattccccacgactcgcctagttatattcagaaggagtgctggcacctgagctcctttgaagagactccggctgcaggaaagcggctgcttcacgctggcagctcccctctcacttttgccttccttaatggcttttgaagttcccagggctctgttttaacatagaaatggtcttcaagggcagatcttgcctagagaaacatagtgtcccctgtgaggtggtgggaactttggaagactcccctccacagcctagtgcactgcccaggaagtgaacaactggccccatcatttacccaaatgccttgggcagggctgacaaagctgcctctgcaggtaattacacactttaatatggagtgcagtggcgtgatcatagctcactgcagcctcaaacccctgggctcaagccatcctcccacctcagcctctcaagtagctggaactaaaggggcatgcaaccatgcctggctggttttttatttttatttttatttttttagagatgggagtcttgcagttttgcccaggctggtttcaaactcctggcctcaagcagtcctcctgcctcagcctctcaaaatgctgggattacaggcatgagccacagtgcctggcctggcatcttatcttagtttcatgccattctgcacatatttctcagcctctgttctatgtgcagcatcactgggcattgatgcaagagaagtagaagatacagtctctcccacatggagcttagaactcactggagatgcaaaagtcctacctgaacctcagttttctcatctgtaaagtgggagtaagaatattaagcctggccaaacacggtggctcacgcctgtaatcccagcacttagggaggccgaggtgggcagatcacctgaggtcaggagtttgagaccagcctggccaaccaacatggtgaaaccccttctttactaaaaatataaaaattagccgggcgtggtggcaggcacctgtaatcccagctacttgggaggctgaggcagaagaatcacttgaactcaggaggcagaggttgcagtgagctgagatcgcaccactgcactctagcctaggtaacagagtgagactccttctcaaaaaaaaaaaaaaaaactattaattcagtcacaaaaggccacatattctatgactccttgtctgtgaaatgttcaaaacagacaaatccatgagacagaaagtagagtagtggctgctgagggctgggggagggagatgggggtgactgctgataggcacagggtttctttctgaggtgatgggaatgttttaaacttagattgtatataagtctgtaaatatactgaaaaccactgaactgtgttaaagtacaaaattacaacacatttaatttgaaggtctaattggcttgtattagtgaccctagaatcaggcaacatgtcattctgtaaaatagaacgagtgctccaaggagctgagcagaggaggctgctttataggcagaaaaaagcttgagaaggcagagacagggaacacaacgcagatcggttgtttcaaacttccttccatcatacggttaaaacagaagggacttctttatcatggcagctcaggaaaaccgggtcgcttctgactggttgttgcacttctcctgatgtttggaaagctgccctatttcaaagttcagttggatggcgacgtagcacctagcacgagggactccattctggtttggtctagtctgtcagggcctcatccaaacagtggcctctcatgaactttatgtaacaactgtatcctttaaagaggccaattttatggtatgtgaattatatctcaacaaagctgttgttttttacaaagtaacatcaaaaacaacaaaaaagaatactgttcatagaaggctacggggcttttctgtttatggaacatgtcccaagagttatcttgttatactcagtcaccttcaccaaagccagaagaggtgctgccgctgcaccccctttacagagaagtctagcgtttcgtcattcgtgcaagccaaatccagatccggatccctcctcccagctccaagcctgctgatgttcaaccaccctacaaggagccccccaagctttctcccagcctagaggctggacaccagcggggctctcagggttcatgatgtgtggaaaaggtaagggaaaaaaatcgacaactaaaagccattagacgaaaattccaaatagaatgtagccggataagcagtcccaacccacctgggagtctgaaagggagggccctgtaggaaggtgatggtcataacccttcgctgggttgatttgttactgagttgctgggagaaatccaggataaagggtggtaaagcagtgcatgctcttgcaccgggagaaaaagggcacaggttagtgtaggggacctgagaacagggcagagctcaatcactgtgtgtgtgagcttcatctcagaccaggtgtaacaggaacagccccgtccaccatcacgtgccttgtaagattcagaaaagagcatctcctcagtggttctcaagcctggttgcccactgaagtcatctgggagctttagaacaattctgatccctgggcccacctggagactgattcgattggtcaggggcctggctgcagcagccgagtgttaaaagcccctggtgagtctcatgtgcagcctagcttaagaaccatgtctgctctagacgcagtatcagcccaggctgcacttgagaatccgcccacccccaactcccgggggagctttcagaaataccagtgcacaggcctgccccagcccacttcagccagaggctctgagatggagcccccgccaggtaggatagacgtgccacacggctgagaaagttggtgtaggaggatcagcgggcctctcccttccctgcagtgccatgcggcggtgttcacagctcgccgccccctccccctccgtcccacttactccagagccaggccccatcctgatctgcggatctgccgcacaggttcaggttgccccctctgtaacttacagccgaccctccagactcagcctcacctcccctttagtaagccaacaatggactcacatacaaaatgcaatgtggtgtggggcctacagctctcccccttgtgccaccaactggtgtgtataggctgtccctcaatagctcttgctgtgaaatttgcagcctatttaacggctgtgcatgtgtgtgtgcatgtgttggggtggtgagtgcaggagttgggtgggaatcagaggtgagctagggtccccaatccacactccaggcaccttgaatccacccatggtcagtcttcctgcactgttgaggaaggtttgtaataatttttgctaataccccatcccctctccccacccccagattccacttgcccatcctgccccctacactcagcaccagccaagcgcctggctcccaggagtttcccagtaagcattttctgagtgactgaaccattcttctctgcagccagacctgagtccaacctgagccaccctttgctgccctctccaacctaggggaggttgtggctgtgctcagcagggcctcaataaggaactgggcatggattttgcagggggctttggtgaagaaagttctacctataggtattaaagatagagattaagggaatgagccactcatcattccagggacatgctgctgtctcgctgagcagggatgagaatttattggtctccttggcacagagtggctggccacaacctggctgggaacactgaactgagggatcccaccacggtaatagggcccacgctgcccttctggcagggcatcactcagaagaatttttccagcccgaaggatctgtccgttcagggtctagccaaaatcatagagcttgccttagtttcaaaagcaaccaggtcagaggtggaggctattctctttgaacctttggaggccgttgatgtggtgtttgaagtgcccacgctggccgccagcctgagttccttagacacaggcagcctgcgcagacgacaaggctcgggcccctgacggaggcccccagtgccgcccgctggtgtgctggcctcgtgacgccctcaccaagctagcagtggcttttaacagccaacctcaatttccagttcccttgcacattttgctttctcccactcataggtacaggaagtctgatcgggagcggggccagcgtcagggaccttggtgaggaatagcagcaggttgccctggttacggtctgacccaaggatgtgaggaggaccgggccaggctcccacctgagcccctactcagggcacctcctcatgcccgaagccagctaatgtcacccaaattggagcactcaggaccaaggcctaaacattcctttttcccctggagcacagggatggctcatgtggcttaattatactgttcaaaagggagtgagctgagagaggaaactgcagcagatagacctatacctggtaatcaaatgtaatcagtttccaatgtaggaagatttcaggcatttacccaggtgcttgggggaggggacacaacaatttgtggtcttccttctctttccccttatttttctgattcagaaaccagtcatcacagaatctatggggactgggtgcttgctcaggaaggataaggtgggagagggagaattcattttgaaaattatagtcatgcctgagacagggcagcttcggtgacttccaagcagcagctccttagcagcgaagcccaaaatccctcctgagtttccggcctgtgttgtggcctgagggcagcagccacatctctccactaggtgcattttaacatgttaaaaggaaatatgttaaaaggatggctctgagtagccactgaaattaattgcacaattaggcttgtataaaatcttttttatgcagtaagggatgggaccgtgtagatttccattacagaaagaattgtccctgtgattcacaaaagcatgatgggagcacttcacagccaagatgtcggcctggtgatctgacaacgtggccttttggaattttgaaattccaattatctcttttaaatattctgaaaataaaagtatcaaatcctgaaataataaatactagaatatgaatcagaaatctaattttgcccagggcaagaaataattttttccagttaaaaagttaaaaaaatacttctacctttattggcattgtgtgtggaaaaagtggtctatttaagggaaatacaggctagtaaaatatttgttatttgcactaggagataatttaaggaacaccttctcaaatgtcatcagacttactttaaaggcaaaccaagtccaaaagttctaaattgagaaagctggaagggaaacttaaatatgatccaaccccctgttttatgaccagaggggaatggattggccaagatgtcggggatggttaataggacctcaggctcctggtcagtgtggggcactcagacccatgagtctagaaagcaaagaacaactggattcatgtttcctatgtcagagtccacccagttgcagttccacctgagtccttcacagacattaaaggtaggattcacatcatggaataagcatttttctactagcgatttgtttaataaagctttattggaatataatttgcatgccataacatttccccttttagatggaaataatagacactgggaactccaaaagagcagggaggagagggagggttgaaaaattacctgttgggtataacattcgattgtaatcagtttccagtgttttgcattcctaccagccgtgtaatgcactatgaacattcatttgggggatgaataccctaggagcccaatccccaccattacatgtgtaatacccatgtaataaacaagcacatgtaccccaaataaaaaaaaatccccttttaaagtgtgtcattcactggttttcagtgtattcacagagttatgcaaccatcaccacaaaccaaatgtttaacatttccatcacccacttagccccctcaaagaaatcctagacctactagcagccactccccattacccacttccaggctctggcaaccacccttcagcttccagtctttatagatttgcatgtgctgggtgttttcatagaaaaggagtgtgtgcccttttgaatctgatttctttcactcagcagattcatccatgcttcagttcatccacgttgtaacatggattagtacttcattccttttcatagccaagtaatattccactttatggctatactacattttattgatgtacatttgagttgtttaccctttttggctgttaggaataatgctctgtgaacatttgtttacagagtttttgtgtatacgtatgttttcagtttccttaggtgtacacccagtagtagaattgctaggtcatatgggaattctgtgtttaaccttttgaggagctgccagacggttttccaaagtggctgcaccgtttgacattccctccagccgtgtatgagggttcgctttctccacgccctcgctaacacctgcgattttcttgttatgtgagccttctcgtgaatgttattccactgacattaatctcatggcaccgtcagtgattgaaatgatcttcttgttctctgtcttcgcctctggatcatgaccttcccgaggactgaatgtgtcataaaatccccagtctctagcagtacatgtgtattgagttggatcacatgctgctggacccatggcttgtcatcatgtgtacatgtagccgactttgactctcaactgtgtcagttctgggctagagactgttactttatacaaagagagataaactgtgtcccttgtcctcaaataaataggttggactactagggtatttacaaaacagagtgtaggtgaagaaaaggaaatttcagtgacaaattaggaggcacttaagaaatactggacgttttcaattaatttggcaaaatgaaaagtaatagatacatttccttggttgtggctgtgatgggtagagacagtggtgctgaacctcgctcacacatgtgaaagcttgtctgctccagaagtagaagagagccttccagttgctaaggctctgtccagggccgggctcctgccaggtggcaggcagaggcttcctcaagccctgcgtccctcttctgggttcagagaccactcccaggcttggttctatcagcacactccatgcatacaggtgcagaatgctctccccggccacccgagaccacacctcagccaggaccttgtgcagagcttgcttgggccaaggtacacgatccaggaaagctgagctcaagaaaaatgaatccaatgctggatgtggtgactcgtgcctataatcccagctaattaggaggctgaggtgggaggattgcctgagcccaagagttcgaggctgtgttgagccatgattgcaccaccgcactccagcttgggtgacaaagggccatgtttcttaaaaagaaaaaaaaaaaaaaaagaaaggagggagaaattaattccctgtctgatgaagaactggtctatgggtcccagaggatctcaaacatttccccttctgtacctttcctcgtcctgttgcctccgcctggaatgcctgttttaattaacgggtgaggatggccacgtactttatccaaactagggcactttgagagtgaaagagggttatgccaggacaacaggcagaagccaggaccgtccagggcaaaccaaggctgcctccactccacgcatcagttccgtcctctggggaaggcgctgtccacttcccactgccatcttccctaagaagacctgccgtcccctgagcatagggaccattccacctcatgtgttgtcattgggttacctgtctcatcctcctcactggatcacggacttctcaaaatcagggaccaggtcaaggggcttggtattcaggaggtgcttatgaaattctcatgagattgaggaattcccacagactgaaagtcaaaggtaaagctggatcatgcatgaggcctcatctaggtaccaagggccttgtgagagatgtcaggaaggcatttcctgaagcactcgttactttctcttctacccctgaccctcctgcacaaagctcagcatgttgatatcctggaaaatacatgtgtggacaaacatatttagagttccaagtgtccagaaccttccgggaattctagccagcacaggtagcaaaataccttccacccagcattgtggggagcatctccaaacagtgaatgtatctggagttcagaaccgtgactttctgattcatttctaattcaaatcctcccagattgatgtcttcccattaagaccctactctatggtaattgctttactaggaacagcgttgagatattcttgagctgacactttcccctcctgttttccaggatcagtacaagttctgctacgaggtggccctggaatacttgaattctggctgatggtgtaaacagctctgcaaacaatccctttcataccacaaagccaagacgttccatggtatttgtgcaaaagagatgaagacttctcaatatgcttattttgctttgcataattggctctttttaagagcccaagaaagtgtttctaaaattgcttgcactgcccaatcccagtaatgctgctgcctgacagaaacacacacacagccacagttgccaaatcccgtactccttgccaccggcttcctagagcagcgtagacagctggtaaactgaagagcacaactatattcttatgaaggaatttgtacctttggggtattattttgtggcccgtgaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaagatatgttgtatgagtcgtcgtttctgtcagatttgtattgtttccaagggaaaagcttgggggaggactcagttcacaaaatgcaaaactcaacgatcagattcacggacccagagcttttccatgtgtttatattgtaaatatttttgatttcatcaaattatttattcattaaaagaaatttttgtgaagcacagtgagtgacaatcatttttcttaaggcctggaaacgattttctgtatgatgttactttatgtgaattctcatctcaataaatgatgacccgtgagcagccgtggcatgttcctggtgtcccagtgcacaggcggtggaggccgcacccgacacgccagcacacagggggagagagtgcggccggggcctgtttgccggagcaagtagagtagagtttttttgagagagagtgttcgtcagtgagagcactgagcccttcacggtggcctgccctggtgccggggaggctcagccatgagcctgcaccatggggcgtgagccctgaccttgtggggcagccaggccaggggccatggcagagacttgctaactggagcatcgtcttcctttctctgtttcccctcagtctgcgggggataatatctctcttctctatgcctcaggccaacctaagacttgctgagagaacagtttttaaagggttagagaatcagagtgcattgaaggacaccgagctgaacaagttcccaccagagcacctgctctgcgccaccctgggctctggccgctgacacagaaggcaggtgcacggtggccttgcagcttgcatttagcttgggttttaggctgtgttaacgattgccaagagctgacagaggcaaagctctgtcgaacacctcttgtgaaccagataccatgcagagcatcttcctgtgtggtagcacgtgctccccaaacatgagccaggtacaactgcgaaacccacctgacagatgaagaaactcaagctagaaaagattaaataacccgtccaaagtcacactggctagcaagtgccagaagcctccagagcccatgggaggtggaagggcagcaccctcaccatggcagaggagcagagtctgctagtgccgagacagagactggcccgccacccgctgtgggaagtggagaggcttgagggcactgttcctgcctgctctggggatcttggtgaccaaagacttcaagggcagaggttgccctccaagaggactgacctggacatctgcgtgttagacctttactgcttcgctgtaccctgagcaatctatatgccccgattggtgtaagtttctctagacccctccttaaactgggtgggtgggaccctgtcctcccccaggaagagctggctgcagcggagcttcgagtctgtactcaatgcctcacattcagactcctcctggaggatggcccctcgccatcccacccagttctctttgctaagctcctaagagactagcaggctgctatttttgtctgtccctcttccaaatgatttctccaggatataggaatagggatgaagacatatggaccgctgcaccctttgcgggtgagctgggccctgaccaggggagtgtggtgaagcccttggccctccgtgatcatggcggcgtggctctgggctccagtccgtcagcatgggtgaaaagacggctcatctgagcatggcgaggaagtgacctcagatgtgtgagtctaatgacaccgccacttcccagtcattccctgcgtcgtcataccccggtctcacatgggagccagttgttttcaatctcttggatttttatctttctttcacttatttcaccttttagcggaaacagtgatagaaaaaaaaaggcacaggcattttgtggctttttcagatttcccacgaggcctcacagcatggttgagacctgttatttccagtacactgagaaagtctctgcccctcgcaagcaagagaagccaccctcttggctgagagtccttctctgtcttctcgcagtgctctgggttcccctctgttgtggcatccggaaccccccagacacttcaaagcctgtgactgctctggaagctgatggtcctgcccctggcacggtccccctctaagtcagcttcacagcagcacctcatgatgcttttgtaacgtgtcagcacagcaagactgaggtgtgtttccagaattccattctctgtatatttccagatggggtgcgctgcaggggtcatttggtgtaagacgtagaggcagaagggaaacagcagccacattgtttttacactcagaaagtggagcagctgtgggccccgcaggtgaataacaatggtgtgagctcctccacctctctcctaagggccctcctagcctctgctcactgggtcaaaactcatgcctgcatttttaggttttgttaaggtatcctagtgccaggactaaaacgtgcattagttaccttctgctgaataacaaattgtccccaaagttggaaacttaacaatgaacatttattatctcataccatttctgtgggtcagaagttcagaaatgatttagttggatgattctggctcaaagatcgctcgtgaggtggccatcaaaatgggtcagggccgcagtcatctgagagcttgactggagctggaaataaacttctaaggtagctcagtcacaggcctggcaaagtgcaactggctgttgatgggaggccccagtttccccccatgtgggcctttccacagctgcttaactgtccccacagcatggcactggcttcttccagggattcagaatggaacaaggcagaagccacaatttcttgtatgatctggccttggaaattatatactgtcattgccacaatatcctatagtttcaaaagtcagtcctattcactatgtgaggggactgcacaaataccagggcgtggggatcattggagccatctgggaggttggccaccacctgctggccagctgcagacctcccacatcagccagcacctcagcatctgcaggctggttggctggagcttagcaaatctcatccctggaacatgtggcttgccagtcaaggctcctcccatataccatcccctctgtcctactatgcgttttcatcctaacaccttctactgcgacagtgctccaagtcgtttgtagtatgccctaaggaaacattattccattgtaaataaacttgattaacacaggcttgattaacgaggctgtctttccccgaactccacggaaatgctccctctgaaactttctcaaatagaggtaagtcattctttcatgtctcaaagatttaatcaatttcaacaaccaccctcatactccacttgagctgatggtcacaccctgcagcctgtcaccttgaactgcctgacctctgaaatcttgaataaacatgccacattctgactccagcctcttcaactgctagctttatctttgccttattcttttattcttgttctttgtatttatgaaaaccttcagcccaatcctgagtgctgcaccctttcttaccttttccacagaacaacccaagccccatgatgtatcacttcaaccagttttgctaacaccctctcaatgcccttgacacttcatacttccatcatatccactctacaaatggttaattttagagaaactcttccaggacttttgatctcagacaaactagggtaacaaaaaccaatctaccctcctaagtgtaagaaataactgggaaatatatatatttttaaaaatggtgtgcaagatactggacatcaggcaatgaaggataacaatctccaagaaacaggaaacaaattaggtgacccctaggattgccctagcttatggcctgagagaacttctagaacatgggtgcagggaggggggatccaggtggagccacatggtttctcttatttgaggagataaggctgaaagtcaaaaaggccaaagtggcaaagatctgcagggcagagtatgagacatagagctacgtagagaaagagttctgaagatctcagaatgtccccctcaagtctttagctaagtactgatcacaacaaccttgtaaggacattacaaagaaaaaaaaaaacctgaaaagattagaaggaacaatactcagagttcacacaggccagaatagttcctgtttccattgaatagagcactcatgtttttgactctgtagtggggcaaaactatctctggtctaagcacagctgtgggcctgcctaacaaagcaataactgaggcatccaactgtttccaagtaacttaattgcacctcagaacaaaactcaagaacatttacaggaatacaaaaatatccagcacccaagaaagtaaaattcacaatgtctggcgtccaatccaaacttactaggcacacaaagaatcaggaaaacatgacatatgatgagaaaaccaaccaatgaaactgactcagaaataataccaatgaattagtagacaagcacattaaagcagttgtttcataactgtactccagattctcaaaaagaggaaagatttagcatgtatggcaaagacatggaaaatattttttaacaacccaaattgaacttcaagagatgaaaactacaaagcctgagacaaaaaatatatatatattaaatgtggtaaacagcagattaggcgccaaagaagaaaaaatgagcaaacttgaagacatcagtaaaaacaatctaaaaacacggaaagacaatattggcaaaaataaaacaatgaagagagcatgaatgaaccattggagtcgcagtaaagttagggagaaggggcagaaaaaaataattagtgaaataatggcccaaattttcaaaactgggtggaaattataaacccacatatccaataagctcagaaaaccctcaagaacaagaaacatgaagaaaactatactaaggtacatcataatcaaattgcttataaccaatgacaaggagaaaatcttataagcagccagagaggactcactgtgtgcagagaaaggtaagaatgacagcagacttcctttcaaacacattgaaagtcagaagatagtagaacagcaatttaaagttctgaatgaatttttttaatatcaaccaaaaattctgtacccagaaacaatattttccaaagtaaaagtaaaataaagaaaatttccaacaaagaaaagttgaaagaattcatccccaaaaggcccatgatacaagaaataaagggaatgatctcaaatagaaatctgcatctatgcaaaggaatgaagagcactggaaagagtaattaaatggagaaatataaaatacttttttcttcccacctcccagcacagcaggcattctcaggatacactaaggctgaggaaaagggaggtggcaaagggtcaaggtcatggtccctctcatccaagtgcccggccagatgggagggagtcgtaatgtctggtagccaccatgccgggtcagactccactgggatgagcccctgctcctcagcctctttggtgactttagcctccttgtccttatcgtcttccccattgccgccgctgtggcagcttcggcagtagtgctgctgtccagtggggcggcccaggccaccagcttggatagccttggggcccagtgtggcctgtgttggtggtgcccactgtgtcaggcagtggcagggtgctgtccatagtcctgtcccggctcagctgcatgcccaggccccagtgctggtataggaggcagcagctgtagcctaggcagcagcaggaagcaacctctgcttgcccctcccctctccaacaggctcatcaactcatataaggacaacagcaatgatttcatatgccccatctgctttgatatgattgaagaggcatacacgacaaaataaggccacagcttttgctataagtagattcactagagttcggaggacaataatatatgtaccaagtataactatgttgtggacaatactaaccatctgtttcctaatttgttggtgaatgagctcattctcaaacagaagcaaagatttgaggaagaggttcaaattggaccactcagtgagtagcaccaatggccacaggtggtgaatatttcaagatttgttgggaactgaccaagataaccttgatttggccaatatcaacctcatgttggagttactagttcagaagaagaaacaactggaagcagaatcacatgcagcccaactacagaatcttatacaattcctcaaggttgcaagaagaaataggagagagcaactgggacacttccagaaggagctaagtgttttggaagaggatattaaaagagtggaagaaatgagtggcttacactctcctgtcagtgaggatagcacagtgcctcaacttgaagctcctcctgcatcacacagtagtattatggattccacagaatatagccaatatccaggtttcagtggcagttcttagacaaagaaacagccttgatataacagcacattaacatcaaaattaaaatggcccactgctcattttgaagacctggagcactgttacttttctacaaggttgtctcgtatctcagatgacagttgaactgcaagccaattggatgaacttcagaaatgcttgtccaaggttactcaatataaatcaatatgaactttagccacattatcatgccctagtgatctctataatgattccaggatagtctctggtattgaatttgaccaggattgtgactattttgcaattgctgaggttacaatgaagattaaagtctatgaatatggcacagtcatccaggatgcagtggatattcattaccgtgtgaatgaaatgacctcaattccaaaatcagctgtatcagttggagtagttaccataagaacctgttagctagcagtgattatgaaggcattgttatcctatgggatggattcacaggacagaggtcaaaggtctaacaggagcgtgagaagaggtgttgaagtgtttcatttgatggatcctaaactcctggctttgggttctgatgatgtaaaagtgaagctgtgatctaccggtctagacaactcagtggcaagcattgaggcaaaggctgatgtgtgctgtgttaaattcagccgctcttccagatgccatttggcttttggctgtgcggatcattgtgtccattactatgatcttcgtagcactaaacagccaatcatggtattcaaaggacgccaaaaagcagtctcttatgcaaagtttgcgagtggtgaggaaattgtctttgcctcaacagacagccagctaacactgtggaatgtagggaaactgtactgcctacattccttcaagggtcatatcaatgaaaagaactttgtaggccttgcttcccgtggagagtatatagcttgtggaagtgagaacaactctctcaacctgtgctataaagcactttctaagactttgctaacttttaagtttgatacagtcaaaagtgttctggacaaagaaggaaaagaagatgatacaaatgaatttgttggtgctgcgtgctggagggcacaaccagatggagagttcaacatgctgattgctgctaacagtgagggtacaattaaggtgctagaattggtacgaagggtttactcaaccctaaatgtacttgatcctgctgatatacctctgcagctgacaatgatagaagaaacagaaaatgtcatgtgatgtctctccccaaagtcatcatgggttttggatttgtttttgagtatttttctttttctctttttcctcctttgtgacctttgggacattgggaatacccagtgaactctccaccatcggtgcgactccatggacattgctactgttggtggtgtggttgtggttatctaatttttgtgatagggaaacacattctttgaaataaaaataaataacaaaaaaggttattgagccacgaataaataaatatgtatatattacttttttcttatttaaatatttttaaaagataatttttacataaaaattatgtaggttacaacatgcagaagtacaaggcataacaacaatagctgggaggggaaaaattgaagtattctgctataagattcttctagtatgcatgaagtataatatcactagaaggcagacagtgataagtttaagatgtacacatacaccctagagcaaccactataataacacagcaaagagttacggttactaagccaacaaaaaagatataatggaatctaaaagagactcaattaatccaaaagaaggcagaaaaagagggaaaatggaataaagaacagatgggatgaatagaaagcaaagagcaagatggtagatttaaacttaactatatcaataatcacattaaaatgtaaatgggctaaacaccccaattaaaagtcagagactatcagattgaataaaaagaaagatccaactatatgctgcctaccagaaacccactttgaacattaaaaaaaacaacaacaacaaataaagaaacccatccggctgctttcttcaatactccaagctgttgagagcagctaggaaaaaaaattacccaaatgagtatcttattgctgctataaattcatggtatccatctttctttttacactcttcatggccaataatctaaggtttctccacactaaagctacctatgctatagcaatggcattcttccccgctccacaggaaaaataagctgttcaccctcatacctgttacgtttccacacccatcctcaccccatttttgcctaattcagagaaacatcattcatttccctccttcaaaagacaagtcttaagagcaggaatggtctctgaggccccctgggcacggaaggtgcgggttgcttcctctcccctgggaggtccttctcactgcctctgtatttcacaccccatttccccaggtgcttgatcagagaacctaagcattctcagacaacctcctaaatatctcatagatccattctgatctctctaattccactagcagggtgcttccaagcctcatttatctggtctctacctgactggcaaactcttctcctagtatttgatcctgttcctccaatccaccctccagtctgcacccagactgatccttaggaaagccaaatatgaggctgtcactcatccctgcttcccactccctgccttcccagtggctttgagacgaaggtctggctcttcagccagtctcatatggccagtcacctcattccactccactccctgctaggggctacagtcctccttcaggtcctctgcatctcatctctttcttatctcaaaacactggcatatgctctgccctcagccttgaaagcaactccaccctctctccatctcctccccatatccatcctccagctttagtggcgtgacttatcccacaaacacagggcatgcaagtttcactgtcagaaccttcttccagtcaacttatatctgattccagccctatcatgccaggctggaggaaaattagatctccgtctttcctgaggctttcactctaccctaccctccaaattttacagaatcctggggtcttatgccgggaagcccccagcgtccagtcagcgttcatcagtctgcctctgcctgtgattgcctggaaacccctgtccagtccgtgtggtcatgggacctgcaggctccactgtttcctggagctgcctggaccacaggacactggggaaggcggggcagccgggtggccagagccctgccttctgtgtgcaccacccagacagcctctctggggtcctgccacctcctggggttgcaaggacagatggctgcatagttcgtttgttctctctccacagtcctgagacattgtttctctcttgtgcaacatctcccagtctctctctctccccgttggggacacctgtaacaactatttccgtgtgctctcctcccactaacaaaggtcctggaagctaagactcagaaagcctcacttcctgcttccagggggaaagggaaatgataacagaaaggaaacaccaactcagaaaggtatcctgcctcattccagagagccttccctggccctgcaggctacgctcactgatctgtctcttaggactcttctccttcctttctaaagctcagtgtccccgtatccacatgttcaacgt

SEQ ID NO: 1313 - DNA, 126642 bp, Homo sapiens
gatactctgttgctaatattcatttcacacatttgatgaactgcttctgaggtgggaacatgcatatttcacaatgacttcaggtaattctgatgcaaatggctcagcttcaaaaagcactgctctaatccttgggttggatatagccaactgtctcttctcttgacctaatgtttacttacttattgcgctattctattgttatttatcctctgcaggcacccaaaagtaatgttatggaaagaacagcatttactcagttcttccattggataaatagttcagcaaagatgatatattgggctcaaaagctttcaaacagagtgaggaatgagaaataaatgcattgtacacacagtcttggaaccacagccttgagttaatagacatagttatccattccactcagtgacacagtacaaaactagtaatctaaacaaaattaatttgtttagattgaggaaattacgtgagttctgaaaagagttatttatttcaatattgtattttaaaagcagtttatttcatcaaaattgctaatgattattagacattattgtggtatactaacaaagtgattaaaatcagcatattcacatataattttataacatgcaaaaaaattggaaggctaagaaaaaataaaagctacaatcctaaatattaatggaacaggaattctaagtaaaggagccatttagagtgtattttacaactgagcaatgacagagaagtacactgagaagaaaaacaggtttggagtcagctattgattacaaaaaattaagtacaaatttgtgaaaaatcatgtgtgctgccctaaattttagatgatttaattgcttttgtgttgctcatgacagtagataaaacatgcctaaaaattcacacttataagacatttaattttaattatttgccctgttataggactattaggactgaaaagcactctgattttgcccattcatctcaaatgagtgctgataagacaatgagcagttaatttccttcatcttgtagactacacattacgtttggaaattaaatgcttgataagatggcatatcttgttacataatttattttttgaaataatagatacttcagccccaaaactactaggaaaatgtgtggtaaatagaatattttaactgaaaatttcaaaagtaaagaagagtttgcttagccctcaaacatggttaatttattaaaagggtttagggttcacacttggaatatctgactctgtttacacctgcagagtgtgtctttttgtagacacttcatttcaaagaagcagctgcataattccctggatttgggggtagaaggagagatctgcttgcaaaaattacattctacctatgaccagaaactttaggaagctgttttagagtataatatggcacccaagttatttctccccaaaatagaacatgtgtatatgtctgtatgcatgcatccacttgtgtgagttctgtaaaaagtaaaatagaaaataaagtacatacaatttacatatacacagacttataaggtaacgattatttttcatttggtgtatttgtgtatattagtgcattttatctttatatgatccctttgaagtaagttttattattcaaaatctccctcacctttgagttcctctgttcccttttaaaaaattaaaaagcaaacaaaaacgccctcaaaagcaaaaaataaaaaattgcttcacatttactcttcagcttctctactagctgttacttcatcatctctaaagttaagtcaactttttgtgacatgcaaagcaaaagccaatatgttactgtatcagttagtttttgctgtgtaacaaattgcttcaaattttagtggctttaaacaatatttattaggacacaattctatgggtcaccaatttaagccaggtttggccaagctgagcttcaccaaggctcactcctgaggctgtagtcaactagcaggtcaattagaaattggttatttaaaaatggctttgcttgcatcacatacatgtctggcagtggggtctttctggctagcagtttttaatagctagccagaccaactggttatcagctgaaataatgggcttaacacatctacaacaagctagcctggtcttagcctcctggtgatggtctcaaggtatccagcatgagcaagaggtgaagcctcaatgcatgagttctttccaagcctctgcttgtgtggttgctaatagccaagttcagaggcaagataggtgggtattaccaaaagcatggatggaagatgcatgaatcattagggaccaatactataacaatctacagcaatcaccctgtgtatatcctcaaaatgttcttgaatcagtccgttcttttctatcttcaccgtcatagcctaatccaagtcttcgttttatcacttggtctttctaactttcctcctccacaatccacttactttttattatatttttcttcctagtacccctcagtgatttgttattgtccgttgtgataaagttgtacacatttcttagcttgatcaagccctctcaagatctgaccttaactcatggtctttcatgtctcatgatgatccttttctctaactggacccaaataccaactcctccaaccagctgtactctttattgccgctgtgcctctgtacattctattccctctgtgtggaatgtattttccccacaattccacctgtgaatgcaaacaaatccttcaaggctgattaaatgttgcattctccgtgaagccttctgcctgcccttcatggacccttgcttctgtattcctagagcattttgtacataccaccatgttgtattctaatatatcagcctcctccattagactgagtattgaaaatgaaataaaatgtcttatttatatttgaatcaccaggtcatgataaattatttttggttgatgaaagtaaggatgaagggtgccaccaatttccattcacttttgtaacaaatatttaataggtatccactatgtcccagctgctgtttaatatatacatttaatattaaatttgagttgcaacttatatttttgccatttactatgtgtgcttattacaatagtatgtaaggagcagttcttaaatacacatagagcaataaattatttacttttgtatactgactaatataatctattttctttcttcactattgcaaacaaacgagtagtcttacattaatctaaaaaagagcattagactatcttttattggaaatggaaagaaatgtaagttgtttgtatgtgaagaacaaaggttcttgaagatactggatgttaaggcttaacaaaataactttcaataaaaaatagagtaatttacattaatttaactaaagaagtgaacattgaaatattttaaatgtattttctctacattttaacagtaacattataataaacatacatttcccaagctttaacatattttatgattatatttgcatccctagaattatataaatatcttctatttacaaacaatcataagttaacttttactaacaattaaaaaaaactcagcttcaaaatttttattttgaaataacttttttaaaaagagagtaatgtaacgttcccttcctgtgtccaagtattctctgttacctgcatgttgtgcacatgtaccccagaacttaaagtataataaaaaatatatatatatttaaaaaaagagagtaatgtaataagctcctttacactctctatcctaacacttttacttttcaaaatcacatatcaaataagaaatgagcctatttgaatccgtcactcattaaggtttattgtatgaagaggtacaagggaagaagaatatctcatcacagccctaaggaaaatcgaaggaaatgtttacaaacctaaacgggtttcaacagcacacattctcattaaagacacttctggttcagggttaaattgccagctctgggccccaattcaagctgaagttcctgtcttgggcttaaaagacatgtctatctttagaatgatggagatagaagagatagttgttcaggaaattgtctgacaattgtgattgtcagtgctgatagtgagttctggtataaagtcaaaacaaccaactgagaaattaattacatagaaagtactttttatttttcttgatacttcctaaagattgcaatctaggaaataactttttctttccatgcaagacctccccatttgtcgccaggctatactgattcttcctttcaataacattagtacctgtcactctccccatttccaaccacatactacctttctgactccgatccctgaccaactgggattcctttcctggattttccccaaattaatttgtcttttacattggtatgcagttatggaaaaaagaatggttctgcccacacagaaactggacccatcaactcggtctcctaaatcataaccaactgaatatattttatttacctttctctcttttttaattgactccctcaatcctctcagccatttattgatccttccttttcttcatctctcctcttcattttccatttcccccgttacttctctattatcctacatgcaataaggaaaaacatatggcacaaccaagattgaaggaggaggaaattagacttgaagaaggaatgcagacctaatctgttgatgtttatatgataacaggaaaactgatagttcatattttaagaacaagcctggaaaatttgtcgaaattttataaatttcttccacagcaaagttttggactaagtagtaattcttacctggtaagcagattcttaatttttaaaaataatctggttgggtgcagtggcccacacctgtaatcccagcactttgggaggccgagtgggggtggataacttgaggtcaggaggtcaagaccagcctggccaacatggtgaaaccccatctctactaaaaatacaaaattagctgggtgcagtagtgtgtgcctgtagtctcagctactcaggaggctgaagcaggataattgcttgaacccgggaagcagaggttgcagtgagccgagatctcaccactgcactccagcttgggcagcagagcaagactccattgcaaaaaaaatctggcctttcttatttaaaaaaaatttactttattgaggcaaaattcacacagaagtcatcattataaccgtcttgaagtgtacagctcagtggcttctagtacagtcataatattgtacaaccatcatcactatccaaaacatttttgtcatccaaaaaagaaaccccatacacattagggagtcacatctcatttcccctacttctaacccctggcaaacccattaatctactttctgtctctatggatgtgcttatcctggacattacatgtaaatggatcacacaatatgtagccttttatatctggcttatttcacttgacatgatgtttttaaggttcatacatattgaagcatgtatcattgcttcactgttttgtttcgttttatttttttgaaacaaaatcttgctctgttgcccaggctagagtgcagtggctgcgatctcagctcagccacctgagtagctgggattacagacatgcaccaccatgcccagctaatttttgtatttttcagtagagatggggttttgacatgttgcccgggctggtcccaaactcctgagctcaagcaatccgtcagcctcagcttcactgttttttaatgactgcataatattcccttgtatggatataccacattgcgtttatgtatagaacagctgatgaacattttggttgtgttgactttttaacttttatgcataatgttgctataaacatttttacacaagctttgtgtatgaatttatgtttcaattctcttgagtatctacctaggaacagaattactggatcatatgtttaactttttgaggaactgtgaaactattttccacagtggtggtatcattttacattcctaccagcaatgtatgaaggtcccaatttctccacaacctcattatcatttttaaaaaattatagtgggtgtgaagtgataccttattgtggttttgatttgcattttcctaatgaaaatgatattgagcattttatgtgcttattagccatttatatatcttatctggagaaatgtctatttaaatcttttacatgtttttaaattgggctattgtcttttgattgttgagttgtaagagttctttatatattctgatggacgattttaaaatatttgtccattgtgtgttgtcttttcattttcttgatagtgttttttgatgcacgcattttggtggagttcagtttatctaccttttttcttttattgcttgtactttttgtatcacattcaataaacctttgcctaatcccaggtgataaagacttaaggcaaggttttagtccaagagttgtacagttttagctcttatatttaggtctttgaaccatttttatttttgtatatagtgtgaagtagggttccaaactcattcttttagatgtggttatataattgaaaaggctatatatctttttccactgaatggtgttagtacctttatcaaaaaatggtatttattgcttcgtgtattttggggctctgctgttaggttcataacctcactttacttttatttgaaagaaacaaaatgaaattcattaacagaaagcaaagtacttgccgtatttataaaataattttggtgaacagaaaaacaaattaggagagacatgaactttcacagaagaaaatttcatagtatatgatcactccagataatactatgcccagaaataatctaggcaaggagatgttcctcaaaattcttctgcagtgaaagagagaaattttttttccttgcttatgtgaactaaaagagatctaaagtttcagaataaaaagattagatatgttttattgaaggcttactctgtttcaggcactggactagtttcttctttataatgtttcatttgatgcttatatcaactctataatgtgatgtcttatgtcagcaggacttgagtcaagtatttttctacaaaagcaatttaaagaaagtgttgccaggagaaacaggaaagggagtaggggtagcaggacagaggagggcaagaagccaacacagatgggattttaggaatggtctagtgggagatggtttcagtccgatcccatagaggagctctggttgtaagttgtacctcagatttatccaacatgagatcaaggttctcaaccatcagtcattggctaagtgctactcaggggcacctaggctctatctgcctatgggcaatggtggtctggtagctaagggcagttcctccaaagaaaagtcccaggagctctcaggtggtggtcttggggctggtattggaaaccaaaggaggcaaaaacagggtgaggggtgctcagaaaatgtggaagaaatccaaggggatctgagcagaacacccacaaaatctactatagatatgtactatttttttccaattttgagagaaggaaacaggcacagaaaggttaaatgcccagaagcacaaagagaatgagtgcaaatgtacctgactccaaattccttttcctttcccctttactcttgtgcctccagtcatgaagaccctgtaatttgggaacttcaaagaatcttctttcagacatcatgtgtttttatttttttccttaaaacagaataaactttttcaggtttttttacttacagtctgttaaactgtaagcagaaatttttacattagcgtattcatgggcatttttccccctgggagacagttgatagcttacaaaaatttcttaaagagtatataaaaaataaacatcttacaaatcactattttaaaagatcattctccatttttacctattttcctgcctagagctgcttttctaaaacactagtctcatgagctcagattagttataataattacaaatagcaaatttagaatattgacagcttttcccctcctctgctttcaccacataccatacgtttgagaagaactggcatttattcttctttaaacgtttggtataaatcactcatgaagctatctcatcatgtgttttctttatgttggaagtttttttattactgattaaatttatttacttgctataggcctatttagacttcctatttttgaatagaagcacaaataactttcacattattttgttaggcaaacagatttacttaaaattaaggcaaaaagttcacttagggccttaactgatcgtggtttttgtttccaatgatctgttcaattggataattgccagattttcacgtagtgtctgtatgacttacacacacacacacacacacacacacacaaacacattatcatatggttagtattttaaaaaagaaattccagtaattttcctgaacatttttcttcttatcatttcatataagtagacacagttaatcactgggactccctttacagaatgaatctgagggtatctctgtaaagaggcaacattctaaactttagtactgtacatacagctaagccctctggtctgagcaggctctgaggctttcggaggactgggtagagaaaactggcaaagttgtcctgaagcactggaggggtatacccactttaggagtgtggaggggtgggtagccccatcctggatctagctgctggaggtaccagataaggtgaaaacctttgacaaagagttgctgcctttcccaacaagtggtactaaaaatggggagattcaaatccactcataattttagctgcttttgctgtattacttagactgtatcgctccttcccataattcacccttcagccacccaccaccttggatcccattttgtttgttctatgttaaatttcaatgtaatgtagtttaatattgtcaaagtcgaaggctgatttctctctctaatgctgcaagagaagatgacatgctgtaggttgtgatgaggcaatgtgatccaaagcagaatccttgcttttgttggagagcactggacatataaagacactgggcgtatttgtcaaaagaacagaaggtggaaggaaaggaagatgatctggcagtcaggtaacaccaatcccaagtctccactgaccgctcccgtctaaagagagcacagattatagtttgcccccatgagattgccattttgggttggaagatggtcgcaatttcatttttcacttaagcaaacgtccgttgccgtactgctaggtatgagatgagtaatcgtcagggacgcgtttaaattacaaaataatggtaaatgggagagaaagaatcttttctcggggttgaggccagatcctccagggctgggagacccaggagtgcgggccactgtgcaccctcgagcaaagcagtgtgtgacgagatgggatcttccctcaaatgctgagaagagccctcgccaatccctcggaaggttcccagaataaaaagcccggtccctgctgtgcaaagactgagcggtactccggtgtactttttccctgtcccaggcgtgcagagtccacgccgcgcggccaggtgccccaatagtgtacctgaaagtagggatggggccagttacagctgcactttccctgcagaagacagtgagccttcccgggatctttctgggagctctgagtgtgaaaacggtcctccggccagcgcaggttgagagaacgggaaggagggggaagctgtgggcgcccagggcgtgacaggcgcaggtgagaaagtgagtttcgcgggagcatctgccgggaccgcagacaggtggagaaacgcagtcccaccgcggcccaccgcggctcccgggcggcctgggctgtacctgtgcgcggcgtcctttctgcgctgagccagggcaccccggagcctgcggcctccttccccgcccctgcggccccgggtcccagccccgccccgccccgccccgggctggggctccgctggggaaccggccgagcggcgcgcgcggaggtgtccggcggccaggaggatggccaaggtcccggagctggaagacaccttcctgcaggcgcagcctgcgccccaactgtccccggggatccaggaagactgctgtgtgcagctcctgggcaagggcttgctagtctatccggaagaaacagtgtacctggcggccgaagggcagcccgggggcgagcagggcggcggggagaaaggcgaagacccggagctgccgggggcagtgaaatcaggtgagtgctctgccgcatccggagctgggaaggggacggggacgtattctaagaagggcacccaataataataatgcatcccgaacaaacataaggcagatatagaatgttctgtccaaatctttgtatttcctcagtaaaatgtcaagtagagacctgacattttgcatagcccccctttcctcccctccgcccccaccccagtaggctactcctttgaagttaaggtacacttaaaggcgacttagttgattttatattctatttttctttatcatcccttcaactggcaatcagaaatgcacttaaacaatggtaacttttcctctgaagaagaggacgccgacaaccacgacagcaaaaccaaagcagcggatcaatacctgtctcagaagaaaaccatcacgcagattgtgaaggataaaaagaagcagacacagctcacgctgcagtggtgagactcgcccgcagggtacactgaagcacctgttgacgttttaacagccagcgtcttcaggatctttgattttcacaatttacttcttcctcaaactttttgggaaagtttaaaaaaccaattagaatttaacccagaatttttttcactgaatttttagtatagagacttatacaagtactggtgaaggatttgcaatacaaatgaaaaccacattacgttgttccttattgactaaaaccatattttcttcaaatgtaagcattaatgaacgtttttatgacttactggcttaatatgcaatcagttcagtccttacatatttgttgtttgatagtttttgagattataaaatatgattcttaaaaacaacttaaaatgaggaaggatcttaacactgcctttattcaaaagagggcaaattaaaaatagtgtatactccataagatgaactgtgtttgaggtagaagacatagaaaaaatcggttaagatatctatactaacttaaatagaagttcaactatttttataccatctatcatatatgatttataataataaaatattacaaattggattttgtggaaaatcttttaaaaccaagaatttatcagtaggatttccacatagagtgaacattttgtaatatctatctaaaagaaagacggctctaaagtaaaagcattatattaaactttcctacgtagtgggaagaaataggagcataaatttcctcacaaattccaagtaaaaaacaaactaataaaaaggactatatatttactgattagttacataacctaattttgtgtaaagtatgatctaaggagccttagaaaaatacaagataaagaactagtaaattttatttttattatttatttaaatattaaattacaatttacatatagtagttttttgtgattatatgcttgaaccctttcaaaatatttgaaatataagccaaatattcatctaaagttggagtttaactattgaagttgatgtcgtggttactagttaagaatatactagagcagttaagtaattgagttaaatatctgggatatttaggatacaactatttgcagcaggataactggggcaaaagtgttttgatttcagatatattattgagctgtttcgaatgattactccattttttccatttaaattgagtgtgtggaaatatatgtttcttttatgaataaatgtatacataaatatatataagttaagatcaaagaaaaaacttgtaccccaaatgaacatcatacttatgtctaggatgatttaatattttgaagacaaagacaatgccgactacaacagtatcaaaatagcaagatgaaatgtgaacattgtgtacatgtaattaaaatataatttttaaatagataaactagaactgaaaatcaaagtgaaaaagctggctgattaattccagttttcactatcaactagtatgtcaactgattttatgtacatatattgatttcatattttgaaacactagatcttagtttttggtctttttttgttcttcattaaaaaaatgagtgatattttacctgttcagggaatactttctttagcctttatcttgtacacattaggatattttaaatcaaatctttgaagggtttcatccaattttaatctgcagactctatattgcatcgtttctgcattataataaatattatcttactatacataaaattggtataagtaaattttagtcaaaatcacctactgaactgttaggaaaactgggattggaatctaaaagtttaatttctacattgctgtttagaaagttgtaacacaaatatgtatttattacatttatataagttatgcttagttacaaattaaatggaattacttcaaattttcaaaggttatatagttatttttataatataaagttgaaggtatatatgttatgtttggagatatctatagagaattacattatcttttaagtgtataggatgttttagataattatagtactgatgacagtagtaaaaagtataggaatagaaatatatcagtgtcatttcagacttaagtaaaatgagtttatcctcatgtgttttgcaaataaatgcatcattgtccttccctaattattcagggctgagaaataggttttgaatgaaagtgagagaatgtaagcatttgccaacctgaagcttgacagccctttagtactaagaatgttttaaaaaatacccatcatcttcaatttcaccattcatatttatatgtcacagagcaaatcatgatgaaccatgaggtttatatagaagacctaatatttgtgatgtggaccaggcatggttttatgttagccatgatattttaactgtactagcagatttttcactggggttttgtacttttaacattaatccttataatttgatttttaaaaaatatccagaataaacgaagtctacttatgtctactcattacctcatttatagagtccatattcaaaatgggtaataagtcaatgagaaagttgaaggaaaaggaaataaaatatttgacctaatttttgttcctttttcttaggcttgaagagaattacattgtatgtgaaggagtttgcttaccacggtgcattctttatgcacactacttagatttctgtaggaaagagaaattagagccagcctgtgcggccacctttggaaaggtaaatgacacgtattggctatagtgacttataactaaagtcatgtcaggcagatagcatgaaaatgaattcatctgtgcaagttctcttagagaatattgagacatttgttttgcaggcataaattgtcttaaggactctgtttggaattgctatatgtttataacttgattttgaatattagaaccctaactattagaagatctaatgtgaatttaaagcaagctttgtttaagcagtagcatttgccttcaaagagggatgcattaaagtgtatagtatggcctgtggtaagaagcaaaattaagtggaggtgacaagtctcttgctaatgcaattagtggttagtggttatccatactatttacctagtccaaatatatgagtttttaataggttttaaaatgtattaaaatttctcctaattctccatttcactctatgtttacattccaaatcccaagattttatgatgggatgggttagaattctctcatttaaaaatatttctttctacccaacctgtgtggttaggatgggaatctatataactgacattattatgcttatatatagagagagagacatcactttgagaatcaatatgaatgtcttaagaaagccttgttctttaagattcatgtcatgctgtgtttgagaacctaggatatcccagaaaaactttaggaagcttgggtctcaaatattgtatcttacacaaattgaaatccagattctaacctgtagagggactcattgtccagaaaataatgaatactacagtccagcttctcatttaaaaaataatgttatttatttcaaaaacctatctatttacagagagagtgtgatattatacattgtaatcaggtaacctgggttctagcctagactggactaatttattgtgagaccttctgaaaagcacttaatctctttaaaaatctgtttactcattctattaaatgaggagtttggataagacaacttctaatatccatattaacattaccattttgtgagtctaccttatgggaataattcttaactgtttggcagtcatgaagcaccttgaaaacctggtaaaactgtagagccagcctccaagaaattaatacatacatagtttgccatggagctctttaaagttcatgtatggatcttcaaagattgaggttaaaattgttttatgtagaagactttttaaaaaatgtttaatcagatcctaattttagcaactttagagaaaggaacatacaaaacaaaaaatttataacattataatggagatacagtaaggcagagaaagttttatatgtcctttggggttgggaatagatttttaattgtgggtaaatctctgtatggaattatatgaagagacccaaatcttctcactccatacataaataaagtaataattgctttggtagtaccatcaagcaaaagcagatattggtatgatctgccttagaaatcaagacaaggtcagtagagcacttcaatcaaaaaagtacctccctgcctctgctgatgtattgcttatcaatatgtgtaagttattactttttccagactaagtattcactcacagttcattcagagttcaacatttactttccccaagtaattggctatgagtggcttgcattaggaccatatactttctaacgcctaaagtaatcatctttctttttagacaattcgccagaagtttcccctcctaacaacaaggcggcttggaacaagaggccattcaaagtaagataccagtgaacatattcaggttctgctcttgtgcatgaagattgacacagatgtaaaataagtattgtctttgtcagtacaaagagaaccaggtattctcttgatgaagcagacttttatcaactgtgagaactgaaaaaaaaaaaaagattttagaataatgtttaaaaagcaaattttacatttgaaaataataatgtattattatttctgctgaaataatttaaatgagtcattttcataatcttaaagctgttactgaaggcaccagtgttatgaggaggaatgcaacgctcccaaagagcaaggcccaaaccagggggtaaagagctttgagtaggaaggaagtgccttagcatgcttcaggttcttcctctagttttctttctgagacaataatttcttgatatctccttctcttctctttaagacaaatgacatgcacagatgacctgtttggtcatctcttaaggtaaatataaacataaactaagctgtcacacattccccctctttatgtctttaaattttcctctctgttgtggcagtctctggagaactcccaggtacagtttctcattcaacagctattttctatgcgtactgtgttttcagtttctcctttccttctgcctatgagcatgtccagatctcctttatgctgagaaagaaaaaagttccaaccttcatgattgctctagtatttccccctttgagctgttgcttcccttaccactgatcacatccctctgacctagtccatttcctacctgggcaaaaatccaatggctggtttttactgttactcatcttccttggctcctgcttagcatttgaaccaactgataatgccctcttaaaataaatacagaaaactacctctatagcttctctgtcatagtactatctaggccctcttccctcttctaccactccttttctggcttgtccactgcctccttctgccctgacatcacatccagcactgatcaatgaaagtataatgtggccacatatttaattcaaaaatttctggaagccacgtttaaaaagtaaaaaggaacaagcgaaattaattttaatgttttatgtaatccaatttatccaaaacattattatctcactatggaatcaatataaaaattattaatcggatattttacattcttcttttcatactacgtttttgaaatctagtgtgtattttacacttacatcacatctcagtttagactagccacatttcctgtgcttacccccacatatggccagtggctttattgctttattggatagctcagctttagacacttgcaaaaacataggtcctactttttgaattcttttgaatatgactctcctcattgctactttcatagcctggccttgactctgtctttcttgtccattcatgcaatttttccaaactgaccttttaaagttgagattcaatcatatctcttccatgttcaaaacctccactggctcataatttctactattaacaacaaactttcctcaacttgacattcaaggtccatcatgatttagtccaagttcattttactatgtcacctatttcttactttctagcatgtagtctatgtgctcaccaaataattatcccagtaacctttgattcactccaactgccagtcttctgtttaagtttatgctgtcttcccctggagaatgccttttcccatatatgtatgttgaaattttacccatttgaaagaatgtctcttgaacttcttcctttagatctttttttagtccattgatttattgtaggtcccttctctgcaccctgtggcagtttgctggtacctatcttaatgtgaaattaacttatctcctcctctaaacagataatacatattttgaggacagaaactttgtctcattcacttttatattctttctgttggtcgatatataatagattatcaattaatacttatttaattgattgcaattaatgttaacattattgtggcctggaaagaataaataaagtgccagattcaaaaaggcaaaatgggtcccttccttctaaccaagtcaactttatttcaaagtttgatcagtttaactgactgatttctactgaatttgattcctactgaattgtattggttgaggaaagatcagatagtgtttaaagtaaatagatagggggaaaagaggccgagcaatgaagagaaaccctcttgacaggatctataagagggtgggctggcaggctgcagggaaagtcaattaatctttgaaggagcctttaggattagggatgaatcattaaccctgtccattgtgtcacagtggggctctagtacttaggttgatgtaacaacatggggtgacttcgggcaatttatttgaatccaagagccatagatgtgcccaacagcaaggcattaacaatttgaatttttttctgctgtgctgatatgccatttgatatttgtgacgtgacttttttgatatgtttatatcatagagaaaaattaattttccatatttaaactacatatggtaaaaatatagcaaaatgtagtttgtatatcttgtaaatagtaatttttttgacataattattcttagctaggtatgtttctgcctttatttccaagaaatatccttagcttttatcttggaagatagaatatcaaaaggcagtatagcctaatggttagggacataggctttaaagttggacaactttaaacatgaatctgatgtttccatgtatagctgtgtgacaccagctttccagctagtgatttattgtaaggttattcagcttttcaccagtaaagtgggtatacaatatcttataggattgttgtgagagttaaatgagataaagtataggaatgaatatagtagtgaatatgctttcaaccgcactatccttaataataaaaaattaatgactcaatataaaatatctgcactacaattagaagttatttactgagtattacacacacacacagatgcatgcactcatctctaatccttgcaataatgatagaagataggaattactgtattacaaatgaggaaattgcatttcaaaggttattggcttgcccaaggccacatagataatacataataacaatgctggcatttgaatcaaagtatatctgactctaaagtttatgttttatctgctagtaaaagtagggaagcctactactttttttccaatatcaatcgtatcaacaaataattattcaattgaatgtttgatttttgacatataagttttattaagtttttttttaacagatctaacagttcttaaactttattaacatattagattcttcttcagagaacaaacaacactttaccatgccacaattgtaaggcatttaatttagaggtatttgtgttttatattaacagcaaatttgtagcacaattttattttctgccttttaattttagtcctaaacatgtctctgttatatattatctttgcaaacatttctaatggctattatttcataaacttacattttataaaaatatttttatgtttctatggaaatatgaacaactgaatgaaagacagaaatataaagtaagtataccttagaaaatcagggaatcataatttctcccaattttactagtaattttgcaaaacattttattgttattgtagtgtttaatacagtacttttagcatagtattactaaatatttgttgaattatttaaaaaatataaataaatgtgatatttattttaacttccttggattgcatactaatacatacaaacattgtgaaactgttctgatgatgattacttaaaaaatgagttctcagtttggccaaattattataggatagctagagtatgtccagtcatctcactggggactatcagaatttattttagattatgattgactcaaaaggttctcctgtactctgggcatgagatagcaccctctttttaaaaattgttcttagatgtctttgaggttcatgaagcaatgtcactctctaaattttactggtccctatataaaacccaaagtttggaaaacactaatctatgtgacaaagagatgattagtagggcctaaaaatcatgaatgaatgtggtgtctattttcaagttctattttcctaagttttgaaataactggctgttaattacagtaatgtcttcacagctctcacatttgtgcatgtgctacttctttccctcactgaaaagtgaaagatgaaaaagtttgactgtataaaatgagcccaaaatttattcaattaaatggaagagataaaatatttaaaacagatatattaaaacaaaaaaaaataggctggatgtggtggctcacacctgtaatcccagcactttgggaggctgagacaggaggatcaggaggtcaagagattgagaccatcctggctaacatggtgaaaccctgtctttactaaaaatacaaaaattagctgggcgtggtggtgcgcacctgtagtcccagctactcaggaagctgaggcaggagaatcacttgaacctgagaggcggaggttgcagtgagctgagatcgcaccactgcactccagcctggcgaccgagcgagactccatctcaaaacataacaaaacaaaacaaaaataaaaaaataataaaacaaaaaaatctaaacagacaggatcactgtgtagggccagatatcatccactgtcaaaattaggaacaattaaaaatggagtaatttgttttcagtggcaagttcaacattccacatcaaaggccactgctgctgatggttatggaaaaaaaaaatctctaaagatgaacatgaggggtcaggaagcgtcactctagggcacctaacaagtgtgctttggggacaaagccagtcaatttgcaggtccattagcagctcagctctctatccagttccttcacgcttaccatcccctgccagccaagaaaaccagcaaccccagcggcagacactgtacattcccaataccaagataaaaattgactttactttcatgtttcttcttttcttccctttagttttactaccaattccaaaagtatacacctggttttattatctgtgatattttttaattgaggttttgaataaataaaaaatgaaacaaagttctataaggataataatgaagaatcattcttgcatattttatggttatgaatacattgagaataatcagtccattcctactgacatggatgtacaaagcgtgatgctaaagagtttttgagatgcaaagaattgtaaaacagggtacctgctggcaaagaactttcgctactcatcttaattatttaataagcattttactgagggtcccgttgctaactaggccctcgggtacaatgataagcaaaaaccttgtatcccacccttgctcagaatggcttggctaagtaaaggagaacataattgagcccacaaatagattttacacacatggtagactgtttgattttaagttacattttaattttttgtagactttgatcagccaaatcttggttttcagacatgatggacaaaagctattatcttatttattagtagtgatttagtgggttaataaaactgatacggcagctgctcttatcatagcaagttattgcaagtccctgaacagcttaatcccatcatttccttatcagttatcatttgtgtagtgtaaactaacatcagggctactagctcagtgggaacatatgtttcaggaattctatataaagactgaaatggaaaagaagaaatatagatgcaagtacaaattgttcagcaaatgaagaaaagtattaggcacaaagtaaatattttagtagtaaaaaaagaacagcaataatttcatttttcatattaaaagtctgttatattttataacatgttcacattaaaatgtggttacaagcattaattattcttttttcataaattttaaatcagatctgtcatttgacataagattgaggaaagttgctaataaatgaacacaattttcttagataatcatagaagctgctttcatgacacattttcttgaagagattagctaatcatccccaggattttcgagcatttatcatatatcttctttaatagaaatggataataatcatatagggagaaggaactgtgaaatgtttgggaatctttattcagagtaacctacaggataagcatcaggtagtgttatataaatttaaacaactatttcttccacagtgagacaaacatcactttttatttaacatacaccagcatatcttcttgttatattacagtatgcatggtaaatactccctagcaagatttattttagggtcatctattaaccacaaaataatgctataaaatattgcaagtgagatgaaaaatttatgtacactttgcatgaactctctctccccagttttatgaggtttatctttagtgactaggaggacagaaagctgctcatttattatctcttctctgttctcagagactctaaatcactcagatgacaacatgtacctagttagactaaaaggaagattaaaggggaaaggttattttgttggctccagaagaaactgggtatgaaatgtgctaaagcattacagtggtcattgcaaaatactgaggtttgtattgctagcaacagtctttccaccaaagtacaccaatttcatgccctttatatatattgtttacgtatgcaacttttgttcaatctcagtgttttactgatgacctggaaatgcaatgtcagaaggtggttattgaaaactatcagctttaagaaaatttgttttattgttttctaaattcctagaagaacacattgatttaaccagtaaatgtatgaggatttttcttcgtactaatttttaatgaggaatacagtgaagggaaagataaaattctcatcctcgaaatcttagggtttagtatgggaggtaagccatgtatacaaatgccaatgatacaaggacagagctgtatagggtaaatgaccaagggaggagttcagggagttcaggagttttgcctgagatatcaggcaaagcttcatgtgttaaaatatgccttaaactatgattaagaaatgaggacctgatggaagaagggtattcccaatggagagttcaaaaaaccaaaggtaccaccgtggctatggcaagctatttatgaagagcaagtcatcctgatagtaatagtcaagtttctacagtacctgtgatagggttaaaggagttagtagacttccttacatcatgttagataagagattctttaatttctaccaaattttaaattgtggtgatatgtttaagtatatgatattatatgaaatctcttaattggcaaatgtttttatggttttgtgacacattgttatttttaatttttcaagttattcattcatttatctaataaatgtttattaatttcctattacagggagcttacattctgcgagtttatacatgaaatgtcaaatatgaaacatccagatcagtggtgtgggtcttaataattcatgttagttatctatgcttacattactcctgccaaacaagaataaagtgtgtgtgtgtgaatgcagacatatttgaactgtatttcactagaactttctaattgtaaataaaattgcaatacaaaagagagatatcttttgcatcttgagtgtggaggcaatatggtttgtggaatcatgggtttaaattttgccttcaaacccataacatttttaaacaaatcacataatttttgaatgtctgttttggaatggggataatgctctacttgccggctgctgtgaaaatttgagatcatgtacacatacaattctttgcatgtaatagatgctcaaaaatggtaattatttctatcatgactcactatcacctgcttcaatggtagcaaatattaatttggtattacaattctctgtttgcattatttgttccctcacaagactgttaactcctccagagactctcctctacctctctttcaatcctcagcacatggcacacagtgagcactgaatacatgtaggaaaaaaaagagtgtactctttcactggttctctatctcctggcatgtatataagattgtatgatagaatatgctcagctacatcaacatatctaaaatctaaggcattgctaataagaaaagtacatgccatttctctcttgtagagctgagtgtagctgaccaagtcattttcttcaggtgtcagtttgtgtatgggtttatagtgttatttacatttgacttatacataaaatacatacattaattaaaaagcacggttttttgagtatatataaaatagttacttttgtattttggatgtaggtagaggcattaaatatttctatttgtaaagatattctgtcctaatgactggggacaggaataagggggccaaataatataatcatttataacaataagaaacaaataaattgcataataaaacattctatccttaaaagtcgtaagaaaaaagttacacatctgtattagttaggatttatttagtcttaaaatgtagcaatttttttaaaatgtgaatatcaaatggttttaaaaactgcaagtaaaatgtacctcagtgctggtcagtgtagtcacttttccatgacagcaggcatcagaaggccatagactatggaggaatttggaaatatggatattcctgatcagattttcaatgtctgttttgttcatcattgtactgacaactagcacagtggtcagggcacagtatctgctctaatattttttgaactaatggccatccctttgacttgtcttgtgatttttgtgtaccacctgtgaagacagtgtagtttgttctcaatctgcatggcaaaccattttaccacgctgaaaagaggattagagttgagaaacaagaaaattgaagttataataaaagaagtttatcaatttttaagccaacgtttaacatgtatttctttagcaagtggctaaaatgtagtatttaaactataaagcttatagaacaaacagcaagctttgcaaaaagaacatgaaattacaacatctttccattctaatggatctctgttttcaaacattatttgatttatttcttctaatatgtaaacatttcttttggtatcttagttctaaaatctaacaaatgaaatattagtaattatttcagactctggcttattaactaattctactaatatatgtgactatcatctaaatctgctaatgttttcacagttttaaatatttctcttacctatatctattaatatagctcctttggtaaagtctttatgacttaagtaagcttctttcttttcgtttctaattagagacatactcagtttagtattttgaagtttccattaagttttccatttccttcatttctccctttgttccattataccttagaggttctttttttaatctaccataggatttctttttctgtactgtaaaaatgagcagttatgatggtccttttttcaggttaacagactataattgtacatttaccaaaattgaggacttgaaaacatcttcccagtcttccagaatcataaaatatcttcatttaccttgaccaccatatattattgtttcccaaatatgacaactctttctgaaaacattagttataatatttgttgctgctgttgttgttttgatgtttaaaaatcctttttccttcatctcaaatgaccttgaatcagtagaggcaagtttgctgccacagtcctgcccttagcacctgagaagagagaagccatttctgggcctcccactttggggggctcattctggctgtcatccagctgctgtcctcccatgaggcagggagtccatagcctgagtgaatgtgtccatccaaaaaccacatcccacttctgggtccctggggccctggaattccctgttcaactccccaggcccacttcttgggcctatattgggcatgtcccaagtccatcctcagaaggccacattgcttcactagtgttcataaccctagactgaggtgtggtcagggggtagctgttagtaggtgatgcagatgcagctggatcttggatgtgcagtccagttccctcacagtgaacaaaggagccagagctgaaaaatggggtgaaagtgggtctttccccaccaccatgttcccatatggaactccaggagtctaagaatgctaaattcatatttacctactagaccattatggaggtaacttgtcaatgtaagaggacaggaatatttttgttagctgttcattagctcgatttatagttttcaaatagctattcatatggtatgtaggcttccatttgtactcccgtcctggatcctgaaaatgcttaggagtggaacttcttggccaagtagttctttattgctgaggccagagatagggcccttgatggatgaacggaagattcatccattcaaccagatggatgaactgaggattcagatggtggctcctcagtttaaaggatccactttaaactcagatggtggtgctcggaaacaacgttttaaaatataattaggctgatgtccactggaaatcccctcattctcttttttacatttctttcctgatcctagatgaatgcaaattgaaggagttggtaaacagtaggtagtggtgctttatgggggatggatggtggagagtggagactgaccacagaaagcagatgctagaggactctgactatcctcactaaatgcccactattccactagcatgtgtataatatttgtagtgtttgtatatgggtgtgtaatatgtcaagagtttgtgacttaggagaataagccataatttgagaatcagtgagttgctatacttgtattgtgtctcatgatccactggcatatttaaaacaaattatctacagcactgttactttccacatgtcattttcattgatttgcaacatagccttctccccattgttgcatgaaattttgaagtgaaaatagtagtgaattggacttttgattcctcgtgaggaaaataatgtgtaaagggtcacatgtttcatacatattcccatgtgtgagattggtcttccctacacatatggtaaagaaaaccatagcattttcttgtccaattgactaaattcatgttgaatcacccaatttgtaaatacatacagtacatatacttagagccaaagcctacatttatacattattgggatttggaacctaatgttttagggtatgtaagaggattgtcagtaggtaattctcatttttcaagcctagagtcagaaataacaacaataagtaggagtagtgactatcaaagaggaatatagcacattaagatgctgcctacctgaaaaatgtcagaaaagaaaggtcatcagggtttgcagttcttattcatggttatgtcagttataccttagtctctttttcccctccaaaaatctccttcactaacacagagctggttcctgtctttgctctaggtatcattactatgggattggcatcaaagagagcagtgcatattaccactccgtttattctggaaagggcttgacaaggtagagttacaccatcttcaagacaaattctctgtgtttctttaaatatgcatgatacctattgaataaaatgatttcttaattttgcttatcaagatgtttccatttaagcatcagaccttaatgtccgctttgtatggatgattatataatctagattactgggaaaattatataacttgtcataattagtgagaaattaattgtgaactagtgttccagagagatgaagaggagaaatcaaggaagcagaattgcttttaaattagtatttactaataaagcaaagtctattttcaggttggattcaataaaacaaaggcagtaaatgtaaatgtaacttttttctgagacaacctgttttaaagatctatgtgcttgactagtaccttaccaagatagaaagtttattgtaataatctctaatcacatatactttgaccatcctcttaccttatgagggtgaaattactgacctgtttgggtttctatgaaaggtaaaacatgaatgaaaataaacagcacattgctctaagccactgttaactatcatggggatattagtaagtgaggttacatctaatgaaaccagtgataacacatcattcattttttaaactgaaactctgaataattagatgtgtatctgagattgctttatggtacgatttaccaagaattgctcttagctcttaaaagaagaaattatttttaaaagtaaagtatcttgtggaaaaaaaaagtttagtcactgagtcatactaagataaatttagatattacaaggaacataaggctgcttactagccaccaccccactataaaatgtaaatataggctggaacacacacaaatgtttaatagtgagtgtcctttacttgtctcaaatctcacctggcttttaaaaatattattcatttactttttttctaaagaacttattttgttttagtaagttgagaaagatgcttgatttctttaaaaaaagcaaatttctccagcttatttctctaatcatggtatgaaattactgcttctttaggttgtctacatatcattgaatgctatagctgtaattttgtttgaactaatggaaaatgtactaattttttaaggttttctggaagcaagctaaagaatgaggtaagaattattttcatctctattttacatctgctataatatgtcttacaagctgagcaatacatgttaattattccctttggcaaatgtagaaataaatgttatttattaggaattccttgacgaaggacttcagatacagctcaattagatttgggacaacaaatgaatctttgcatggatctaccaaacaactttcagttaacctaggagagatacatttttagttatctttacctaatatcagatacttacaagactgtaaaaaaaacactatcatttatccaaaaagtttccacttaaatataaacaaaaagcttaagctgaggatatggaaagaattggtctttggactgcacccatttagacaaaacatttattagttatcaaggagcccaaatgctatgctacactatggtttgttttactactttgtgtacacacacacacacacacacacacacacacacgtatacaatctttctccctaggcttcctctccaccccctccttcaagaacagactttatctaaatgagttagactaccattagggactgcatgggtaattagacacatgataaggccttcattattctcaagttaactaatcattaagaagaggtgctgccaagctaagggcacatgacaatgtgttgtgtagtaaatctggacctgaggtaaagtgtaactccattagtttggtgaaatgatgcaagcatattttaagaaataatataaggcccccaacccactaaatggccaatttctttccaccagtgcttttaatacagttaatggctaattacataatataaatcctccagattgctctttttatcaatgaaataatagctctttattagataaacaattgtgaaactgcaaaaatattgacttagagatacactttggttgagtaaagtttatgtcaatagggaatttacgttatttctctcaggtgttctttctactagtttgatgaggctggtggtactagcaagccctctgccgataaatggcaagccttgtttcatggaataaaagaaaaatatttctcaagtctactttttcctccttagaagaggacactgcaaatactgttgtagattttgttactaaaattaaaatattctgattaagctctatagcctaaccattttctgtggatacctgaaggcaataatagtgtaccattactttgatgattatagaaattaacacaactaagagctttctaaaggctcagaactactctaaataagtttaaaatgataataaaatattttcataacacaattgaaatttttaaaaattattttctttgggaggctgaaaaatacaaaaaattatttgggcatggtgatgtatgcctgtaatcccagctactcaaggaggctgaggcagcagaatcacttgagccctagaggctcggaggttgcagtgagccatgattgtgccactgtattctagcctaggcaacagtgtgagaccctatctcaaaaaaaaaaaattgtatttagggcgaccaaccatcgttggtgtgctcagacatgactttcagtgcaaatcttcatatacgtcagttcatttgaacattcataactgtgaggtatggtgtcagcatatttacagctaagaacaatgaggctgagagatgtatttgcttttttaagaggtcagagaaagattctatttttttaaagccatggtcaagatattaattaacagatgtattacattacaggtactaggagacaaaatggtgaatgaagagatttggtcctgcccttccagagctttacagtatagcaggaaagcatatcttgaacaagtaattataagaaattctagagggtgtcatgggagtaactaggtttagggagttaaggacattttacacaggaagtgatattaaggaaataactcagaatatagtggtagtttggaggaggagtggagtaggggaagagggaagaagagtggttaagacagatggaatagcataggccagggtttctcagcctccatactatggaaattgtggttcagataataatgtttatggaagatatcaagtatattgtaggatgcttagtagtatcacagcatctctggcctctacccattacattccagtagcagacccccacccccttgtcgtgacaaccaaaaacgtctctgacattgccaaatgtcaactactggcatatgtgaaggcaagcaagaggtgtatcatgttgtagaaaaaataaaaaaaattctgcttagctatagtgtagaatgaggtagagagtaatataataggtagaggctggattgtttgtagtctcattaggttaagaattctgtaatgggaagccactaaaggggaattatgcatcagacttggtgttttataaaactcattctgaccatgacatggagaatacattagaagagtgtaaggcaggaagccagtagatccattggaggctatctggatagtctgtgtaagagaagatctggaccagaataatagcccaagggatggagagaagtaactgattttagttgggaaatattgaaggagaagcaggaagaaagagtaaaaagataaggggtttaatttgggacttgtcatatttgatgtgtttgtgaaacatttaacacaaattttaagtgggaagttggatatatgtgattggaaaggaggacttcaagatttagtttgatggtgattgaagccatggtaatggataaaaatgcttagggaaaaaatgaatgagaagacaagaggttaccaaaaaaaagttgtgaaaagtgagagaggaagagtcggtgagataacagaggagagtctagagtggtaggaagagaaggaggagaatacagtgtcacaggattcaggatgaaaaaatgctccctacagaagggaatgctcagatggtgctgaaaagtcatcaagataaggagtggaaaggatccatggaattagttaagtggagataactaatgatttcagggagagcctttccagtggtgagctggggtttggtttgtgaaatgagtgggaagtagcattgaatgtagaacatttagtcaagttcagggtgataattggaaaggacttgggatttgggattttttgtttttgtttttgagacagggtctcactctgtcacccaggctggtgtgcagtggcacaatcttgactcactgcagcctcaacctcctgggctcaagtgatcctcccacctcagcttcccaagtagctgggactacaggcacacaccaccacacccagctaattttttggaatttagttttgaaggatgattagactaatgtctaatgctaataaaacaggaacagtaaagaatgaagactgaaaatattaaagaaaggaaagttgagagcacaaggtcactgaggaggtcagtgtagaggaattggccctagagaggaggagcagttcttccactaaaactgaaaagagaaagggtaagttcggatgcaagcagatttgtagatttttgtggcagaaagttgaggtagcttctgtttggtagttttgcatttctctcaggaatggtagtgtaggtcatgtgctgtggcaaaaatcatggaaagaaagtaggagtttgaggaacttaaaagaaagtcctagctattctcaaccaggttttctagagagaatatagccctaatgccctaagacatccactgaatataaggaataaactctgtcgtgcatgagtgtttagaatggtattgattaagcaccatccttgagagaattgaaaaatggttgttcaaatcattttctgtaggacttaattttctcacagatttattgagatggtagcaacagtctttgtggaagacaagaaagttagaagattgtaaaatttaaatggcatgagccagaagaaatgcaaaatattcaggaacagttataataagagaagcatactgcctatttggaaaaaaaaaatacaggcataaaagaaaactacaagtgaaatgacataccatgtgcctggataggaatgctagatattataaatattccaattcttcctaaattaattcagacattttatattataatgaaaatttgagtgggtaattaatttttggagatgaatatgttacgagcttaatctagaagaatatacaggaagtaatagttaagagaaatgtaaacaagaagagtaaaaaggggatttgtctgccacatatcaaaatattatgacatgatactgagtcaactgtagatagaacaaatctgcagcagagtttaggtacctgacaaaagaccctagtatttataaggttttagtgtatgaccaaacagaaattacaacaaatgaaggaagaaaatatttttctgtgtcctttttggagaaaggtggagtactatataaataaaattattcaggaggtgttagaaacattgaccattttgcaaaaaaatttctatacctcacaacttatgtgaatttcatataaacaattaaatataaaaataatacttaggaggaaatatatgtctaccccacttctggaaggagttattcactttctaagcataaaagcagtttaagacatttcataggaaaaagaaaaacacacacattggaaacttcttcatatcaaaagcatcatatgcaaaatttgaagtcaaaggaaaaactgggggaaatatcttcagcaaacatgacaataaaattatatccatagtacataaaaaatcctataaaaatatgaagaccacaataagtagtagaagatgcgaatagatgattcacagtagaaagaaaaagctaataaacgcatgaagaaaggagtaccaaataaacaaaaattaagataacattttacaatatgaaactatgaaatatttaaaaattattgggaagttggtgaaggtaggatgagataaactctttcatatcttgctgaaggcagaatgaatttttggaaaatgtttggaagatctgcaccaagtctttaaagtatttatatcctttcctgctaattctacttttgtatggattttgtatgaatcttttctttttttttgagatggagtcttgctctgtcacccaggtcggagtgcagtggcgtgatatggctcattgcaacctgcgtctccagtgttcaagtgattcttctgcctcagcttcccgagtagctgggattacaggcgtgcgccgccacacctggctaatttttgtgtttttagtagagtcggggttttgtcatgttggccaggttggtcttgaactcctgacctcaggtgatctgcctacctcagccttccaaagtgttgggatgacaggtgtgagccaccgtgcccggccttgaatctatttttatttcatagtgaaatctatttttatttaaaaaaaatttttatttcactatgaaataaaaatagaaataaaaataaaataggtaaatttcatagtgaaataaaatagaaaatgcagacagaaaattatgcacaaaatttttattgattacagtgagaaactatatgtaacctaaatgactaatatcaaagaaatggttacataatttattgtacttttgtgtggctgaatattatttattaaaaggctcttttaatgatatagagaaatgttaattataaaaaaaggacacagaagcaaatatatgtgaaatatgtaaagcataactgggtatttacaaattatatacagttggtccctggcttaaaatggtttgacttacaatttttcgactttgtgatggtgtgaaagggatgcgcattcagtagaaactgtacttcgagtacccatacaaccattccacttctcactttcaatacagtatttaataaattatgagttatttaacacttcattataaaataagctttgtgttagatgattttgccctactgtaacctaaggtaaatgttccaagcacgtttaaggtaggctaggctaagttataatgttcagtaagttgggtatattaaacgcatttttgacttacaatattttccaattgtaatggttttattgggatgtaaccccattgtaaattgagaggcactgtatgacagagaattaatatctattactatgttgtaaaatattgtagctgctagccacatgtgactattaattaagtaaagtaaaaaatgctcagtcacgttagctacatttcaagtgcttactgtattggacaggaaagatacagaacatttccataataacagaaagctctattggacagcactgttctagaatatgtatagaattcaagtcaataatgaaaagacaacccaacagaattatagcaaagtatatgaagaggcaattaattcaggataaacaaagaatgactaacagtgctagttggcattctggttgaccagtgtccataacgtatgttgaataccaccccttgccaataaaaaagtgctcaatctaaatattaatcagggaaatgaaaattaaaaccctaatgtgtgattgtctcacatatattacattagcaataactaaaatgtctaaagacacactgttgacaggaatatggaccaaaggaactctcaaatagagtagaagggacaatatctagtgaagttgaagatttacacactttatgactgcattcctaaagaaaccttcacattgtgcacaaggaggtgtgtatgaggatgttcactgcgacatggtttataattgcagaatactcgaaaataatcaaagtgttcattatgatataatgggaaataagtttttatacatttatacaatggagtgctatactgctttgggtatgagcgaatgaatgatagttataataatcaaattagggtcatctcaaaaacctaaagttgagtgaaaaaagcacattgaaaatacaaggatacatagtgtattataccagttttaaagaacagtataatattaagaacatttacatactaggtaaattttttaatgtttgagtagaaatgatctaaaccaagcccagaacactatttcttgtgggagaagaagggaatgaaattaggcaaggctgctttagtattggaaatgtctcatgtcttaatcaggatggtaagtgggtatttattattttttctctatatcttttaaaaagttttaaatagttcaaaatataaaagcaaacaacaacaacaaaaaacaacaaaaacaaaataaaaaacaggaaaaagatggtaagagcgttactacttagtattaataattgttactgttttaaaatttttattcataaatggagtggtttaaatttcagaaatgtcttagagattgtctcagaatctgttaattcacaggaataaaacaaatgaacaaaacttaattataatattttctccccatcaaagaaagcttttcttttcctgtgggtcttctaatgtgggccaaatttttgtttcaagcagctagtgaagttgacattatttcttagggaatgggtccattgatttcatacatttctaccaggaagtttccttgatagcctgagttttcttctccttaacatcaaccgttcacagccagttgaacaactttgtaccaagataaatatcaaatcctccctccttggtatatgcttttcaaatatttgtagactgttatcatactctcctttgtcatcacttagccaagccatgcagcttaagtcctttaatctttcctcataaatcagaccctcttgccttctagtcatatttgtttcttttctgtagggtccttcttgttttcttttagaaatacgattcttaatagttcacccaagagtaccgaagttatcaattgagaaaggaaaaaacaaaacaaacccagacctctgtagctggcctatgatctggcacctcttttagtacgattgtaatagcaaatatattagtggaattagaatgagcatattttactattttaaagatgatcactcctctctttttgtgttacacttactggatattattcgatttatgcaatttatatgatctttgtatccagttgttaacatccaaaacaaaattaattttaaggttttttggggcccttttgccccttcttgatgttgcacatattgctagctttgattacacaaaattattatttaccaatatgagagtttttaaaagtattagaattaaagttacatactttatttcttaatatgtgtttctttagcatgctaacattttttattgggaaatgtgttattcacagcacccacccaaacacacaaacacatgcatagaatttttaaaataatcataatatgaaaactcaagccctttctcataacttaaaagagaggagtcctctgtgcacccacttcaatcactttttcctccctactcatcagaagttaccactctccagaatatggtgttactgtttgtttttctgtaaagtttgccacttacaaatagatctctcaacaacatattgtttattatttgcccagttgtatcctacataaaaataggctccttgttttccctgtgactttctgttttccttcaatgctaggttttgtgattctttaatgctgatatatgaagttctaatttatttgtactgctgtataatattccattgtaggaaactatcccaatgcgtttattcattccattgtggatgggaattttttttttgcctgaaaaacaatattgacgcaaacaattctccaggtagacatctataggagttgaattccaggtcccaagatatactcatctttaactttactagtaaaggtgaaattattttccagagtggttgtatcaacttctgtctctccagctgtgtgtgatcattacttttgtaccttattcttatgcttggtattaaatgacattttagtttttgccagtcttgtgggtgtaaaatcatgtctgtgttttttatttggaaattgtttttaacaactgatgagctagaatatatttttggatttttattggtcgattcttttctgtgaaatgtttgttcagatcatatcgttttttattttgaaattttaatcttaagagttctttatatgttctggatactaatatcctgtaagttatgtgttgtaaataacttcttcctgttagtggcatgactcaatattctattgtatcttttgatgaagatttttattttatggttagtactttttatatcttgttttttaaaaatttgtgtatattccaagattataacaatattctctataaattactttgaaagcataaagttgctctgaacatttatttcatttgtaattggtttttgttcatatttttattgtggtaaactacatataaaatatactatctcagccatttttgagtgtacagttttgtggtattaagtacattggtatcattgtgtaaccatcaccaccatccaccttcagaactctttcatcttgcaagactgaaactctctactcattgaacaataactcccatcttccctctaccatgtccctggccactaccattctactttctgtctctatgatgtttactactctagaatcctctttaagtagagccatacagtatttgtcttctggtgactgacttatttcacttaccataatgtcctcaaggttcatccatgttgtagcatatgtcagaacatcattcccttttaaggatgaatgatatttcattgtatgtatatacagtaccacattttgctaatccattcatctgtcgatggacaagtgggttgcttccacgtttaagctacagtgactaatgctgctatgaatgtggatgtacaaatatctctttgagatcctgctataattgttttgggtatatacccagaagcggaattactgggtcatataataattctatttttaatttttgggggaactaccaaactgttttacatagcagctgtactattttacattctcaccaacaatgcacaaggattccaattttttcacatccttgacaacacttgttatttttgctggcgtgtgtttgtgtgtgtttttgtgtttatagtagccatcccagtgggtgtgatgtggtatctcatttagggtttgatttgcatttccctaatgattgtaacattgagcatattttaatgtatgtactagtcattcatatatcttctctagagaagtgtatatcaagtcctttgcccattatgaatcattttgtttacttttatgttgttaagttttaggagttctcaatatattctgtatattaatcccttatgaaacatgatttgcaaatattttctctcattccatacattgcctttctactgtgatcatagtgtcatgtacagttatatgcataacttttatgaacaaaagtgtttctttttttttttttttgagatggagtctcactctgtcaccaggctggagtgcagtggtgcagtctcggctcactgcaacctctgcctcccgtgttcaagcattctcctgcctcagcctcccaaggagctgggactgcaggcgtgtgccaccatgcccagctaatttttgtatttttagtagagacagagtttcaccatgttggccaggatgttctcaatctcttgacctcatgatccacccacctcagcctcccaaagtgctgggattataaatagttcatgaagaactattttttttatgaagtacaatttgtgtaatttttgttgttacctgtgttttagtgtcctatataaaattttttttccaaatcacatgtttccttctaaacatgtttcctgtttccttctaaaatttttatagttttagctcctacatttagatatttgattcatttttggttaatttttgtatatgatgtatgaggtaaaggtctgactttattcctttgaatgtggacatccagttttctgagcacactttgttgatagaactgtcctttccccatagaattgtcctttccccatagaatggttttggcacccctatcaaaaattattttaccatatatgtgaggatttgttactggcctctctgttctattccattggtttatgtgtctgtcttcatgacagtaccatattgttttgattactgtaactttatagtacgtttgaaatcaggaagtcttctctgactttgttcttctttttcaagatttttggctacccagggtcccttgagattccatagatatttttaggatggatttttctttttctgaaaaaactgtcactaggattgcattgaatcattgaatctatatctcactctaggcagtattgctatcttaaatattaattcttctaatccatgaacatagaatgtctttttatttatttatgtattctttaatttctttcagctcttttatgtagtttgtattgtacaagtctttcacttccttggttaaattagtttttaagtattttattctttttgatgctattgtagatgaaattgttttcttaattttcttttcaggctgttcattattagtgaatataaatgcaactagtttttgcatgctgactttgaatcctgctactttgttgaatccatttatgagttgtgtgtgtgtgtgtgtgtgtgtaatttttaggggtttctacatataagattatatcatctgtgaacagagattttctacttcttccttttcaatttggatgccttgtgtttttttgtttttttttttttgcctaactactctagctaagacttctagtaccatgttgagtagaagtgatgaaagcagacttgctttgttcctgatctttgaggaaaagctttcagtctttcaccattacatatgatgttttctataggtttttcataaacaacttttattatgttgaggtggttttcctatatggctggtttgttgagtattgttatcatgaaaggatatggaattttttcaaatactttttctgtacctaatgagattatcatttttttattccattaatgtgatgtaacacatttattgatttttatatattgaaccatccttgcattccagaaataaatctcacttatttatggtgtgtaatcctgttaatatgctgtggaatttggcttactaatattttgtggagagtttttgcatcaaagttcataagggatattggtctgcagttttcttgccttgcaatgtctttgtcaggctttggtatcagggcaatattggcctcatagaataagttacaaagtactccttcctcttcaattccttggaaaactttgagatgtattgatattagttcctctttaaatgtttggtagaattcactgctgaagccaactctggggcttttctttgagtgtgttggttaactactacaaatttgtaaattttccagttttctgctattatttatttccaagttcatcccatgttggttgaagaaggtacattgtatgacatctatcttttcgaattcactgagacttagtttgtggcctaacatatggtctatcctggaagatgtcccatgtgctcttgaaaataatgtgtattctgttgttgttgggtagattattctgtatatgtttgttcaatatagttggtttattatgctgtcacatcctctatactcttacttaacttctgtctgtttgttctgtccgttattgagaatgaggtgttaaagtctccaacaattattgtaaaactgttcatttctccctttaattttgtcaatttttcttcatatattttgattatctgttattatctgttatctgtacatacctgttattaggtacatgtacataaagggttatgattattagatcttttttgcctaatcaaaattttgttaatgtataatatccttgtctgttacacaccttttaaaatttagagtctattttgtctaacttcattctgccaatatctgtcttccaattggagagattgattcatttacatttaaagtaattaccattaatcaactcctcattatcctccattacccactacactttctagcatcttgtaaccactattctattctctaagttcatgtgatcaaattttttatctcccatatacgagtgagaacacgtgatatttgtctttctgtgcctggcttatttcacttgccataatattttccagtttcatccatgttgttgcaattgacttttaaattgatcttgtattcagcaactttgctaaaaaaaactttattgttaaccataatttttgtgtaatttgttttagtttttcaatgaaatcaattacatcagtagcaaataatgctaatattgtctcttccttttcggtacttaatctgtcattactttttcgagttcattattattctggctacaaactctggtatagtgttgagtaaaaaaggtgagagcaggcaaatttaccttgtttgtgattttcaagggtattttaccactaagtaagacatttgctgtgggcttctgatagatattctttgtataatgattaagttttcctctatttctagcatacacacacacacacacacagacacacacacacacacacacacacacagagggattgagagagagagaggctaatgaatggtagtggattttaaacaaactttttcctgcatcagttgagatgattatataatatacagcattctcctctgtttgttgttaatatgatgaatttaaacctgagtatgattgtacttatatactactgaattttgtttaatattttgtttaatactgtctttagtaataagtgaaattgaaatataatttttctttttctgttcttgtctagttttgacatatacgttttcaagtgaattgggaagttatccttttttctattgtcagaaaaaaatctagtaagcttaaaattgtctgtttcctgaatgcttgataaaaggtcacctgttaaaatcttttgagtctgtttttttctttgtaaaaggatttttgattactaattatatttctttagtggaaataagagtattcctttattcctaactgcgatttaatatcatactgtgtattatcattttgggagtttatatttctctgtttctcttttcctatatcaccaaatcacatattgagatgaataaacatgactttccacacaagagaaaaaatatatgaaaagtgcaaacctttctaaaattaagatttaggtaaatttttgttatgcttatccaacaaatgttagttttctgttttgtcatataacttccttcctttaaggattaagttatttattttcttgtttcctatattatttttccctatttattgacagtaacattccttgacagtgcaatgataattggtgctcataaatggaaaagccaagcattgaaagtctttgaagcatttcttaaattaagatagattaataaatagagtggattgggattaactatgctattatatcagtttatgataattattaaataatagttattaattaaaaaattaagaatatacttgaaaagagattaataaagtaaaaattaaacataatttttaaaaatgaatttctactatattttaaatataaagctcatttaaatctttttttttttttttttttttttttttttgagacggagtcttgctctgtcacccaggctggagtgcagtggcacgatcttggctcactgcaagctctgcctccagcttatttaaatcttaaataagtcaacaagaaatcagggcttctaaaatatctggtgttaaaggactcaaaagtactcccagttcccttggctctacccttataagttctagaaagacaggatgggaacccaacctgtctatgacagtaattaagtttttgtctactaaacatcttcaatatgacagagataaacaaagaagtgcagtctagaaataaatgtgagaaaattatgagaaagaacaaaattttgtccttgccagggacactttatgtcctttattatattcataatttcattatttccccaaacttttgattacaatctggtttgttaaaattttgtttggggaggaggaacaatcagttatggcctgggagactgatttgctgaggctccagttctgtcatgaatatgtgtttgttcttcctgtgtgggtttcctgtaagtataccagcacagtagcattataagttatttgtcacttttctaattttctgaaaatagctcaagtatgctttctccaagagatgtgaaagaacaacacatgcctgaatttagggtagaagaaacttactgtgggagagtccagtgcactagcttgagaatcagaagttagactccaataaaaattttgctagtaattacctctgagactgaataaattattttacgttcaatcatctcatttacttaatttgtaaaaaggaaggttggatttgacaattcctgatcctcttatagttaaaataatttcagtagtttcaaaggcagatcttcctaaacttatgccattagcaaatgtgtacttaaatttctaaaagttgtgaaaactgacaaatattcaaaactaaaatttgaagtgataggaaaaatattctaactatgaaactattgaaggtttgaaaaccatttggctgacatgtctcgtttattcagttacacaatctaaacagtctactcaaatctcgtaaattctcatggtttgcaggatgaagaagaatgaaattttatggatttgtattttactagaatagtactttggaagcatatagttgataatgatgtatttgttttcatttttctaaattatagggtggcttcactcgtaaatattcgcttagctcaaaaactggaacacttcttccagaattccccagcgctcaacaccttgtataccaaggatgcatttctaaggacaaggtatcaattacagatacttctctattgattttctgatatgttggctccatatgtcaatttgctgggaatttcatggtactgcaggaagcaatcagaaatctgcataatcaaacataattgactgatttataggagaggcaaacttttgttaacattgattaacacttccaattaattatttaccatctccatgatagtgtgtaatcagaaggtggtaaaataaaccttaaaagactaaacattattttttatttaaagctctattgaagaagaaaatactagaatgtggctgtcacatacactttcttcagttaaaagttttatgttttcaattatctccattttatttcagcaaatggtcatcaagcatttctctaggacagaatctgtccctagcactgagggacatgctagatgaatgcaagaactatgctagatgagcatgaactttccttacttctaaaattctgtgttctcttatatttgcattttttaaagttaagaaagaatcattttcattgggattcagtttataaataattctcaatatgacttttcaatgtttatgtaatagcgtgtaaactatatcttcgatttctgtacttctaaagtcatttgtcggggatctgttggctgtttagtagcagagaccattattaaattagagcataattatttctacatttttgtttcaaccaaagtacatgtttcattagcatttgaagaagacatctcttacagtatattgagttagttcgtatttctgaggtacaaagatagaggaatatgattaatgtccagatgctttactttagtaatgggctttttgtagaaatgaggtaaagatagcacattgatttaaaaaaaatttattggcatataagtagagatgcatagtaacttacagggctcattttgatgacagccatactctgttagttaagaataggcaaagtattctttagaaagaatgaaaacatgtcttttgcagcaacatggatgcagctggaggccattaacataagcaaattaatgcaggagaagaaaactaaatactacatgttctcacttataagtgagagctaaacactgggtatttctagtcataaaatggcaacagtagacactggagactactgctggggaagggggaagagggaaatgggttgaaaaactaactattgggtactacgctcagtatctgggtaattggatcattcgtattccaaacctcagcatctcttggtatacttacgtaacaaacatgcatatgtaccctctaaatctaaaatacaagttggaaaaaaaaaagtaaaatatacccttaaaaaaaagaagaggcaaatgaagataattctcaaatgccaaatccaagggagtctctcaaactatgttcacttctgactgttctctcccattacatttctcaaggttatcacataatttttaccttatagatgtaatgtgtgatatgatgactttatatttgagaatcccccagtaaatgttaacatgtggcagtttgtgaggattcctgtggaaatcaggaggatctcagtcttctgagggagggtattattgggttacttttgtggagaggattgcttccatgcaaacttatcatgaagatgtttatggtgtaaatatacctggtgagagagagagggggaccaaaaaggcaagcaacaaagaagaaaggagaggtgagaaacaggctccaatagtttacctcaatagtttgctgggaatttcatgtttctctgctggcctccaaggaagttcatacctgccaatttgaaagactggtctgtagatcatttctcaggtatcaaggtgcttttataacccttggtttctaagttcattcccagtggactccatcatgaaagccagggactgacactcttttttgaggacaatttagctctgtcaccttccttgccattagccaggctcctcaggtaacttatcagttcctagaaagtgcggtggggctaaaatcaagcacttaaggtacctgcttctttttcttttttcttttgagacagaccctccctctgttgcccaggctggagtgcagtggcgccatctcggctcacggcaacctttgcctccctggttcagtgattctcttgcctcagcttctgtagctgggattacaagtgcctgccgacatgcctggctaacttttgtgtttttagtagagacgggatttccctatgctggccaggcttgtctcgaactcctgacctcaagtaatccacctgcctcagcctcccaaagcattgagattacaggcgtaagccaccgcgcccagccagcacttgcttctttaaggccgaaagaatggaaactgcccagtgaaaagctgaccccagtgagggtactgagaagctgggggcctgctactcatagtgtctctcgaggcagttgtctcccccaccacgtgctcactgtctttagtggagctaagccttgcctctgctcctgcccactctagtacaatgtctattctcagaaaattgactaagattatgtttataaagaatgcaaagtacactggaattaaaattcattgcgctaagactatgtaagtattaaataaacaaattaagtattatgctaattgtgagttttaaaaattttgatgatttgtatataaagcaataaattttgtaacaagtagaaatacttgtgaagataaaggcttacttgtactttaataggtttcagggctcaaaggattaattttgaaagaatttattgatatggaatagatgtacatattttgggggcacatgtgataatatgcttatataatttgtacggataaatcagtgtaattgggttactgatcaccttaaatatttatcttctctttttgctaaagacatttgaattgttctcttctagctactttgaatatgcaatagattattgtaagctataatcaccctacagatctatccaacaccagatcttatttcttctatcaaattgtgtatttgtacccattaatcaacttctcattattttcctctccccctcctctttccgacctctggtaaccaccagtctactcgctaccttcatgagatccacttgtttaggtcccacatatgagtgagatcatgtgatatttgtctttctctgcttggcttattctacttaacataatgccctccagttccatccatgttgctgcatatgacagggttttattttttatggatgaataatattcccttgtgtatataccacattttctttatccattcatccattgatgagcacttaggttgattccatatgttggctattgtgaatagtgctgccataaacatgggagagcagatatctctctttgatatattgatttcctttttctggatatatacagaaagggttaatttttgacaacagttatgacttcccttccatctttcgtgtgttactcatcctcattttaaacatatgacttggaataatctgaaaatataatagcattgcctgaaatatagagcaattctcatttgcattgatggtaacatatcctgctagaggtattctatagtcagcacagctccttcagatggatcaataatgttcatatcatggttctacagctctaagctaaaccacaaagatatgtgtattgggttgtgggaataaagggaaatgcaaagggttaggataggacacctccatcaccaccaccactctagatgctattggaatcaaaatagctgacatccatcagtttcttaatatgtactatggattattccaaacactttatatttgttaattcatttagtcttcctagcaaccctattttatagctactgttattatcatgtcaattttagatatgaggaaattaaagcacataaatatcaagtagtgtgcctaatgttacataactagtaataactagtaagtggcaaattagagctgcgattgaaatccaggtaatctgaaggcaaagctcacacattcaacctccaaacattgctttttttcacgtagagtacataactggcaacaggtagggaaatttctaacatgtaaaataaaagttttagtttgaatgttattaagtggccagaatattatctagttctagcctattgcaaattttagaatatatttaaaacttttaaactatgctatgcaaatatccatggtaacttgaaaagagagacttttcataatagacattcaatgtttgaaacttttttttggaaaatgcatcatttgatattattactaactctggataatgtttagtaaggtcttactgggtgccaggcactgttccatatgtgtcacatcctattttatttgattttcttaacaccatgtaagtaatatgttattactacctacttaaaaagcttgggagctcagagacaaagccacttttgcagtcatacctggtaagtagtgcagtgaaggtgggcacccaagttgagctgactccagagacaaaatttgaaaccattatgccatactgctccaagcatccacttcataaaactgtgtgaagatttgatgtattttactactttatgtttatttatccaaatctttgttactacttttactactttatgtttatttacccaaaaattaattttaaaaaatttaaatttaaattaaaaattaaattttaaaatttaatattttagtaggcataaaactaggatgttactttggtccatagtactctgaaaaattacctttttcatattatactgtagttgtccatttgtttgcttttctcccttcacaaggcagtaagatccttgaaataagaattttgccttaatttttgagtcctcaacattgagcatactgcttggtacgtaataggatcttttaaaaaatctgtgttgaacaaattaacaagaaaaggcagtgttaaaaggatgctttggttaagctttttcttccttgaaataggttgatacgctcataatgatgtacaaaactcactgccagtgtatcctggacaatgcaattaatggaaactttgaagaggtaagaatgacaaagaatgctttatttgaccctattatatatactttcatgttctgttcttaatgagttcatgttaaagaaaaaaatcttaacatactttttactctgcaactagatccagcattttttattacacttttggcaaggaatgcctgaccatctccttcccctgctcgaaaatcctgttatcattgatattttctgtgtttgtgactcaattctttataaggtaagcactttgggatgtcttaaacatgagccatttatttctttacgtagcattctatctaaattcttgcaatatattttcagtaaatatgttatttatggctggatatacactgtctttttttttgatgagaaagcaagcaatttaatagtgcacgtttaatagtgtatgtgttttaattgaagtttacattaagtaaaacaaactcaatttctttttacagctaataatgagtctatatgtgacacacttattaatatgtgaaaacttagttaaattttattaactctctaaggtgttttcagattaaaataacacagtggattttttttcacaatgccagtgttttggcagaaagcagaattaggcacccttatgagattaataacttgaaaatctcaaaaacctctaactttaatgcattaatgtctaattctcttctcaaaccaaatcagagttcctaagtgtctgcagaaggatctcgaagacatcctaaataaggacaaactgattgtccttctaggcaaacatttaatggaagacagaaagaggctaattcttgacagtctcttccctggtggctacaagttctaagctgatggataaaactatattgcaatgtgggtactttaaagtgagtttgcctacatttgctttctaacttaccataaggaaaaacaaaagctttccttttaaaaaataatctgagttggcaagaaaacccaagctggacgctgttaaacatttaggaaataaaatccttctaagttagttgccactatcagattctcagctttgcagaaaagtaaagcaaaagctatttatagataaactaagtccagaagcccctaagcagaccaagaagtaatgagacaacttgaataagagagtgcatatttttatcctctgtccagtacttcctcatcacaggataggagaaaggaggaataaagtacaatatattttctgcctttagttcaagttcaagttgaaaaaatttcagaggagagtaaggattgtcttgtttttttttttttttctggattgaatatgaatgccattatttagagaaaaacagtttaatttgcattaattgtttgtaatgcttaacacttgacaaggctcccaaaaggggaggggaggcagctccgtgagtgagtataagaaaagacctggggctcatgcacacaaatttccatcagaccaaagctttttggactgtcattcagtttgtccaagaaatacttttaaaacacacttctccctttaagtgatctgttttttttagtctagtataaacatcctgactttaaatatctttaaatgaacctggtttctcctcctcatggtggacccagagaggcacagtgagctctgtaagtagaacggtgtaagatgagcttctacaaaaatcttcctcccacctctagaaagtggtcagcttttcatcataaaacggtatatgattaccatggaccaatccattggtaattaacatactgagcatgtacatatacagtgctatctcttgtttttattgtcatacacactcacacacaactcatacatacattcattttggagataaaattataactttgagaaaggagttaacatgttattctctaggaagctaggaataaaaagtagttgaccaataatatgtctttctatagaaatactaagtaaagatttgtattaacctcttttgctatgattaaggttcttacagatgtactcattcctgcaacaatgcaagaaatgcctgaaaggtatgttcagttaataaaacatgagcattcctagtataggatttaactttatacattatattagaagaaaacattaggtagtaatttattcatttatcaagaagactattttctacttttgtccctttgtatttgctggaagagatgtgtcttatagctgggcctcaataaacaaaatgggtgaaacaatccttcaatccctttaatttgagagcggctaaagtgaaaaatagatttaagcactgttgatcttcgagaaatttttcaatggaaactagctggagtatgataaaaaagataattaatggaaaataaccacaagaataaaaactataggagaaattattgtattttattattaacttttgtcttaattacaaaatcagaaagtggcatgatgaaattactgccttcttttaacaaaggaataaaatctcaaatagtttattgaaacaataccagaagatttttcaaaaaaaaaaaaccttttcaatataagaacaatagaattctgaaaaaaaaaagccaactttttctctgaaaacaaaatctaatgaaatgataaaatttattttagtattttgggggtacaaattcatataggactggacatagttggtgctccaaaaatagatgttgcttggtaaaacaaattttactttttatttaccttttcctccagattatttcatctatatgatagttggtattagcctgatcaataatgtcttttaattatcaattgtagtctttaaatatctattctgtactctgaattgggtacttgaagtggagtttgaagagcttgagtgttttgaccaagatgataacaaaacatctcatgtaccccataaatatatacacctcctatgcacccacaaacattttaaaaatatagcataagaaaagatgataaatggcagatctaggctgtctgacttcaaaagtactgcttatgaaaccatagaataatagtatacctcaattaaaatatgattgtttaatgcattttttaacaatgaagcatttaacacatagccttctttgtagcttattagcagacataagaaattttgctaaaaattgggaacagtgggttgtttcatccttggaaaacttgccagaagctctaactgacaagaaaatacctattgtgcgaagatttgtatcttctctgaaacgacaaacatctttcttacatcttgcccaggtatgttggttgctaagtcgagagcatttgagtcaccatataaaaaatgaatcttctgagaaggacagattgaggaactttcatagattgaagggagctaagtagacaacaactaaatgcaacgtgagacccagaagtgaatgctatgatagaaaaagcacattagtgggaaagctggtgaaatttgaattatgtctgtagttaatagtattgtaccaatgttaatttcataatttgggtaatatacaatagttacagaagatgataagaagctggatggagagtatatggaaatattctgcactatctttgcaacttctctgtgattggaaatttaaaaaacttgaatgcaattaaacatttatttgccatgtgaatctaattggtacaaattaaggttgtgagaagtaagcctgtgtgatacttaatattgtgaaaccacaaactcaacacattttaaactgccgactaatcatggctcttttaaatagagcaaaagtaattcataagttaagaatgatgcatttgtatattgttaaaatatatttctctttccccaaaatgattatctgctttatgaaggtttcttgccttctaaattttaaaagacaagcttgagatgatttcagataggaaatgtaacatttaaaaattcttattttgtgatcatggacaaagagaatccatttatattttctttttctattttttattatactttaagttttagggtacatgtgcacatcgtgcaggtttgttacatatgtatacatgtgccctgttggtgtgttgcacccattaactcatcatttacattaggtgtatctcctataattttcagacttttaacagagatgatcatgagtctcagctactgcttttgtctttaaaataagaaaaaagttatttatgatacttttatctcaaggaactatttttctgatagctaaaaatttcttctagatacattagaaatgatatagtgtagtgtcttctttactttctctatgcagattgccagaccagctctctttgaccagcatgtcgttaattctatggtgtctgatattgaaagggttgatttgaacagcattggctctcaagcccttcttaccatttcaggcagcacagacactgaatctggtatctacactgaacgtaagtccattctctttgtttagaacaaggttttctaagctcagaaaattgacatcttgagctgggtaactctgttggaggagcctgtccagtgtgctgtaggatgtttagcagcatccttgacctttacccattagatgacagtagcagcctcccccaagctgagacaaccaaaaatgtttccccacattgtcaaaggtgttctgggctgaaaaatcacatctgattgaaaaaaaacctggtttataaaaatatttttaattaaaaaaatttatcttctaataaaaaatagttataattactcaccatggaaaagatagaaaatattgaggaaaataaaagtcatctgtaatttcattacctagaaataaatgaaatggaaataatctgaaaataatcaaattgttttgagttttgtaagttttctttcagttttacattacatgtatagaaatttacatgtgttttatagtcttgtcatcctgtggtgtgtgataaatatcaaaatggtatctcagcacaatactgcttttcaaagcagactctctactcaggtttggaccatctgagagagcttaccaagccaatatgcatggctagacaactaggcttgaatttcaagggataacagccactattttttcctccctctgtctttgaaaagacaaaacctgcagcctcctatacactggagcacaaactatggactgctctctggggcccaatctcaactccactttttatttcctaacataaaataggattaccttttgagattcagtaaaccttaaaacctttaataaaaggatagtcttaaactgcccttttaaatattacatgataaaacgttattcaggtaaatggctcaattctgctgagaagaaattaacttttactaaagataaaagatattttggaaagcaggaaatcaccaagcttaggttcattcattcacttttaactaatctgttccgtttaatgaaaacactagactcaaaatgaatatttaactacataaacaacttaatcttccctagtatgtgaatacacatataagatttaaacctatatttcaatatataccaagatatatacacttattaaaatttcgggcacacttcaagaggctgaggtgggaagattgcttgatcccaggagttcaaggccagcctgggcaacacagcaagaccttgctctataatttttttttttttttaatttaggcaggcttgttggtgcgtgcctggagtcccaactgcttgggaggctgaggcaggagggtcacttgagcccaggagtttgaggctgcagtaagccatgatcacgtcattgcactccagcctgggcaacaaagcaagatcctgtctctctctctctcacacacacaccattgaagagtacagtactaaggatttttttgttactgttttcaagatatgatattaattcttttcacacatttatctgtctttccctttcatgctatcaaagtattgatgattccaagttttaggttttctcttggattccaagtagagtacaatattctgttttcttttctttcttttttttttttttcctgggtagatgactctatcactgtgttccaagaactgaaggatctccttaagaagaatgccactgtggaggcttttattgaatggttggatactgtggtagaacagagagttattaaggtactttttaatgacagattcagaaaataagttccttgtaaagagtaaatgctaaactggctataattttttgtctggggggagaggggtggaaggctgtgtgtgtaaaggctttgaaaagcttttgatgctctacgaataaggcaggccaaatactgaaattaggaatatgtcaagatttgagagcattgggcatggattccattatatttctcctttcttgccgaaagactacaagatgctctgccttccctatcagtcaataacattacagctgagtaacatcagtagagaaagataaacttagaaactggaatgatctggcccgtttctaaaaagcaagatttcataaatgctgatggaaaacatggttctaagcatttgcatttctgaattccaaaagctcaatattttgtgttttctctgtggtttcttcaccttctttggttaacctagtcacccattgtgaaacaagcaataagaacaaatatatccatcactagttggtgttggccattccatatcaaggagactagttatagtttggagacttttttccttctgtaaggaaaatagattatcattcagtaccaaagaagtcagagttaatcattcacaaaaatatatagcccttccttcacacctcaccttctgttctttttaaagctctgtcaaagaaaaattaaaaaataaaaatattttgaaaattatttcattttgttgtctaattctattaggaaacaaagccatattgaataaagacttattacccttaaaacatcagcaaagacaggctaacattaaattccctggacagatagttttatttgatgaaataaatgccatgccatctgtccatttgttagacagtctatttacttcttgatctaacacaggatgcatgtagtactgagaggacggattttatagtttcattttgttcctttacttttagaccagcaaacaaaatggaaggtcattaaagaagagagctcaagactttctgttaaagtggagtttttttggtgctcgagtaatgcataatctcaccttgaacaatgcatccagttttggtaacatacgtgcattataaaactgttcttacatgaattatataatttgttcctcagtcacagttcctgtcaatttttaaacatgttacatcatcacttcttaaactgtatctgaatatggagctatgagaaaatggtatttatgagcctgggttttggagtcagaccataagcaggattaaatcctaacaatgattgtctctggctatgggccaatctgctcattgaagaaggggaagaatattctcttcgaagggttgtataggtactttggtgagatgatgtatataaaaacaaattgcctagcactcaggaaatgcttaatgcatagcagctattatcattacattccatcagtgcttggataaattttctttgttaaacaaatgataattaagacattattttccaaagttattattcattgcaatacggcaaatttctgcagcttttctgagcacccatataactgcactccaggaatcaaaaaacagcttagaagacacactgtcatgtttctgacccatctttcctgttctatatgacttgggagacaaatagggttaagttagctttttataaaattgaatgccttctttttccttagaattcctgagactcctattttatagttataatgttaactcatgagtagtaactctgcatttggtagctgcatttcaggaaatcttcacattatgaaagagattacaattaactaaattgtttttatttaatgttctatagaattaaataaaatcagtgaatttgtattgaagaataaacaaaacacattgtctattatttgaaatagacttcccatatttaaagttttataaaatatacagcattgaagcctggccttactacgaaaaatacttttgttggaaaatctattgaatagttaaaagaagttttagttttccagaacatatttcacttgaaaattactcttttagtttttgccaaatctaagaatattttgtttcaggctagaaagatatctctttacttgacttttttcagaccatgttggccattgtctaattatttagtacaaagtaaacagaaatagagcagagtagagctcattctccccaagttgaagcttatcacactccaatgtgtgccctcttaaagcataaagcatgtctcactttcatccgtattttcctttgatgtaattagtggccaaagagctggcaggacagtacacacagtgagcagggcaggcaatacacagaaagattagagatccaagttaagcatgttggtcttagcaggtcatttaaagtccaacaagtatttgtttatttcagttgctccttgtaaagtgttgcgagatggtcacaaagataactgacttctctttccctttccttctctttctctcccctttttacatttcacactgtcctctcctcattctccatccataaacaaggttcttttcatttgattcgaatgcttctcgatgaatacattctcctggccatggagacccagtttaataatgacaaagagcaggagttacagaatttattggacaagtatatgaagaattcaggtaacttaaaataactgttttgttttgcatatttctttgttttaatcttaagttcaagaatttataagttcagatattaagtgggtttatcataatctcagagtttttctccaaacatgtcattactaattctcaccatacagtcacactattggagcactacttttctttcattcattgctatgtagtcaaaagtactttactggaaactctgaagtatacaaaattggtgatcttaatttctgggaattaaggtgaagttggagaagtgactataatacaaaaaataactgtaattcaagacacatgtggtatactacatatgtaagtggtgtaaaaataagttctataggagtttagagaaggaaggaaacacatctattcaggatagggcaacttgcattttgaagacttcactccaaactggattatttagtgctccttatctacatccacatccgcaaatatgcagctaaaaaaaacctagcatcactgtcaagagcaaaggtctgccaacctcacttcccatgggaaacattgcttagtagtttccagattaaatactcaacaatgaaacattttcattttctttttacttgggtttatctacgaggaatgtgagaaaaaatctcaaatttcccattttaaaaactctttccagatgcgagtaaagctgctttcactgcttctccgagttcatgctttctggccaaccgtaataaagggagcatggtttccagcgacgctgtgaagaatgaaagccacgtggagacaacctatctccctctgccatccagtcaacctggaggcctaggccctgctctgcaccagttccctgctgggaacacagacaacatgccgctcacaggtacgctaaagagaactgcttaggctccagcacatctcagagaagcctgttgcttcatttttcttaaaactcataacttccagtccaggaattccaacaataaaaaaggatgatcttaactgagttttaataaagatttataatatttttgtgattttcagcaatggtaataatactgttattaacacaggtatcatgtcttgacacactccataaattatattagaagtatgaataattagttaatttagtggaagaaataattagatgaggtatacataaaattcttaagatgctttgaagatcaaaaaaatgggttgcttatttctggattttgaggagactttatttctcctcccttaaaaagtagtttcgggctgggtatggtggctcatgcctgtaatctcagcattttgggaggccgaggcgagcagagcacctgaggtcaggagtttgagaccagcctgcccaacatggcaaaaccccgtctctactaaacatacaaaaaattagccgggcttggtggcaggcgcctgtactctctcttgaacccaggaggcggaccttgcagtgagctgagatcaggccattacactccagctgggtgacgagagtgaagctccatatcaaaaaagcaaacaaacaaacaaaaaaactggattcggccattttaggataatcgttacaataattctcccttttggtctaaggttctctttgtgtcaacatgaatatttggtggcttgaactagctactcgggaatattttaaatctgcttattgccttgtgtcttttttgaaatctttttatatacattacttcatttgatatacagaattttaaacctagaagagccttatagttcaggagtccatttctaccaatggaacactggcggcccagagagttggtggcattcataaatcacattacttataagaggtgtttgcatgacattttgaattgactgctttgaagccatggccattttgacattagtgactttttctttttaccctaaaaatcaaacagtttaacaatcagctaattttttaattatggggaaatatgagcagcagacacacatgtcctccccatgctacctgtggagaaaccatgaagccatcgcagactttcctctgtagtcaccaaatccacgtctccactgttgtgatatatacatgtgttgtgattatattttttaaattctggatttttggtgcttttcagtttagttatttttggagggcaggaatgaagcaagctggaaaacaatacattaataaatcttttgaatattttttaaagatgtgagctcatctactttaatatgacactaaaggaatgttctggtgattttttccaggtcaaatggagctttcacagattgctggtcatctgatgacaccacccatttctccagccatggcaagccgaggaagtgtcattaaccaaggaccaatggcagggaggcccccaagtgtgggcccagtactgtcagctccatcacactgctccacatacccagagcccatttatcccactctccctcaagccaatcatgacttttatagcaccagctctaactaccagactgtgtttagggcacagccccactccacatcaggactctatcctcatcacaccgagcatggtcgatgcatggcttggactgaacagcagctttcaagagacttcttcagtggcagctgtgcggggtctccatataactcccggccaccgtctagctatggcccatccctgcaagcccaggattcacacaatatgcagtttttaaatacaggaagcttcaatttcttgagcaacacaggagctgccagctgccaaggagcaacactgcctcctaattcaccaaatggtattgatatttaaaagaatttttcttggtttttgagatggcaatgaggcaaaatcagacattgcgttccacctctgctgactagcatgtcctttcatttaaggcttccaaagatcatggaatcttagacatttggagctgatttctgtcacatacatatatatttcctaatttttgtggctttcctaaagttgcccttcttcctttttttttttttttttttgagacaaggtcttatgctgtagcccaggctggagtgcttggcaggatcatgattcactgcagcctcaaacccctagctcaagcaatcctcctatctcagcttcccaagtagctgggactacaggcatgcatcaccatccctgtctatattttaaattttttctagagacaaagtctcactatgtttgcccaggctggtctcaaactaccaactttaagcaatcctctctccttggcttcccaaaatgctgaggtgcctcccaaaggtgtgagccaacacccccggcctaaagctgtcctcctaaataccgcatatgttaaaaaaaaaaaaaagatagttaaatcatatgtttgagacctaccttaatagccccaaagaagaatgttctgtcttttgaaaacatttttagtggataatatttcttcctgataactaaaagcagattttaaagattgggaacaaaacagaccaataaaaataggaagttaagggaattagagagacctgtgaccttgagtcaccaaaataggctttgtgtgtaggcttctttggtgtctttctcctaagtgtaggccagtctttgtcttccctaaacatgcatctatacatgaaagtagtatttttgtgacaggcgatagtgctttttttccttcaaaggtagatcttgttaatttagataagggaaatctgacagaagtgtaatctggtcttaaagttaatacaattcttatgtcttaaattatgtattatgctataattattgtattaaattatgtatgatgctacaattcttatgtgttaaaaaacacaaaaaacagcacagtaaaccttatccatgtacaagcacaaatccagttctgtagcatgtatagatacacatgtaatacttacagtttgatatctttaggacgtcacctcattactttgtcacttttttccttcctgaaagttctttgtagtaagttaacagcaaattctcaacattttctgttacaggatactatggaagcaacataaactacccagagtctcacaggctcggatcaatggtgaatcagcacgtttctgtcatcagcagcattcgttcactgcccccctacagtgacatccacgatccacttaacattttagatgacagtggtagaaaacagaccagctcgttttacacagacacatcatctccagttgcatgtcgaactccagtcctaggtaaattattttagcagttcttgaaaacattttaagaagttgttaacctcaggtatgcaacattacttgagggagatatgctgaggtgaactgagcaagcatgtttccacggttgatttattaccttggatctaaagttatattttttgtatctgactacacagttagtaacagtttttcatttcttattctgtatatctctattatgcaacctactgctagatctgttactttttacaaaaaaaatagctggtatctattaagtatgcaaaagattaatatgacctgtcaaatgcagtctaaaactgtaagttttaaaagggcagtaataatatccttttctcactcttgattagtgttggacccagttgtagtgccaagagatatctttaggcctcatgatctccatcagtatccaaaaatcactccaagattaaaaaaaactggtgtcctgtgatgggtgctactagcattttctcattcttatgtaaaatgtgattcaacacctctgtagaaaatgttgccatttttattgctctctaacatatcatgtaagtaaaaataagaaaaacgtgtgcttgccgtgaagcctcctggaatcttcttccaaccaggttacatttcttaatcctcatctatgaagaaattctgcaataataattagtatgttattagtaataacatagatttagtcactatagatttagtttctaaaaatactaataagatttcacagggcaagtatatattcactaagtatcaaagcagagtgttaatatttatatgagatggttaaagtcttccaatgagattgatttcagactagcataagtagagggcattgacacgcaaccagagcataagggaaaatgaaatcaatttcatctctcctcactcagtgtaccttcccaataattcaataggaagtactccttctcttcctgtcactgtcacacatgctccctgagcagaatctagcagctcatcttctgctatctgcaaatggtcattgcttctaggttactctaatgaagcagaaaattccacttcaggaagttttctcaccatgagactaaaatgtactgtgttgctattgttactattagttctgtttacctgaagagatagtggaagctttgacgaaacataggttaagagtagggtggagtctaagctttagtttatcagagctggcttacaagtagattacaaagtgtgctgcagggtaaaatgaggggatagaataagtggataagtagtgcaaggagaattgagttcaactatttcttaagtataaagcctggttcttagacagagagcacgtcatgtcagcaataagaaggcagcaaccatatatgagagaaatacagggctagtgagccagttaatgaattttattgagaaccgactaggagccagaccccattctagatgtgaggatatggtggtgatcaggccatagttcttgcctgtaagaagtttacattctagtagagggacagtaaggcaataaatacatgagcaaatgcattaaaaagataatgtcaagtactctgaacctgattaaatagagtaaaatgacagacagtaaaggaggagctgctttcggtaggacagctgagaaaggaatcctgaggcagaaacatttgagttgaaagctgagtgatgagaaggaggcaaagatgtgaagatctgagggaggagttccaggcagaagaaacagtgaatgcagaaccgctgaaatcagaataaatttgaaaaaatcaatgggcagagagcaggccagtgtgtcttaagcatgttgaatgaaggagagagtagagcaaaataaataaaaaatcaggggcccatctacatagggtaagatgcttggttcatgttccaagggtatcggaagccactatggcatttgagacgagtgaaagtttgatctactcttcagcaatatcattctggttgctctcgggaaggtgagtgggtgaaacaaaggtggagatcatgggaccagtcaggaggctgctgtgttggtccaggagagaaaagatggtggtttgaactacaaccgtgaaagtgcagatggaaagaggaggttgattgggggatatattttggcggtagcacttaagttgaaatggagttttctttgtgaaatatgtagaggaaataatttctgggagactagcaagtgggaacaaatggaagaaaaaatgattgctctggtaaaccatacagactcaaatttagaataggtatgtgtgctaagtgcaaaaataaatacagggtattaaaatgagtggcatttgcagagaaaagaaaatgtcaatcaattttcaattgctgattatattttcccttacagcttccagtttgcaaaccccaattccttcttcctcatcccaatgtatgtatggaacttccaaccagtatccagctcaagaaaccctggactcccatggaacaagcagtagagaaatggtgtcctctttaccacctatcaacactgtgttcatgggaacagcagctggaggcacttaaaccaccaatgtgggagggggtgctaaaactttaaaaaaaatctctactgtgcaaatatcattattcactcagacttccataagagtaaataaaaatgaatatgcagtggctgacattgttttaaagtcactggtactatggacaactccatagtgaatggagatacttgcagagcttgtcatgcacactaagagtttaaaatgtgagctcattattaatcatagtttcaaaattatcaaataaaaccagtgaagatctgaagatgcaaacatttcaactatgaagatttacatttcactttctaatttattaaacatctgtgtgcctttttatctttggtttcttttaaaaagtatatttaatgcctttacaatacctttaatttattaggatctcagaatcattgtttactatcccttatttgacaaaaagtcaaatgtgtatgttctacctccaacggaaatgtttacaaggtcaagacttaattcaattcagacaagaccaaagttgcttgacttcaattcctgtgcattagtgtgatgatttctgtcacatagcagcattccgattctatgtaactgaatggagatgataagtgctttcccctctttatttaaaaaagattaaaaggaataaaagaaataatgtatggaaatatttttaaaggcttggtgctcttggggctggtactgtttctgaagaatgctggggatttactctttaatctcagctcctttggaaatgagattaaggagtcaagtagtgtggttaaacactataatttaaaaacatttgcatatcatatccatgcctatacatataaagaaattgtgaattgtagactatttgaaccttttcagatttagaagcagtcttttaccaagtactttcttatacattgaaagtcaatgagtgttcagggattagctagatgcaaagcctaattcagaagtgaaggaatcattacatataaattaatacaatttgataacactatctatctttctacctctgtttctttttcttttccatatgtcttcactgaaaggtctgttgtaaagttcctggcctgtggtaggagacttccataaactttacaggcttctcctatagtcttatgacaagcctcatattatttgtattaaggattaggttacactataaaccccaggtacatcgtaaaaggatctataagacccagatactcattatacatcatgatggaatttggtaaaacaaactgtggaatttttttcagcaagcaataaacaattatctgtggacctgtcagagtattgctaccatttgcttagttgtatgttcaacagtatgcagtttataatttaattaattgaacagaaaaagattatagcagtaacaaatcacaaagaatagcaaatgttctattctttgatctagaaatattgtagaaatacagaggagaaaattaataaagacttggaattaagtagtaaacaaaacagctttaaaaagcgtttggccataagtcttgaaagttaaccaaaattttaatgtatactaattaaatacatgttcagcctctatgtgtcagacacttcattatataacaacatggaagatacaaagatgggaaagacactgtcataccttatacatttttgtgtaacaatgtaggggtaatgtgatagaaaatagaagctcctagaggatttttgagtagaaaagcaacgtggggaaagtgatgtttagggaatatctaacactagttggagagaggggctgaattggatagcggagaaattagtctgaaaagggggctatttggaggttgtttctctcatctagatgtccggtggataaacacagagaatacttggaagcagagggaatgagatcagggagagagaaagaagcatcatttcaaaagaatgtatttaaggattttctctaaccctgtttgcaaaggatttccctaccctatttgtaaagcattgcagtgtaaataatttgccatatattgatgccctttttgtaaacgagagaaaatgacccagagcagggagaagcttacaagacatgtgaacagcatctctgggtctcatttgcacctggctgataacaaggtgctcaatcttgacgtcaagagacagatgactaacttgctctttttgccagacagtgggacttgagtttatctctgttaaatgcataacagtgtttctccatgcaggcactattggctttcaggcaggacagttcttttatctcactgttctgcatattgcacaagatttatatccctggctctcaaacactaaatctcaatagaactccctttcccagtcactgtgacaaccaaaaacacctcacattttttcaaatgcctctggagaggcagtgctagttctccttgaattaaaggtgacaacatctttaattttacctagaaggagcatgagacaatataatacctctctgcccttcagttacactcatcatttaaaaatggtttccttcatggatctaagcctgggtgctcaaggcattttctgatattcttgttaattttaataggttaaaggatcttgcctagcgttttagtgtttctgtttccaaaagcaagtatattatccctcaagtagtttttagaagttgtgaagtatcaattataaagtggcctgtttcagctaatgcttatgtgaaatgcaaaattaaggttagaaatcagaattcaaaaaatgcttgctttacaattcaattattttattttctttttcaatttttaaactttttgtagagatgggggtctctctatgttacccagatgggtcctgaacttctgggctcaagtgatcctcctgcctcacaaagtgctgggattacaggcataagccaccgtaccagacctataactcagtcctcgagtagtatttttcaaatgttatgttacggtgtggtggctgctatagataaaagacctattgacaaatgaatgctccaattcactcagtagattttttttttttttttagacggggtctcactgtctcccagctcgagtgcagtgggcgatcacagctcactgcagcctaggctttctaggctcaagtgatcctcccaaaactcctgagttcaagtgaccccctgcctcagcctcctgaagttctgggattacaggaatgagccacttcaatcctggcttcagtaaattcttaatagaatttagagaccaagaacctgttttacaacaacttaaaacccagctatgtcattaacatagaatcacatatcacaatggacctggtttattttcctctctgcaggtagtgttgcactaagaaaaattagaactctcatcagttatatgttcccaagcatgctttcaggtcagaatatttaaacaaaaatttaagctaaattcccattatagttgtaatgtaaaatcctttctctttgttcccctttcaaagaagaatccaggagaccctcaaggtctaacatgcccagagcctattttggaaatggaggggggatgattatcacaacgccgaaacagggaaggcacactggcatttagtgccaggaccatgcatgtgaatgtcctgcaatgtgtgggtcagatttgcacaatgaggaattgtcttacttcaaaagccaataatgcttctataaggaaatgaaggcagaccagtaggctatgaggtggttgccacaaagctttgcccaataatgacgcttcatattatctaacatctaactaatccaatcagataatctcagatgctggtgaggttgcagagaaatagcaacacttttatattgttgggaaattagttcgaccattgtggaagacagtgtggcaattcctcagagacttagaaccagaaataccatttgagccagcaatcctattactgggtatatacccaaaggaatataaatcattctattataaagatacatgcatatgttcattgcaacactattcacaatagcaaagacatggaatcaacccaaatgcccataaatgaaagattggataaagaaaatgtggtacatatacaccatggaatactgtgcagccataaaaaggaatgagatcatatcctttgcagggacatggatgaagctggaagccattatacttagcaaactaatgcaggaagagaaaaccaaacactgcatgttatcatgtataagtgggagctgaacaatgagaacacatggacacagggaagggaacaacactttctggggtctgttggggaagggcaaggaggggagagcattagggaaaagagctaatgcatgctgggcttaatacctaggtgatgggttgataagtgcagcaaacaaccatggcacatgtttacctatgtaacaaaactgcacgtcctgcaaatgtaccctggaacttaaaaaaaaaattataaaaaaaacatcctcaggaactgtgactgcaaaactcacacatagcctagagaaaaaaacaggcagaagagtaaggctgggagagggagacagagaaaagcagaggtagagagaagctgagttgtgagtagggccctgggcagcaatggttggccccctttggttggcctcctctaatgggacactgaaatgacagcttcccagacctgcagtagaaaccagagctgcagctgtgccatcttgaccaatgataaacaatgcccagttctcttctgcccacttacttgagtttgcccttggaaacttaaatggacgtggtctttgtatagtcactcaaagtacagctgctttaactatactaccaggtatactacagtatgtttcctcttctgtagaaaattttgataaataatacattagtggttcactgattttatttttcaacaaataaatctcttcttatacaaatgcagtccattaaaataggacaaaaaaatactgtcaattcttgaaagtcagcctaggtaatgcattttccttccttacccctccaaaaaggagacaagagaagagagagagagagagagagagagagagagagagagagagagaggaggcaagagaaggaggggaggggaataaaaaggaggggagtggaggggagggggtaggggaggaaaacctttgagatacatcttgtgaaacccaaacccgaagttctaacttttttaaaaagcaggacgcaaatgagagtgatatgtctgaactccctggaaaggaatattacagggacttcggtttctttataacagggagtgaaattaattgccatacaaatgttacaatagcagctatgagctcttgtaaggcctggagtagtaaactgttcacgctgtattttgaggatggatttacaatccagggtgagatatagaaatttatacaaaaaccttccagaaaagtaaacagtagtgattatggcatacaggacattttgttctttgggaaagataagaaatgatgaatttatataaaaggttattataccatctcattcaattattgaattttaaattaaatccttgagtttgtaaatggcagagaacacaacctgtccatttcaaaagcacactgattaaatgaaaagaaaataaattgtagttattccttgattataggcattagcaatgactggaaaagattggtagttgtaagcagactctgaggaatgatctattcactaattttgagacatttaaccgtaaaataaggtctctgtgttcttactgataaaaggctttaattagttctctaatatcaaaaccttataaatacagtttgcttttcactgatcttggctatataataccatcatagaaatgttttctattataaaaacaatttattttccacaacaagcaacatcaatttttacttagttttttaaagaatctaatccagctggagaggtctctgatttttcccaaatctctctttaaaaatctatattttcaaaaatattcatgcgaagtttatgaggataaaattgaccccttgttagtttgacccttttacttgtcatatgatgaggttgtagtagaagactctgtccatccaatgacatgggaagctttggacatataaatgtaaaataactctagattcttgttcctattaaaaacattatctcactatttacaaatatttcatttgatatcaatgtttaaaatctatcagttgcttgagtatcattttctttctttctttctttttttttttttttttttttttgagatggagtctcactctgtcgcccaggctggagtgcagtggtgcgatctcggctcactgaaagctccgcctcccgggttcacgccattctcctgcctcagccttccgagtagctgggactacaggcgcccgccaccacgcctggctaatttttttgtatttttggtagggatgacggggttttaccgtgttagccaggatggtctcgatctcctgacctcgtgatccgcccgcctcggcctcccaaagtgctgggattacaggcgtgagccaccgcgcccggcctattttctttctttttaaaaaacggaattaggctggacacagtggctcatgcctgtaatcctatcatattgtgaggctgaggcaggaggattgcttgatgcccggagtttgagaccagcgtgggcaacatagtgagaccttgtctctacaaaaaataaaaaaagtcagccacatgcatacctgtagttgagctactcaggaggatgaagcaggatgatcacttgagcccaggaggtcaaggctgcagtgagccaacattatgccactgcactccagcctgggtgacagagcaagaccccctctcaaaactagacaaatagccgggtgtggtggttcacacctgtaatcccagcactttggaaggctgaagcaggcgaatgaatcacttgaagttaggggttcaagaccagcctggcaaacacggtgaaacatggtccctactaaaaatacaaaaattagccggccctggtggcgcctgcaatcccagctacttgggagactgaggtgggaggatggcttcagcccaggaggcagagattgcagtgagtcggaattgcaccacttcactccagcctcggcttcagagtgagactgcctcaaaaaataataaataaataacagaattagaaaagccaatgcatgaatattgtaatgagataacgttgtagtgatctcaggttggttaagttttaagaaatgaatgtgttgaaagttccaagaaatagtcccttttatcccacattttaatgaatatgtctgctcacactggtgataacaagaacagacaagatttcttccctcatgaagctaatagttatgagggagggcagacaataatctaaacatttgcacaattaattacaattaagaaataattaattgaaaatgtgaaaagtgaaggctgctgagagaaatgataacaagagttaggctcatgcaggtgtgtgcaggacaaggtatagggcggggatagctggtcagggaagcttcttggaagaagcaacgtctaatctgagacctgaagcatgagtaggaagtgggtggtgatggggagaaactttctggtggagaaagagtggtggcgagcagcagaaccgcttgttcaggacaagaatccaacatgtgaggaactaaagactggtcatcaaagttgaaaagatgtggcagatcacagagagctagggagagcggccagaacgagtcgggagagcgactactgaggctttcaaactgtaatggtgatcttagcgatttattgttaaatgtgagaaacttgtgtgattgtgaagatctataaagaattagaagaggctggtaagaatgcctgagatttttataaactgaaatgctgaaacattttcatgatgagaacagccttgctctcctagatttcacagttaaaaattatttaataggctgtaagtcccttttatgtgtccaaagacaacacttaatcaagaaaattaatctcatgagtttttttgtggaagtttcaaattggatctcttttaaaaatgatttcagccaatataaacaagtttagtagaattttctattcttttcccctacaaacttaatcccagacatcctttcttgaaaaacacacttagataacaagaagaggaaaaagtatgtgaattcttttaaatggtgttttcctttatttctggcatgattgattttaaccctaaaattgaagagaactaaaggtgaagaggtcgaaaccaagatttttcagtgtgatgtagtgacttgacctcctttctcaaaatagatgtagagcctccaagtaagatttgggtgagaaacacacttacaaaagtgaaaaattaactacccaatatgatacccgctctaaagtaaagagaaaccattgtttttattagttaaaaacaagggtggagttcttatcaatcaatagtcagaataagggtcagagatttacagccttcaagcatctttaaacacactgaggcaaatatgagctttgtgggcagtttgttaatcaagctttgtcatttggctttgtgtactttagcttattaatgctttacacatgacctctatgaaaaaataaaacttttcatgttttttcatataatatttttatattaaaaatggcaacatttcttgcctgtgaatttcaggggtaatatatttgtactatctgctacccctgcctgctacacacatgccgttttccacgtgtttcttattgtctggacccctgtacaatgtattgtgcccattttgactttctactccccaaaggaagactcacctagaagatgtgcctgaaggtgacacctgatgtcagcatttttacaggaagcgggatattcagttgtctggggaatttgagacacttggacatcaagccagcagaacaaagtcttccgggggaatattgaacctcggatgaaagataaccccttagcatatcagtggttctcttacatactgatgttccccagggagtatatgggaacagtggccaagaactaactattaatcctagaaaccagaaagaattgcttgtctttggtccatgcttcagtgctagatggcttgacctagtgaaagtccagtatagcttttcttgggctccttgatttgagagtcagatgggggtgcagcaggcactaagatgtgtcaggatgatgtaggcaagtctcaagctttcccaggaaagacatctcttcaagattcccgtactcatctctgtgtcatagcactgaagtggctattcaagtttctattaaaatataatattaaaatataaagacagaattagctaaaatatgagtttaaggtagagaccaaatatgtataattttaaaactcttaccacagagtcagatggatctgtgtttttaaccacattatttgtgtgatgatttagataacttctcagagaaccatttttctcatctgtaaaatgggtttaataatagtacttatcaaagaaggtttttgtgagaattaattaagccatatagcatgatggttcttgacacgttgtacaggctcaataaatagcaatggttgctaattatcattattattcttcaaatcccatgaaatcagtagcagtagtaaaagcaatgcagaccgttcttttatgtctttatgtgtaacatgaactgctctattgctagagttgtctagtaagataacgtaggccagtgccaattaaataagaatttattatgtaaaagtaaagggaaaaaagcaaaatgtagtaaatcattaactactccaatgtggtttcatagaggtgatactcatgggataacaatatggtctgaattgttagatatgaaaataagattacaagcaatattttaaaacaatttgtttttatacatatattactggtttcatacaatcatacaaattctttctctattaatcagtaattctacaggagaattgtcaatgtttatttcagtctaattgtatttgttttcacagacctgcaataaagtcataaaaacatgaaatttgtccgtgaaaatttctattataaaaaagtatttttcatggattaatttttcttccttaaaagtcatttaaattaatagttctacaagcacatgtgattaaatttataacaaaaaattattaatgaattggacatttctaatgtcttcataactgcttagggacaaggtgctttctgatctcttccttattattataaggaagaccttcacgctagtcaaaaggccagtctcccaggccactaagctgtacatccaactgtcaattgaaaatctcccccaaaatgtcccccaggcccgtgaagttcggtgtgtacagacttggagccatttgcttcattcttgttgtattctgaccatgtatttatctccttgttatagtgccacaaaagccagaaacctgggaattatcctaaatgctccctcattgccccctcttctggtcagtcttttccttctaattatcttcttgagccctctcattctctttatcttcgtgtacaacccagtgcaaactcttcttgtcaggactgtgatattagcccaattcaatcagtttctccatcgtatctggagagatctttcttaaatacaaaatacacctctgctcaagattcctcacctgctcctctttgacctcggaacgatgcccactctcgtctgtatgagtctaaggttttttcacttttcctgcctggagctagtattgatcattataatgtatacacttttgaggacttcatctgcaattggaaggcttatagaatttttagatggcaaaaataatcaccgtaggtactgggatttcctttgtgttttgttgtcagagtagaaagtgtaggaatataatgataaaggatcaatagagatgaaattgcttataaaaatcaatagctttaatggctttaaatatttcaggacattagcatttgacacaaacaacattgaaagaaaccttatttaatggacgtttctggctcaattctcagtctctttaatttgtgacaaagtgatattgaaaagctgaggaaataccttgatagacccccatgacataaaggtatatcgagacttaattgaggcaaaggctgagataagaaaattaatacacaggaatttaataaactctctcttctgcccctcttgtgcttggctgattttttaatcttccggtataggtgtcttgttcccaaagaagtctctcctgaaactctaaactccaggttagtgttcctcccataagctcccattaggtccttccccaatatggcacttatgctatgttatttttctgtatcctgaactagactatatactctgggatggctgaggcaattttcaggtttattgatataatcctgcaataaatacatgattaattaaaattgcaagaaaacaccattaaactcagaataagagtagtcacctttgggttcatcactcaagatgctgtgcaccaaataacatcttgaggccagagacagtctagacaacaatcattgtcatctaatgggactagaattgcacaaagtatagaaacttaacggaggctggacttgccatggcataattaccaatctaaaactccttggggaagaaagttgtgttatatatgcacataaattttgtctacttactttttgtctttagatttgattttattttgaatcaacggcagggttgaaacacaagggggttctaagaactaatgtctagttatttattttcatagactacgctctcagcaaatattgattaatgcagtaattgattgattgattgattggggagaactggaagatgcctttgtaagtcacgaaacccaagtgtacatcctaaataaatgattgtacttttgctcaaggagacagatgataggatgttcactgtattctcaaagcaaaaaattagaacatcttaaatgaccatcaacggatggattttcaaaatgagtaagtgttcatccaatggaatactatacttgaggcaaaattaatgaaatctctacatattaggaataaattttgaaaagatcatgttgagtggaagtccagttcaaaagattaaagtccagtatttatataaatttaaaaataaaaccataaaataaaactattgtttataaacatacatatgtgatgaaaatataaatatgtgattgggaggtatgtatagttatatgtattattttcagtacatgattacctttgggaaaggaggcagggggatgagattggatgagggtccatttgtatgtgaaagacttggtttcatttttaaaaagatgcaaagcaaatataacaaaatgttacatacttgttcaggtacgatgatggatacattgatatctattatatttttctgtgtacttttggtaacttaaaatatttcataatgatttattaaggtaaaataaaaataagccataagaaaagagatcctattcagtttcaaaaattcaaatataatttacccattgatattagttgaacagtacagcagtaagtggagtaaaatatatgctattgaagttaaggggttatttaagtctcattagcaaacgtttatatctccagggaggctaattagtcagtaataaatgttttgttagagaagatggagaagactgtttttcctttgacaaaatacatattttttctaactataatacaaaagcaaaagatgcttagaaatgcataaactgacctctcataagtaaaaactataaaacataattttacacacatacacatataagcctatgtgcacatatgatttaacaacatgattctatgcatattggtttacacttatgtattatatgtgaacctttttttctatattaactagcttccttcgacagaaaattttggtagctgtgtagagtttctaaatatggatatttataacttacttaaccaattccctactgttggatatttaagtggtttctagacttaaaaatatataaatgtagtgatttcctggttcattggaaataatatggtttagaagatccttcaatccccacattttatttattgagccccaacatataaatacacagagttgattttttttaacataaggagtcatccaggtgatgagctaaattttttatgtattttcagcatgtcttatgtccaggagacaaaaccagtataacaccctggccacctattagcatgtctggaagttggcatccctagggtaggactacatccccacagtgatttttatctgcctactttggagatagggaaaagggttgccacactaaaactgttcaaagtgaaattcttaggggataattaaattgtttaaatattcttaaatgggaattctttccaaaatattaataatattgatcaatggatgtattcctctagtccttacaacaactctattaatatatttctattcatgatgaatgtcagaagaacctgctttttgatagttttagggtagacatagcaaaataaccttgttggcctaaattcgccgcccccctctccaaaaaaagaccttttgaaagatgaacatccatttgcactcaaattaactgtgggcttatctttggagacaggtagatgtgtgagaatatggcaacagtctaggtaagagatgatgaacacaatgcacaatggagaacatgagcaagtaaaatttaagtgaggggaaatagcattaagcaaccatgcttagtgaaattcaggcactatggaggtcgtgatttgatccactatcaagggcaatgtcacaattcattatttcaagttcagttaatattgatgaggtataaacacatggcttcctcccttgaaattatttcttcatgtaaacacacctctcaatagcctagcaacttgtctgccttctgctttcaaagctagatttatcatgcattcccttagataaaaggaatggttcagacacatcttcaacatcccttcccaaggtataaaatccaaatttctgctcacggtcagtgcaaataacctccaacaagcaaatacttttctgttatattaaggagaaaacctacagaaaaaccaacttgaactggtttttctgaggcaggtcttgtgtttgtgtttgttggtgaagtacaaataactcacgggagaaaaccctatgcaacacataaaatctgtatgtattacctggaatcccttaggctattataatttttataataggtgaagatgatactgcaatactgcaggtaaaagatggttaaggcttcaactcttgtgatgaatttgataggtttaaaatacttaataattgaatgctggggagggaaatggtagtaagagagacaggaaagaaaagagctgatctggagactaggtatgtggtgaggccgataattgagtaagaactataggaagtgtagtccttctgtcggagacattctggtgaagagcgacgagagacatgatgatttcacacagttttgtggtttctttgaggtcatgcctggactggcttatttccagtctggaactcaggggaactataaaggttgaaagtatgcacttgatggtcattaagataaggtgttagttaaaactgtaagtagtaaagttctttgcctagggagagtacatagactggccagagcggtgaaccaaaagaagatccctgagaaacttttctttttaaagaggagacacagagaaggcatccttatagagactgagggccagaactgggagaagaaaaagaggacagttataacttgaagtcaaggatgtggagagtttcaaaaatatgtgcttgtcaatagtggtaaacaaaacatagatgctccataaaaagtttgaaaaatatctattaggcttggcaatataaagattgatgggctttgctagggcagtttgagcaaaagccagtttgtatgagtttagattactcaatccaaatgtatgcaaatttaaatgtaaataggaagtgagaaaaggtagacaaatgagtatagaacactcgttaaaaactttttctgaacttcttgcacttgagaacatgggctacagggttaagagagggatgttttattttgttttttgactggaagaaatttaagcatgcttatgaactacagagaaacaactggcagaggaaggcattgaaggtataagagagacagaggtagtggatggggtggcagacaggaagcagtatctttggttgcatcagcaggacttgctaatatttttcttctcactgccttcccatggcactctctattcacatgctattcaccatctattccatcagattccttggtagcatctgcaacactacttatccatttatgagcattattcttccaagccctccctcaaaatccttgaagaagaaaaatgggatagccttggtgattggtgagtgaaagcagaatctacaccagaagtatttctctatttggttgtgtgctttttaattgctatatcggcaatcaagtgacctaatcagttgtgtatcccccctaatgatttggtattccttgcccaaaagcaagccctgttattaaagtgaaacagccacaaaaatcttcataaggtggagatttctacaaaattcaagttatgcacacatctcataaaactttctgactgcctgcattgaattagggtaggattaaggccactgtactatacacatgtatacagagaacacacaaagatatattacttttctggtgaagcaggaagttctgatacagcaataaggcacagacacatttaggctagtctaaaggtagatcttaaatttttggctttttaattacctagtgaaatgcacagtaggtgcatttcctccattgctaacccccagcccacttctcagattcactcatatacccccaggagtaacctggaggactgagtgaggtttagaaatgcatgaaggtgtccagctattacatgatcatttttataagctgaaagtttagtgctttgtcattttaatttcattaatgtatgtgaaatttaaaatggtcacaatgtgaaaattgcatgaaagcagccttgtcagaaggacacgtgacttccttagattactcagttctagcttttcctcattcttcaaataatcatactttctatcaatgaccatctccttttttttcttttcccatctttgcctcttgaagtctatggctgatatgacaattctttatcctctgcccctactccatggccaactatcactacctttcagcagtcattctagaagccttttctgaaatgatccatcaaaataccaaccaacaagtattgctaagcactagggactattattctgaggggtgggaacatagtttatagagccaacagtcactagcagctttgcttcattttattttctggcacttttctgtacagagaacgctactaacatttaaaatctgagttctgagcctcagaaacagtgcaaagaatgagacatgggcaagaaaggtgcttgtaccatcaaaatgacctggaagttcattgttgtttatagtttttcacatcagaaacttggatctgatgtattaacatcatttgaatgacttctatttgaaaaataggattcgtagagactctaagacactataaaaattttcttcaagtgcagaaagaagcatattagtagagcaaacacctatggaaacctgaaatgaatttcctctcttgtcatttttcttcacaaatgaagaacctttgtcctggaaacgatgattagcatatatctactgcaaagtatatgtgcatgttttggagtttcttggcataaaattgagatttgtgtcctctcttaaaatttaaagaagaaaaaggagaaataaaatgacaaaaataatgtagtaggacaagaaaataaaaaataaaataagcaaacaaacagcaaaaagacacgctatggctctttagatgaaaagaaatcagctaagcacacatttccattcacagaatggcagtttctacacatgcatattcaaagcatctttaaatgttcagttcctattgtagctactccatttctgtagatttttttttcttgatggtggcacagatggactcacaattggagagaatgtaaaaagattctatttagcaggtgaactaggaaagctgacctaccttcctctggcttggttgatcattacctttgatcaaataaaagaccacatgttccagctgcccttatgccctgcttactgcagtgagagaaggaagggagagaaagacagaaaaatagaaagaagacttagacaagatagatattatgtaaatttgcatatcatctgaaggcaagcatgtttcatgtgtccacattcttcattaaaaaaacaattagatgagttgaaaacagctcacaatacatttgtttactcttactgtagagtaaatgataatctcttgtaacaaattcaaacttctaaaattaaaaatgtcatgcaatatgttcatagaaaaaaaaatctggatgctaagataggcataaggaagaagagagtgaggggtgaaaagaatggatgtagaaagagagccagagaacaattattcttcatgacttcatattgaaaccttgaggattcagatatgcagagatccatacaaccacctctgccatctggccatgtgtagtaatgatagaattcgtggatttcttgatatactttgtgactttggaaaatgctatgctttaaggagcattagatactcaacaatatcttcttgttttccatttgagtttactacaattggtagatatttggatttagacaagatattactaaaagggaacattcaaaaaatgaggtttttgttttcccaaaatgaattttagaacttagttctcttctgaaacacacagaaagatacctaaatgtgatagaatatgaggagacagataacaaattagaatacatatcacatttttcttaaaaatactgtatgtagttttttttcttgttataagtataaataagaatatgttgagaggggtaatttggtatcaaattgttgataatgattttccagggtgggaaaattacagggaactttctgtgtaatgatttcctgtaatcattaaattttgttgactactatttttaattagaaaaaaatctaaaacattttgtcttataagttgtattaggagttggtaattaaagtataattacagtggctatcctagtcaatgctggataatttgctagtgactaggggctaatctgcattttctggagaattctgctactgaataggccctctgaacttgatggcctgtttgaacttgatgaatcacatttgagaacagatctaaccgaatacttgccttgtttttaaggaacttctttgaattatcccattttattggttttacatcaagcaggaaatgataggcatatattgaatggtgacagatatgcactcagtaaatttaagagttattgttgtaattgtccaaagcaaaatgaaagtcaaaatatagtagactattcgtacttttccaaaccagaattaaaaccatagctgtttaatttgaacaagaaaagggttttggagactgtgtctaatgaaggtaaataaataaacttggaatgtgggaagctctcaagtctgaatgacaaaaggagtgtttggaaggatgaaaggtcatgagaagcctgaagacagccctagaatgatgtcactctgagtatgagattgtctgggtctcaaagataagtatatcttctttcagtttttaaaggaaagtaaagctaagtaagagatttcattttattcattaacttttaagagacaaagactaagattttcaagtcgaagcctgaaaaaaatgtgactggacagagatgtcattttatttgatgtttccagggctgctgagacagagagacttgaccagtgtgcagtgtcccgatagaaacatgaggataaaactcaaagtgtattcttctgacatcaacaaagtcatttgctgaattctgatagtataatttcaaattgtaaagagaagaactttgtacctcatggtaacctgaaaccatatgtatctagtagtaaagattactttaagctaaatttgttaaaatggaatttaatggccataggtattcacaaaagtgaaatcagaatctcttcctaagtcacagggataacaagatcaaaatgtgtttttaagatttgtatcgcatccttgaaagttaacagtgtgattatattattgctgctcactttcaaaagctgaaagtgttctgggggaaagtggagaatatttggctgctgcaatgcatcattagtctctccagctacacctaaaaaaatgaatcaataagactttcacatcatacacaattgttacttagctgttgctgataaatttcgtctttctcagggagattttgtaacttggataaatagatgcctgtcattcattccacagttgcctcatttctgtgacttcttgaaagaagcatatcccatgtatacactgagataactttcagtgtatacatggctagacgatagcatttctttagcatggtattgtctgtaatctgctgtctccatgaagagcatctgcaactggctttgtcaaacagtcagactgacatcaaagctggggcctttgtgagccagcagactggcaagatgagcacagccagaggagaacaatcggtggctgaggcacagatgatgggttcccgtgctttctctcacatctgatttacttcatcttatcaatgctgataagagcaagaaaactatctgaactggacaaaggcaaataatagaatattattaatgcattcacataaacatctaaaagaatacttagaactttgtgagcaatatcaggttgatcttttaactatgaattgtgttggccacagtttttcctcttgagggattttaagacttttccacctcccatgtcactgattatggactgtgaagtaggatttttaaaattattattttagtagagtcggggtcttactatgttactcaagctggtcttgaactcctggactcaagcaaccttcttgacttagccttcccagtagctaggattacaggcatgagccacagcacccagcagaattctttattgtatagaatgcgtaggcagtgaataggaatacctacattgccaaaataattttcatttctttggaattctttttctcatgttagctttagttccttttcaaacatacatattttacatttttcatgattttctataaatttgctatcaattaggatagttatatatcctaatttgcccctaatttgtgagtttatatgatgctttttatacagaatttttataaacacttataaatgcattgtattaaaaataaaattatatatatatagttttcttaaacataaataggacaaaattttatgaagtttttgtttgtcttttcatatcaatttaataagaaccactgcatacatattctgtcacatccatggtttcaggataacatacatcactgatgcaactcaactgcatgcatacatttttagtaatttgtatgtgcccagcagtgtgcttttaaaggtaaattactcctcatcttccatcacaggataaaagtgattgtttacctattggtttcctggcataaacatggttttaataatagtttctattaatatggtcatagtaactccataaaaaaaaataaaaaacccttgagtttgtcagaggatcagtaagctcacaggagacactggatgcttttaactactttttttttttgagacggagtctccctctgtcacccgggctggagtgctgtggtgggatttcggctcactgcaacctctgcctcccaggttcaagtgattctccagcctcagcttccccagtagctgggactacaagcacgtgccaccatgcctggctaatttttgtatttttagtagagagtaatttttgtaattttagtagtacaaaaaaactttgtatttttcaccatgtcagtcaggctggtctcgaactcctgatctcaggtgatctgcctaccttggcctcccaaagtgctgggattacaggcctgagccaccatgcctggccccttttaactatttctgtaccttcataacatcaattagcaactctcatctcttgaattccaatatacaataagcagtcatcacatattatagcactcttttaataaataatacatctacatgtgtctgctatgtgccaggcactgtgctaagtgtgttatacacatgagtaaaccttcccatcagccttatgaggtaagtgctattgctatctccattttacagatgacaaaactgtgtacggaagacaggcaggtttccccagactctatagctagtaggtagtggaagctagaagttaaagctaggcaccttgaataaaggtttcattctgagctatgacaattctgccttagatggacactgtggtctctctactcctcactcccatcacatccctatccaagatttatggtcagttattgttggcttggcacgagctatttcagaggactctctcaatttcacctttggctcaaagtcttcaaattattttttaaaaagggaaggaaggaagaaggaaaacacagaaagaaagaaagagaaaggaagaaaggaaaagtcttaactaataatgaattctgtgatagctggcaattatttcccagttttttttcctctccctgaatagacataatatgacagatgtcagccaaagagaatgaggaagttgatttaagtccactattaaaccacatattcacttattttttattgaggaactacattggatttaaaggtaaaatgcctcaagaatttgttttcagatagagcaactgattgtaatagaagtaaaaattttattatacttcttaactgtaccaggtactttaatacattatctcataaagaccacacagcaaccctgttatggaagtaattttattttcactaccttatagatgacgggaccccagcttatgaagattaagtgactcccccaagtccatgaactaaaaagtggcagggccatgacttgggccctggcatgactccaaagtttatattatcaaactctttttgctgcatctcccaaatggcaaaaggtgcaatttatggtagttcagacattctcaggtccacagcgtggggatgggggatgggactgattctatgccctttaagaaggtttaacaggtgcaaatttggcaactcttctgcctcttctttctgggaatgaaagacagggcctacagtttttacattaatgcaagtcaatatatttcataagccacttatttaaaaaatattttacctttccctgaatattctacttgtgctctgtgagccctctctatgatacccactatagtactcttagattcctgacaatatcatgacaagttagcatgaaaagtttccaatactatgtgtcatattaaaacttgtctttttaaaaaataaattctaaaaattgtgggtacatactaggtgtatgtatttatggagaacatgagatattttgatataggcatgcaatgcatagtaatcacattatggaaatggagtatccaccccctcaagcatttatcctccatgttataaaccatccaattatactctttatttttaaatgtacaattaaactatcttgactatagtctctctgttgtgctatcaaatactgggtcgtattaattctttcaaactatttttttgtacccattaaccatctccacctccccttcaccactccccactacccttcccagcctctggtaaccctccttctactccctatctccatgagttcagttgtataataaaaacccgtctttacccagtgctgactaaagagacctctgctaggcagtgtctgggaaataatgttctttttaaaaaaagatgggtgaagagaggacctatccttcccttccttccttgttggtatgtttgatgtcaggacacaccacatgggactgctgcagctattttgggaccatgaagaagaggccaagagaactctagaaaaggcaacccagttatctagctgcattgaacttctgaaccagcctgggatgcacatttccagtcttcctgttatgtaagcagtaaaatatccgttttgaccaaaacacacacacaaaaaccaaaacttgcctttaacatcacattcattctctaatccattaataataactctccatgtacgagaggaaacaaaacacctttgaaaaacagcagcaggtaagaagatactttcacctccatttattttgaattctatgacagtctttcttttccatctctcagagataaattttttccttttttttttttaactgatatgttaagcaaatcaatgccctaaaatcagaactctgacgtttaaggaaaaaaaaaaagccctgtagttttttttttctgtactttgaggggaaaaatagtttaccttctcactacaacagatggttttaaatgcagtgattacaaaattctgaaggtaaaatggtttaattacaaagtcaataccgcctctaacctgggctgagtctttagcgtaaaaacaacagacggagcagtgcaaacgctgggacaatgtttaaccagaactttgcatagctactgcagtagggctttccatggggctttagtaaaccacagagctcacgattctgggtttctattcattgaattaccttaaggtgaagaatcataaatgtgtgtatatatttcactatgcaatatacgcatgcacacacgcaagtctgatggggtctactcctggaacctgaaccccaatagtatgagatggggttcaatttcagcaaaaatgagtgataagaaaaaattaaggatacacagaaaaaggagtttgccacagggataaattttcggttcatttaaaaaggacattattctgaaattatatgttagtaaacttgatttctaaacattaaattgtcagtttttgcttaaaatccaaaggaaaattaatgacatagtagaaaatgattcaattgctagatgtttgtaaagatgttttaaaaacacacaagaaagctaagtttgctttttaaataaaaaattatcatctttttctaaatagaaagatgggtggatacaaaaattattcgtggattaaaccctaattcttattaaacttgtaatactgaaaaatcactttgagtgcctcttgaaaacttccctacatgctgaattacaatatacttttatatcaaataactcggttagtgatttcttttttcattttatccattaattagaatgagaaccattcatgaaaactgatgtaaaagaaaagtgcacgcgttctccctaaggtggcatattcttgcctcacatccactaagtatttaatacaggccattacaagatagtttgggtcattggactaagcagatgtgggaggtactaaatagttaagtaaaataaacatttcggatggtcttatctcggagtcttctgatcttaataaatgtcaccagaataatctaaaacgactctttagcaactctgcagggaattaaaatcagaaacattttgcgatttctaatctgtttaggttgctctgaaaggaaaaatgcctcattccagcaggcagtgtatggaattatattcaacaaaacttggaaaggttggtgttgaggttaaaatgtgaagaaaagtaaaaagaaataaatagtgcattctaaaaataaaataaaaatgccttaaaaagtgcaatttttaaaacattacattaaggcaaagtaagtcaactgaatcataatgaccacaccttaatatgtcttttggagaagtgttaaaatttaatcgcccaaattcttagttataggacatagctaactgcttgcctaatttcattctctgctacatgttttctaaaaagtcctgaagcaaaggatgaacaatcttagcttttaaaactcacttagaattaaggaattctttggtatttctcagtgagaaattcttgaaaaccattcatttgaaattcatttaattactctttcgtttcccactctcacgccccacttaataggcaaccattctaatgtatttaatgtacagctttttacattttgcactgaattagaaatagagacaattctaggtatacacctagaattgagtgcatagaattcactgagtgtatacctaggataagtaggtattcgtgaaaattcacagagtgtatacctaggataagtaggtatactgtgcaactagtcccaagatcaagaggcagatattgccaacaccccacaaattttttgtgtgtccctttcaagtcactatcagctcagagaaaccactatcctgacttttggcagaggtgattgactttacttatttagtacattatatcaacgggaccataccatttgcactcttatatgtctggcttccttagctcaacattgtgtttttaagatacatccatgtttttgtgttcagctggagattgttctttcttactgctgtataatatctcactttgtgaatataccactatttattgcccttaatttttgataaacacatgaccatatttctgtcaggcatatgcctgggaatggcgaagttaagttataatgtgtacaatatgttcacccttagttaatatggccaaagctggatgacaaactgaatgtttgtgctgagccctttgtttctatgttcttatagaagatgaattctcatttggtatacacacaactttacatatattaatggttttatgttattcatctcgttctgctttccatgtttttttcattcaggattatagatttaagatccatgcacgtggctatgtgaacatcaagtctgtgacttataattgcacatcattatagaatgaatagtgacatttttgaaataatgttttgaaataatgtaatgtttaacgacagaggaatggtttcattcaacaacaaattactataggcccatttaaaacaagtttttaaagactttatgaaaataatattttggaaaaagaaggacgtaaaactgtttacaaagtataatctaaattttatttttaaatgtataatctgcaagggaatataccaaatataagtaatatgtactatagtataagatttgtggtgcttttttcttctttatgtttttgatattttccaaggatattatgatcaagaaaagctaaacaacaaaaaggtaacctatgaactacaaaacagagtactgtctttacatgagctaatatgtgttataaaacattcttttaaatatttttatcatgtgttttcccactgtttcacatcacttttttcatagtcattatttgcactttgtgttaagtcattagtttcgtctctcaaatacaaccttgttttaatgtcttcacctttcttctactttagtctcttcaattttgcctcattattcattatagaggcctgctagaagtcagcacgtccctctcttctcaatggagcagctctctctcccctcaaagctaacagttgatatttttcatattgttgagtgttatggaaaacccacatcctgtaattgtgtgttaagatgcctttcctcttctcaagttcatttcttaattacctgaattattatatctaacccacattgattatactataagtggtaattgttaacattactaagtagaaataggatctcacattaaatagagcttttctgtgattttaatctttgttagggcaaaaacgtttgttcctcaattttgcttctcctttaacctgttctttgtccttgactacaaacagaaatggaagtgggcattccctcaagcaagacccaaacccaacccttcgaatgagagcacatttttttttacagtttagaaaggaaagtagaaaggagagatcatctcattctaatgacgaaggctgagtgacctttccaacctttcataactggataaagcctcatcagaaataactggaggtagtatcttgacttcttttccaatgcttttcaaccaccatatactcttccatctcaatgtaaccttagagatgaaactattccttctctggttgttgttgacatctaacttaaagtgtgttattataggagatccacatgctattcttatgtttatttctcaattaaccaaattataatatgtaacctacaatcagaataccttcaatcatagaacagattaatatttgtcaaatgggaatgcataagcagggctgcatcatgactttcactggccccaggcactttttgctgtatgggttccttccaccatataaaaatattaaaaatttgtaaagttttacaatttagtaggatggagaaaagcaataaagaaaatgaaatggggagggtgatgagaactatgacaacaactatctggccacgtagctggctgggtaggaggctcctctcctggctggtccacatttattcactacctcccttgtttcatccccttggagttgctctagggagcccttagaagaccactaccaccacgctcccaaactatcctgcctgcttacctctctctctcacagaacattttctgtcatgcagcttgtcctctcagtcccctattctctgttatgaagcaacccagagggtggatcatcatataaataaatgtcccaatgtgttcactggagaacgtgctgctccaagtgggagtcacctcttcattctttttcccattatagtgaaaaacatgccccgatgtttactgatggcctgatgtttacaaggtggtcatctgacttgatgaactgacttgcagaattagaaactctggacagaaagcatggtctcttactggcaggccagcacccttttcacagccagcctcctctgcatccaagcctaaaacatcactgcatagcatctctgtattcctgttctatggaaaaataatttcaaagcagtacgcaatccaagggtaaataaagcagaaaatccatacatatttaagccttttcttggttaacgacttttactaatgatggcaacaaaattattgaagcctgcaataagccatccagtggtcaaataggtcaccttatgactagtattaagatttaaatatcctttaaaattaaacagtttggggttattaatgtttcctttcctctcaaaatttttgtgttgaggggaggtatgggaggaaatgtattagcaacagtaggatgtgaagaataactctaagtacattaaacatctgttgatggagccattagcacaggttgtagataccgccacctggcctttattccattttgctcgaactttagtacctgaaaatatactgtagtaattttgttccacttcttttaaatcttttactactgcattaagtggaacataagcactaattagttctcactgagacaaaaagacctgcttatggcaaaaatcaaaagccaataagaaagtggcaagggttaaagcatcacttagcatcttgagctggtggtgttactgcctgtatgagaggaagtccttaaaacagcaaatggaggtgaaagcagctgtagtttatataatcatgttattcagtgagagaatttcagctccttcctctatcatttctataggttatttttaagtgtaagattagatttttcatggtcaaggcactaaataaaataggatcttcaaaaaataagtctccatattccccaaatgctaagcctaaactgttttttttttttttttttttttaggaaagtcatgtgaacaagtgcttgttctgaattttcatcagatttacaaagctcaattaaaggcattaagccttctcctgaaaggacgattgactttcttgatttatagcccattcattcagtcttctataaaacatggtccccaagctacagaagcactgtgtctgactcaatcacaaaatcaggcttccctgtgtgctggcacatgggctccttctatattaacgttttcttcacatacaaagagattcatcaagttttgccgagatgctctaagagaactaagcaatcagagtttcatttttcaactcctctatgaagtgtccccatttccagcttggccatttgagatttgaggcttcaatctattaatgttaatgtcatgaatggatgagttccatagttccacacaccgtagatctgcagtgttccttgaaattgttcttagctctaaataatgttatctctctgttctttatgtagatacactatattatccattagatgctgtggaactctgtggctggacatcagtcccaatatcatggctaaaaagatgtatcttggacctaggtttgatgtagttgccctgggttaccaattataattatatcaaaggcatctgctttccattcttaactgcaaattgatggagtgagttgtgataacatttaagtttcacgtattctttgacaattcaatctagttactgtattcactttcatacaatttgtattgaataacttgtattgaacaacttgtgctttagtttccttctcttcaaaatgatgaaaatgattcctgggctatatatttaatggattacagatataaaatgaaaacacacatgtatcttgaagcatggatgtaaagaatagctgttgatagcataacattgtttctgaccttttcttctccttcccatccccagtgtcactcttctagtttagaaactttgtatgccttacctattacttcagtgtagtcattctggaaaaaaaacaactttccttcttctggctgaaatactactgattcctgaagactcaactgacctacttttttctccctagagacttcccagttctttcaggccttttctcacagaattaattgcttacttaccatgtcttatgtagcattgttggttttgtttttttgtttgtttgcttgttttttgagacagggtcccctctgtcacccaggctggaatgtgcagtggaaatcatagctcactgcagccttgaactcctgggctcacacaaacctcccacctcagcctcccaagtagctgggactgcagatgcaccaccatgcctgggtaatgatttttttaaaataacatttggtggagatggagttatcactatgttgcccaggctggtcttgaatttttagcctcaagcaatcgtcctaccttggcctcccaaattgctgggatacaggtgtgagccaccacatatgacccattgttggcttttggtcagtctatttcttcaattaagttgtaagtcctttgagggaagaaatcctggtttggtcacattttcatcccctaaagtacccagcacagtgtcttaagtcttcttggattgaacggaattgaactgaataaggctaatgaagaaacctggcaatgaactttctattaataccaaagtaaaattattgatctattgccaaattcagtggccagttctttttatcttcatatttaggacgtcttgcagcatttgacacagcagataactctccttcttgaagcacttttcctgtaggtttttgagacatgacactctcctttttttcctcccattttactgactactccttaatcttatattctgactccacttcctctgcttacctgcaaatgctaaaatatcccaggcctctgtctttaacccccaacccattgatatagtttggaggtttgtccccttcaaatctgatgttacaatgtaatccaacatttcaatatcaatgttgaaggtggggcccagtggggaggtgatagggtcatgggggcagatccctcataagcggcttggtacccttccctttgtgatgagtgggttcttgcttggttagttcataggagcgctggttgtttagaagaagccggcatgtctcttgctccctctctcaccatgtgacaccctgctcccccttcaccattttccatgaataaaagcttcctaaggcctcacaagaagccaagcagatgttggtgccgtgcttgtacagcctgcagaaacataagccaaataaacctctgttcttaataaattccccagcctcaagtattcctttatagtaagacaaaataaactaacacacccaaaaactaactcttcctacataatatcatcttgtctgctggcattaaataccactgatatgccaccaatcccatgtttgtatctccagctcaaagtgctcccctgaattctgggctcatatatccatttgcctttagatttccacccatatatccatttacctttcaggatgaccaattttcaacttgaatttaacatgtctaatgtaaaattttagatttccttctattccttcccaaatctggatactctcccaattttctcagcaaattgataaagtcaaatatctagaagtcattttccatttctcccaatcccttgtattctgaactctgcctgaaaaatgtatctcacatctgacctcttctctccatctccactactacaatgctagtcaaagctgccatcgcttctggcctagaccgagtggtcttcgagattccagcctttctcccacagccttttctccacactgctatcaaatgaaactattgaagagcataagtccaataatgtcagttaaactcttccaaagccttcccattggattagaatataatctaaattttcttcccatatcgtgcaaggctctgggttctgcctgagtctcccagtttgtctcctgcacattctttctcatacattccacccctgcagggcactctcaagggcttctccctttgctgcctaaacactcttccctcctcatcctttagatctcagctcaatgtccctcttcaagagggccttcccttactgctccagctaaggtagtcttgcctcttaccctatgaccctctgttccattattttattgtattatttgaaattatagctgtcagaaagtattcatttatttttacatttagtgtctgcctcctccaacccctctttgaatcagatacttttcatattcattgtatgtgactatcatttaggacaatccctggccaatagtaggtactcaacaaatacctgttgcatgaattgattttctaccttattcatttaacaatcactgagaatgatttacgtataggctatgtatatgtgcttattatataacctgataaaatatggtttctattttcagggcattcacaatgtagcagaggagacagcaaaataaacagaagtagagcacagtgggctgtccttgttgaggagcatgcaggagctatgggcagcatgtagctgggacatgaaacatagacctgggttggatataggaagtttgggaaaaggctttctgaaagggggtgtctattaatgccaaaacaaattactacaaattaagcaccttaaaacaacatccatttattatctcataggtccgctggtcagaactccctctgggctcagctgattctcagcttagagtctcatgggtcaaaatcaagatatcagcaacacagtgttcctttctgggctctgggtttaaattacatttaagctcattcagagtgttggcagagttcagtttcttgccattgtaggactgaggttctcattccttgctggctgtcatccagaggctgatctttattgctagagactactcacattttttttgtcctgctttccatgtagctttccaggaatgggggataaattctctctcgtgcttcaagtttctgcaacttccccttctgcctcatgtcttttctgcctctggtcagagaaacttctctgcttttaagagtccatgcagtttacattgggcccacctggaaaatctgggataattttcccattgtatggtctatgatgtaaattgtatctgtaaagtcccttttatcaagtaacataagatattcacaggttccagggattagaacatggacatcttgagagaatgtttttctacctaccatagaaaagatacctcacctaggtctttcagattaattaggagttaactaggcaagaaatgtgaaaaagaatattccaggaaataggaaaaaccagagaatcataaaatccttgccagtctttccacatggatgtctgtgtatgtggaaagggtgtggggccaggtctaagggttgtaagatgaacagaagccagatgttgaaggaccttgtgcaccgcagggaggagtttggaattcattgtgaagtcaactgagagtcatcccataggctgggagctcatgataggattgtggagaatagcaacccaggtagggcagggtttgctgcaagagcagaggaacttgtacctaggactgtctgaatacttctgtgatccaacaagtgaaaaactcgaagcagcagattgtgcaaaaacctgtgtaagatgctccagataggctgggaagactcaggtgccatgatttcctacttcctaccaggaccacgaaaggatccccaaccccaaattatcttacttgttgatgtctgaagatcttaatttagttttaatattcaaaattctccgagatagagatcagtgttcactaaatacatccttcttttctaaaaaatatgctttccctcccatcatggttcagcttattaaattggtaattcattcaacaaaaaatacattgaaggactagtttaagtagtgtggagcagccattcacacatatgaattagtattaccacatttatatcttcatggtcttcatttttctaccctctctaaggacagataaagctttgtcagttttgatcttgctcttaagactggcttttatgaatcacccactggctaatatctttcagtgttttatattgctgcttttttcaaacttgtaatttcagacatggtttcaagtttcagcaagttttttattacatatatatgtatatataaatacatttgtacataaaatatttacatatgcacatacataaaatatattatacatatatgtaagcatacatatacatatgtactataatgacatctattttttataaatatctttgaaagataatagaaaattattctaaaacctgtccacttcctagtcaagattgtctgattcaattttcttttcttttttttttttgagacggggtctcgctctgtctcccaggctggagtgtagtggcgcgatgtcggctcactgcaagctctgcctcctgggttcacgccattctcctgcctcagcctcccgagtagctgggactacaggcgcctgtcaccacgcccggctaattttttgtatttttagtagagacggggtttcaccgtgttagccaggatggtcttcatttcctgacctcgtgattctcccacctcggcctcccaaagtgctgggatttacaggcgtgagccaccacgcccggccgtctgattcaattttcttaaatgttgattacattcggtgtgaggacacgccccgctcaagaacccacaccccaacagtcaccatcactgcatgtttctaatagacacttggttttagcaaaacaaaaccatctgtcacgttaaattaaatgttaatatgaatgggttggttttttagttcagtttatacaaaaattgaaatttcattttgtttaataaggtttgtatctagttttgtggccctatgtatataagtaacattattttaagatcaagttcatactgggggggagttcttgacaatattttttattcctaatttaagtttcagaaacgcatctctattgttttaattatttgcttgctacccttcacaagacaggtggttatattccagtgatataattgaggggaaggcgggggaaaagtggggttacttagagaactatagtatcaaaacatctctgaatttgaaggaaagagagattatgtagtttcacagggtctctattctgaaaatttctatactacaagcatgcatatttctctttattgcattacacattaattgcattctatatagaaattaagacgcattataataatttttctttacaatgaaaaatcaatacctgattttctgttgaagttcttgtgtaaagtagaactttaagaataaaaaaaaaacctgttaaatccaactccatcccacatacatctatattaacagatttaaaacgacaacaacaaagcctggagaacttgaatggcttatcatacaacttgttggtagcttaatcagaacctaccttttctatatcttagactcagactgagacaggcctgcttatgacctgtgcctagggcactttacacttctccttcatcaactcagagtcactaaaatgaccagtatttgccttcccccactggactcagagctctgtcaagacaggaacctcttatgccggattcctgatgtagcccagtgttgagcacatatttggtgagtaagagagtgggtacagggaagggcaaagaaatgaaatgaatacaaggaaggaaggaaggaaggaaggaaggagggaaggaagggagggagggaaggaagggagggagggagggaagaaacaacggagagatagggcaggtctgtaaacctcgaatctactctttctactatagcatgctccatgcaaaaccttaaatctactgctttttttgggattttcacttgagattataatgctgtcatacccaaagggccataagaattgaagctagtttaacatgataccataactgaagaaaactttatgaaggtaagactatgcatatttcactaaaactatatatctaagccaagcacaatgcctagcatgtagcatgtgctgaaaacatatttattggataagtgtatacaggcattttgagaagacgagggaaaagtgtcacagcccactcatacaaatctgtgacgtcttcagccaagcaattcatttgtttagaaaatgaatcacaagaaaatcaaacacatcctcagcaaatggattacaggaaaactatctttaatccaatattgcaagattaaaatttacatttataaaggataatacaaatagagggaaatagaacgtgaataaaatgaaattaaatgccttagtaaaacactacagaaagaaacctgtttcctctaaaataaagattggacagttggtaaactcaaaaggtacaatgatctctcccaactgaaccaagtacagagaaactgccctaagaatgaatgaccactcttaaccacctgtattgcagaaaatcatatgcagatgttgcaaactaagcaagagcaatgaaaaaaaaatcagtgggaagagcaagcaatgggtgagtctggggaagcagtcagggaatgttgtggtgggttagtggtaggatgaaagatctcagttatggtagcatggagtggcaaagagagagtccaggctttgcagctgaatagatttggatggaacatttcccatctatgtgattttggataaattatcttctttgagctttagtttttttatgcacaaattgaggactatgataattgcattagagttattatataaatagttgctgactatttacatagtcatatgtattgcatatgactaatgcagtaagcactcatcaacggtattttattattatcattattattttactattactatttttctattatttttattattattttactattatgattatgattgcctcagcatcagggatctttgaacataaaggggaaaaatggtagcactatttcactttgatatttctagcaagctcctaggtgatgctgatggggctaatccatggaccacactttgaaaagccaggttgagcccttttggaatctctggccgtcctccataaccacagttcaacaagatctccaagtgagtcctatgtaaaccaaagtgtaagaagcactaatgtagggtacagatcttctgatgcaagaattctttctacaagagagactgtgaggacaagtttactttgtgctaaacaataacaattatgttaatggaggtacatcgttttgagttttcttctccttgtgtcctgcaggaagaaggatcagttgaggaggcagctgatgttacagaagagctgaccctcactcactgtcactgaggcagctaagcttgactcccttgctttttatagaatgaggatttgaaaacagctgggctgctgtgttcttagagtgttactagctaggccaaagtggatcagctgttactagggtccctttaagcctttcttgttgtggcttggttcattttcaaaggcagcaagtagaaaaggtgcctagtgcttctccctgtccaatgcagctaattgcccctcagttctgagcaaaaggcatcccttgtgctttgatgcctgaatgtatgggaaggtgcaactggtttacttgtctggggcctctctgggagagatttgtagtcccaaatttatcatgggggtatgtaaagggacatgggttggaaacagcagagactattttcccgtctgaatctctgtccttaatcgaaagtagaatggtttctacctcactgttggtcaggctttgaggaaacagaaatggagaagtgggaaaagctatgggagaattaaataaggggagaaaattcaaaggaattttctagctccgaagagaaatttagaccacaaaaaggagaatcttggattcatgccccctggctgcatattatcagaataatctttgtattacagtggggtaagaacgaaacaggtctgctatagatactcacttatcaatcaggagtcagagtctataaaatagaggtgaagtaagaaacaggttaataagagaacagtatatctacaatctgtctggttcaaatagcctcatcctcttttgagaagccaaatctacgctcactactccccctgctggatctacaagagtagattcccagattcataaactgcaaatcattcatttaacctgctctctatgaattaagcacttgcactgaagtacgcaatgccattttgatggaatggggagaacaaggccaactcttatatttctgactgtttatattgctagataaaaaagaaaatccagcataacttattttccataggaaagaaaaataaaagcaaaaggtcccagctgtagacaccttgatagcattgatatgtaagtattcctagaaataatgaataagtattctgcatgtactacagcagcaagacttgcgcaacttctcctcccctttctctttctgtaaatctcacagcaaggacagtgagtgcttccttctttctcattgcaaatggaaatgctctcggcatgctggcttcaatggcaagtattgcattattttaaaaactttcagagaaaaacagtaagaatgattgaacagctcaccacgggcaggtaaaatctattaaaagcatttttattctttatttctaaaatagtttgtcataaacatccctccttaattcctctttccatcttaatcaggaagcttttatcatgggatcattttaaaaattttattgtggataatttcaaacctatacaaaagtgaaaaagatagtaccaccctccacacactcatccacccagcttcaacagttattgacacaggtccaatcctcagtgtctaactttctcctgtagcattattttcaagtatatatcacacatattatttcattaataaatgttctagtatgtattctaaaacatactagactattattcattaattatatacagattaatatatatttatatatactgttattatatatttatatatttatattaatatataatatatattttatattaatatattatattaattaatatataatatctattatatatagttcactatatagaatgaacataactataatattattactagacttaaaattaacatttcttaatatagaatatccagtaagtgttcaaattctaatgccctatgaatcattgatttttcataatttgtttgaattaatttcaaagtaaggttcacaaattgtgcctcattgatatgtattttaagacattttaatctacacatttcttctccaactctcttttctttgcaattatttttgaggaagccagattgtttgtcccatagaatttccttcttctggattttactgattgcacctctgtatattttaataagtttttttttgtcctctgtatattggtatttgagcctagaggcttgccaaataggttgaattttttaagcaagattactttataggtagtggtgtgttcgtctatcaagaggtatcaagagtctgatgattactcctttgtcctgttagcagctgttgatgctcaatgcctaaacaattaattcattcattgtgggttggaagataatgatagtaatgatatgctaattcaataatttcttatgtacttaataactggactattctacagaaaaatacttatgtttggttacccagtgatatagtttgtgtaggaaagacaagttactaatttttaccttctatttactaattatcaaaataatgaggtggttccctaaaaccctccaaaagtgactaattaattttgtttctaatcatgtgtctttaaatgacctttaaggtcagttttggaatagttgggttttgacacaattcacaggtttctaccaattaattataaatttgcttttccattattcttattccatttttttcccttttttacagtgatatgtattttcaacctttcatttggataggtatcttttttccttcagtgggaagttacctgttccttctcccaaagccttaaatatttatttctattttttctctctctcacccagtctcaaacataaacctactcattcatgcattcattcatttatttgttcatccattaaacaatgcctgtgagtgctaactatgtgccaggcattgtcctgaaacagacaaaaattcctttattattaaaattatattgcaatggggaggacaggaaacatacacaagataaaaaagacctcccactcctgtttttaatgccatcctcccatttttgttcccctttcttcccaacagcattgtcatcagttttaaagccttctgaattataataatgaatgaagctatttttttttgtttggaagttggcaagaagttgagatgcaggggaattggaaggaaaagttttttgtttttttttctgcagttgtgaatgtataatactgtgtttctttatgtcggtatgtttatacctagttgtgcctatgtaataacttggccaatggctaatcagggagtttggggggtcagaagccaggtccctgaaaatggtattgcagaacagaaagagaccggtgatcactggtgtgctagatactctggggactgggatacaatttttttggtattgttaatactttgtttctctgcctaaactagcatttcttaaaatgatgcatatttgaatttccaggaaagcataagaactactaatgcccaggacgtagatgaatacatcagagtttctgggggatgggaatggagactgttctaaaaggtccccaggtgattctaatgtgtaaccagaaatgaaaatgtgaggctaaactttctgttaagtaatgaccaaataaagcaagttcttcaatactgtcattagagggcagcactgccccaaaaattcaaaaatctgacctgtcatccatgtctcattgcactagtttgatagacatttttttgcattttaaattaaatatcctacttttataaaactgtacttgggttccagaattatctaagctttaattgtactttataattctattaattttaaagtaataaaaatttaaacttttaaagtagttctgattataacagcaatttcaacaaattcaggtcatttcaaactacattaaaatttatttcagtatttattttaactgatacatatcattgcacatatttatggagtacagtatgatgttttgatacatgtatatattgtgtaatggtcaaatcagggttttcagcatactcatatatttatcatttttgtgtggttagaatatttgaattcatctcttatagctattttgaaatacaaaatatttaactacattattttaagccaacattatttgaaactacagacgaacaactccaaaaacattaccataataaataacatttcatttttgatgaaaattgggagaaatatttcaagatttggcaaatagtattaattttttaaaaaataacatgagttgtcagcatgattgatttccaatcctagaggttcaaagtgtacaaagttggacaagatcaggaaataatagaaaggaatgtatttcataagcctgtgtcagtgtctgagaataatttgaagatgtttgctgtactgattagattcggcagatgggagaattcttgagtcaataacccagcctgattttatacaaagattctcacttcctgaaaacttatgaaaggacattatatatttttaaaggctttacctccagtctgcattatatatgagtggggttcctatcataagatggcagagaatgtagttgatctaataaagattaggttgaaaaagtgattattccctaaaccttttcagggtggagagagtatgggtgtcaacttggtggagtgctgtttgagaagtagcattaggtttacttaaacatggattttatggcaccatatggatcaaatctttcttccgtctactttcacttgttgtcaatacatacgtttaaaaagtaagaactcttctaagaactgaaaagtcccacaacagaagtctatttatcaagggcctcattttacaatgaaacttatctgtctcgttgttctgagtactgtaaaaatctagttatttaaagaatcaatgcagcaaacccagaaatagtaacttttttatattcatatatgtatagtcatttggatatagaaaccaactttatacacacacgtaaacatacacacataccctcaccaatggactttgggctttaataacatgatgtttctattaaaatttaagttccatccacacactatgccaaaaagtctcattaatgtaaaaatgatcattcaacaacatagcctcaaaattcacaaacactgcagctttttactccagaggtccttatatagatgggcaagacttctcttcactgcagatattccactgcatccttgtaagacttgaactagacatatataagattataaactagttatacccacatttatgtagtagaaatttgtttaaagcacagtgagaaaggcagcaaagaccaaagacacctcccctcttataaataatatttctcttcttaggtaaaatagatttgtacctgatctttctagcgaaaatacttttcatctctaaagatgccaaactgcctgtgttgtgctcattcttcagcgtgtatgaatgaaaacaagataaaacatggtgttaacagatagcagaagagccttgctcgtaatggtgcaaggacaatgagcattcctaatcccatgcttggaacactctgctgcccccacatctgctggtctcctttcctatagtcatgggagctatttggccattttgcttaagcgcacacaagtcaactgattccccagtccctttgccacaggcctgcaagcgtaggatggaaaacaatttcaacattcgctgcttggactgccgcccttagaagcacatttgttgttcatacatggtcttttggctgccttctttcccagccatctgttaaaggagacattgtgcctgctctgatgggatggtgccactatttctaagagactcacaaagtgtatgtgtcttaactacctgggctttacaaatttcaaagcacatttactgattggtattgaattttaaaagcaatgcataatatttgttggtttgaaaaaatcattattaaagactatttcttaaagcagttttaggttagcagtaaattgtgaggaaggttcccagatatgccaaatatcccttcccctacacatacattttaaaactctgtagagctgagaaataagtaagggctacattctgtgtccagataacttgtgaaattcccaaaagaactatccagatctccttttagtgggggcagacaatgatattgaatgctgctttttccatgattgaatgcaggatataaatacagctgtatgcatcactgctttctcctttcatgtgaccagctctgagaaaacagtgactatacacctgttatcctcttatcctcagggctacacatgtctcatcaattcacagagctcgtttatacactcggaatagttgatttgtgtatcattgattatgcttcagtccatgagagccaaattttcattggcaagccatattagcactgagagttcatgtatgtggtaatagatttgctctatgacattcccaaggactgggattgcctttccaaagacggttgggttgagctttttgtagctttcagcttgtacatttttgaagtttgccatttcccttttcaagtttccgatgtgcttttccccagattcctaagcattcccaggcagagtctgagcctgtccccaggtctctgtcaggtttcatctttccactggataggtcatcatgttttgcagccagcttgtgtatccttctgcacttggctgatgaccatttcacatattgacatctggatcggaaagcaaagctaatttgggaagcaagactaacaaagccagccaaataccacctgaatgaactctagcactgactcaaacaataaaaattgttattgtgtgtgattaccaccaaattttatcatttctaagtcttgttcctccaaaattccagttaaagtaataatttcttaactgagactaacacattaaaagaataatctaaaaccatgtatttttttggtaaaggattaccaaatttatagtattgtgttcatgctcaggactagatgattattatttatcttatatagaaagtagaatctatcatctttttaacaaacagatgtggtaggtgatgaagatacattatctcacttcatccagggggattttgttcaggtgatgggtagctgtaagtgaagtggttgcatattgtgtgaagagcagtcctcatgcagagtgccaggctaggcagggaagatctagaagaggagtaactgggtggaaagggcaaacagcagagggaagttctcatgagctgaacagtggtaatgggatagcaagcagtgaaatgagctcactgaccagttcaggagagtgtaataggcgccttgtaactgaggatgagcaatctgatctcagagccccatgcaacaggaagctatgactggttctgtgtactgggctagggtgtggtaatcgagactacttatgatctgtttgtgttccccccaaactaatatgttaaagcccaatccccagtgtaacggtattaagaagtggggcctaatcaggtaattaggtcacaaagagagagccctcatgaatgaaattaattcccttgtaaaagagcccccagagaggtcactgtaactttttaccataacttcacatgtcccttctgccatgtgaagttacagtgaaaagactgccatttatgaatcaggaaatgggtcctcaccagacacggagtctgccagtgcctttatcttggacttaccagtatccagaactgtgaggagtgtttgttgtttctaatccacccagtttacggcattttgttatagcagtttgaatggattaagacacgaattaaggcttaggctgaatgtagcctaaaaaattacatcacagtgggacagagcctaggaaggcttacggctgattgcaaacctgaggtgttctagcctacaaatgggtagttaactgcctctgacagtgagctctgagagagaagcaccatgtatatctttcttgtacatcattacgtttccagggttgaacacagaacctagcacagtcatatactgcatagtgatgttttggtgaactatggaccacataaacaaaggactatggaccacataacatgataaaaaagctgaaaaattgctattgcttagtgatgttgtagccattgtaatatcatagtacaatgcatcactcacacgtttatggtgatgctggtgtaaataaacttcctgtgctgactttttaatagttattttacagtgtacccctatttattaaaaaaaaaagttaattgtaaaacagcctcaggcaggtccttcaggagatattccagaaggcataattgtctcaggagatgacagctctaggcatgtttttgtccttgaagatcttccagagggacaggatgtggaggtggaagacaataatattgattatcctgaccctgtgtaggcctaggctaatgtatgtgtgtgtgccttagttttaacaaaaaaagtttagaaagttaaaaaaaattaataaaaaacttataaagttataaagaaaggaaatgtgtgttttaagctaaatgttattacaaaaaagtcaaaaaggtaaattgaaaagtttataaagtaaaagtcacagtaagctaaggcatatttattattattttttaaatctagtgtagcctaagcagacaatgtttataaagtctacaatgatgtacaataatgtctttcacattcactcacctctcactcactgactcattcaaagcaacttccagtcctgcaagcttcattcatggaaagtggcctatacaggtgttcctttttcatcttttaaggtaagataattttaccgtaccttttctatgtttagttatgtttaggtacacaaatacttcccattgtgttacacttgtctacagtatttggtacagtaacatgctgtacagatttgtagcctaggagcaacatgctatgtagcctcggtgtgtagtaggctatagtatctaggtttgcattagtgcattctatgatgtttgcaaaatgatgaaattgcctaatgatgcatttcttctgagaaatgcatatccccattgctaatcagctcatgactgtatatagtaggtgctccatcaatatggttgaacaagtgagggagtaagagaaaagagttttgtgtgatggtttgaagaaaagaacactaagaattgcaatggaatggctttttttgtgtgaatggcagttattattccaaaagtccttgggttaggaccagaggtaaatttgccacagcttcaaaaacttaaacttcagggacccttgcttgcacagtcactcgttaggatcgtggtagtgacttgctaatgagtacatgtgtcttctgttcttgtaaaattaatagaaaagaaagacattttaacaacaatcgataagactactgtctttttccactcttaatttgtctggctcatgaataccttcaagtcgtagtattgaagtagctgggatccttttttgaatctgcctacaaggaagttacattgaggctatatttagttttggtttagcgattttcagtaattttttaagtgtagttaagttagagggatactcatgcccacagttacaattcacctagtgttgtgacagaaaaggccaggagcagaggaactctcagacaaaaccacctacttccagagacaatgttaagtgtcttactgtgctagtacccaaagaatgtgtggcagaggtgaaacaagttttgaattgtttagagctaaaatctagttccgtgaaattgtttttctcttatatcatgtgtagatttagaagccaggttgacagttctcactaacacctaatcaaagtgaatttattccccttgagaatgtactcagtaatgcagtatagaacattgcaaattccaattcactacatggtttttgttttttttttttctttaagagacaagaactgggcacagtggctcatgtcttaatcccagcactttgggaggctaaggcaggaagattgcttgaggccaggggttcgagaccaccctaggtaacacagggagaccctgtctcaaaacaaggagagagacagggtcttgccttgttgcccaggctggattgtagtagcgtaatcatggctcactgcatcctcagcctccaaaatgacgcaattctcctcgctcagcctcctgagtagctgagactacagcgagtgccaccatgcccaaagaatttttttaaatttttgtagagaccagcagtttgagactagcctatgctgcctaggctggtctcaaactcctggccttaagcaatcctcctacctcagccttccaaagtgccgggattacaggcatgagccaccacacccaacccatatttttttcctttttgacaaaagttttataaaatataatttatcaggagttttatatcactaggtcataaccttttgccaagttacaaataggaatatgactgtacattaagtcacatattttatgcatcccaattattgacattaaaaaacaaatttatataattcatggtagaagagagaattacctttctaccatgtctataaaatatttttagaattactgtaatataattaggtgataaaaatatgcagacaaaaatgtaggaaagaaggtatattaagttatatcaggcaacatactaaaaattgtatgttgtttttcttggcttttatagtatttgtgatatgtgtcagcttttagaacttataatggttagaattgcttttttcatgttgcatatttgtttaattttatattcataattttctattctttctctcttaagagcccctctccctaaattatataaacttcgggatccataaaatctaattaaaacagaggtggtgaaactgacatggagagtttcaaagaaagataaagagaaatgtttccatgtatgagaatagaaataatcagttcaagatattggatgagcatatttaggagtagaatgtagcagagagattgaggacagaccgtgtaaaattgtgtctcatttgcatgcaggggagccatgacattgagggatttaaaaaattaaattgaatagattatagtgacattagtagaaagaaatactggtagatacagacacaagtccgaacctgaaagacttctatttccagtggacattagcaagatgtaatcctaaaggtgagattatcaaggtagaatgtaaaagtaaattcctggaagctgggataggaaaaaataatactgaaaagagctacagaatatataaatgagttatacatacattatctgctgataaggcactttaaagtgaaagtaatttttttctttaacatttgttaatatcagtactactaacctccataatataataataataataataataataataataataataaaatctattcagaggattttttaggactcagatatacattgaaagtgcttagcatagtgtctggcctagaataaatgcaaaaattatacatttcaactatgtattattaaagtaaaaatgaaaccagttgaagtctgtaagacataaagaaaaaaacttcatgatagagcaggcttagtggatgtttacaacctcattggttataaatcaccatgcaaggtaaatatgtgaacatgtatttaatattttatcactatgaaaaggttcatcctcaaggaaagttttaagagactggaaggaatacaaatttaataaaagaattggcttaattgtattacctgtttgaaacagcaaagctttatatccactaataagataccacttagtggcatatgataaagctcaaggaaatttcacaaagcctagactgatcttcctgatctttttcactcctagacagtatcttaaatatatcaaggacaaaccgtgatacacagactatagaatggccatagaaaacctcatacacacagacaacttacaaaagcttcccaacatgtcttttcaatatgctaaagttacagttaacagagtctgcagagaggtagtttccagtttttcttcatcctggtttttcatatcagaaaatctgaaatataagagagctctaagacaatctctaataccttaagaactagataaccaggcagcattaccaagtttttatggcttaattataactgtttctcataaactttatttccagcccctaattcaactgaaggaatctccatatttatcttttatcatgtggctttaaatttcctgctgaaataatattttatttagagttgcaatacatcaagagacacctacagatttgaagaaaatgcaaattgaaatgacagtgagatgtcctgcacacctattaaaatggctaatactaaaaagaatgacctaggaattattggagagaatgtgaaacaattggaaacctcatacattgctggtgggaatacaaaatgatataatcagtttggaaaagagtctcaatttttaaaaaagttgaacaatcacctactatatgccccagcctatccacttctaagtattcatccaagagaaatgaaaacttatgaccatatgaaggcttgtatgacacaaatatctatagcagttttatttgttaaaaattgctaatttatttgccaaaaattaaaaactacccaaatgtttttgtatttttagtagagacagggtttcaccgtgttagccaagctggtctcgaactcctgacctcgtgatccgcctgtgtgtggtggcatgcgcctgtagtcccagctactcaggaggctgaggcaggagaatcacttgaacctgggaggcggaggttgcagtgaaccaagatcttgccactgcactccagtctgggcgacaaggtgagactccatctcaaaaacaaaaaacaaaaaacaaaacaaaacaaaacaaaaaactacccaaatgtccatcaacaggtgaatggatacttctccacacaaaaaagtgaactcttcatacacacaatatgaataaatcttgaaataattatactgagtgaaagaagtcatgcaataaagaatacttatcatagttattttatttatataaaattcttaaaaatatggactaatctactgtaataaaaaccaaatcaattgttgcacggggatgaggggatagggaggagcaggagaaagaaattacaaaggtgtgaagaacatgttggggataatagacatgttcattatcttgattttgatggtagcttcgtgaatatatgcatatatcaaagcctatcaaattgtatactttaaatatatgcaacttattgagtgtcaattataactcaccaaagctgttaaaaataattaaataaaattaaatattcattattaaatatcaaccagaaatggatgagactttctatttaaaatcactccagaaaattaccgtctgaaagggacattcctaaataacatttctaaattataaagtggagcttaaaagccttattaaaacattttttgttttaaacagtaactgaaaatcatgagatgagcaatgttaaacaacaaaattacaacatagcctttgaaaacagaaataatagaaagaaaaacaatgtaacaatgtgtcatgtttttgagtatagaaattaaaatgttttgggctttcaaagaaagaaaggacagatttttcaaacttgtgtaaaattaacttgataatgataatgtgatagcaaagcattttatgagaatcaaagggagtaaaatataattttcttagggcttcatttgctcgtctttgccttgtttcttaagataaaagctgaggtcatttatgtaagacctttcctttttactaatacaggtttttagtactttataatttcttctaaatactatcttaaatgtatcccacaaattttgatgtgctgtgtttttattttcattaaattcaaaatactttttaatttctctcttttttttttgaaaaacatctgggttgtctagaagcatgttatttagtctctaagcatttgaagatttttccagatataattctattgttgatttttaaaatttattttcactgtaattaggaaacatactttgtgtgacttgactccttttaaatttattgagactggttttatggcccaataaaatatgatctctcctgataaatttcatgtaaacatttttaaaagctttgtgccctgctatttttgtgtggattgttctataaatgttcattaggtcaagtagattgaaagtgttgttcaggttttatattctttatagtgatatcaattatattaattattgagagataattgcttaaatcttcaacaattgtgggtttatctgcctctccttgcagttatgtcagtatttgctttatgtgttttaaatctctgttcaaaagtacatcagcaattagatttgttatgttcttttattgaatctttatgaaatgacttcctttatctctgataacattcttttgctcagaaatctacttcatctcatattaatggggccattccagctctttttttttttagaatagtatatcttcttccatccttttactttaatatatttgtctcttaatttttaaattatatttcttataaatatgtatagttgaacttgcttttttatctaatatttacaaaagcaaagcatggaatcaatgtaagtgcccatcagtggtaggctggataaagaaaatgtggtacatatacatgatggaatactattcagccataaaaagaatgatatcatattctttgcagcaacaaagatggaactggaggccattatcctaagctaactaacaccggggcagaaaaccaaatctgcatgttctcactataagtgagagcttaacattgtacacatggacacaaagaagagaaccacagatactagggtctatttgagggtggagaatgggagaaggggcaagatcaaaaaactacctttcagatactatgcccgttacctgtacaccaaaactcacaacacacgttacctatgcaacaaaccttgcacatgtacccctgacactaaaagttataaaaaatacatgtcaatcacatctaaaaaatgaaaaataaataaataaaattgccagcacataaaaaaatctttgccatttaactggagtgtttggatcatttacatttaatgcgattattgttatagtagggtttaactctacaatcttgctgttttctgtttatatcatttttgtttttccttccttttatgcctcttttgtataaattcattatttttgtgattccattttatctcccctttttagattattagttatgagtctttgtcatgctattttagtagcaattttgggggtgtatagtatacatatttaacttatcacagtctttcttcaatattatacctgttcgtatatggcataagaaccttacaacagtgtactgttgtttctttccactcaacctttgtggtacttttgtcatacattttatttctttgtatatactaaactccatatatattgttatttattttttattgtaaacattcatcaccttttaaagaaaattaagaaaaaagtctctctttttacccacgtagttacctttttctcgtgctcttcattcatttacatagatgtaagagtccctttattatgaattttcttcttcttaaaatattttaatattttttgtaatgcatatctgctgatgatttctctctcagcttttgtaggttgatatggtttggctatttccccacccaaatttcatcttgaattcccacatgttgtgggagggaccaaccccatgggatttaattgaatcatggggtcaggtctttcccaagctgttctggtgatagtgaataagtctcataaaatctgatggttttataaaggggatttccctgcataaactctcttctcttgtgtaccaccatgtgaggcatgtctttcaccttctgctgtgatcatgaggcctcccaagccatgtgaaactgtgaatccattaaatctctttcttttgtaaatttcccagtcttgagtatgtctttatcagcagcatgaaaacagactaatacataggtcatatagtcttattttaccttcaattctgaaaaatattttcactgggtgaggaattctaggctgacaattttttttgtttgtttcaattctgtagaaaactgctccagaagagtacttctagaatgagatagtaaagacccctgaaacccactctttcataaaatcaatgatatcactagcataagaaatataagaataaaaatttcagaacactgaaaattaaccaaaaacttgcattaatctgaggagtgcttattcaaggaataagactgaatatctgggaaaactgcaagctttgtggtaatttaatttgccacatcctcatcctcctctaataagttctttggaagccttgaaaatcaccagcaatgtaatcatggtaaccatgaaaaccagcaatttattagccactgtaggggatggaatgagtttggagttctaaaaagctgccctattgccacaggattgtcattatctgatagttccctgaatacttccactcacagaacatgtttttattttatctgactttaagatccttcagtgtgaacatatttttccatgggctacttgtcagaagcaactagcaacaactgttgaatattgtagctatctcaagtggtgataatagttagggcaaacaatttagccaaagagctgtagcagctatactaataccagacaaaacagactttaggaattgttactaaagaaaaagaaagacattttgtaatgataaaagggtcaatccatcaaggaagcataacagttattaacaaatatgcacctaacactagggcttggaaaaggaagcaaaaaagcagacagaattgaaaagagaaacaattcaatgacaattgttaggtacttcattactctagtttcaataatcaatagcacaactagacagaagatcaacaaagaattaaaagatttgattacaactataaaccaactagacctacatacatctatataacatacatctatataacacttcaaccaacaatagtagaatatttatgcttctcaagtgtacatgcaatgttctctaaaatagaacatatgttagtccataaaacagcctcagtaaatttaaaaggactgaaataattcaaagtatgttctatgaccacaattaaatgaaattagaaatcttactttaaaactgggtcagacttaaatgtaataactaaagctgtacaagtcttagatgaaaacatagttgtaaatgaccattatcatgtatacggcaatgttttcttagaaatgaccaaaagccatgagtgacaaaggaaaaaatacatacattaaacttaaaatatatcaagtttaaattaattaaaaaactttggtgctccaaaagataatatgaaagtccatacacaaactataaaatgggagaaaatgtttgcaaataatacatctgagaaagaacttgtatccagaatatacacagaactttcaaaactcaacaacagaaagacaatccaatgttaaaatgtgcaaagtatttgaatagacatgtctccaaagaagatattcaagaggccaatatacacaggaaaaaattatcaaaatcatctgtcattagggaaatgcaactcaaaaccacaacaaagtattgttttctatagattaggagggctataatcagtaagatgaacaataacaaatgttgatgacgatgtggagaaactggaaccttcatatattgctggtggggatgcaaaattatgtagcttctgtgagaaacagtttggaaatttctcaaaagtttaaacagagttactattatggccaagaaattatactcttagttctttacccaagagaaattaaaatatatactacaccacacaaaaagttgtgcacagatataattattcataatagccaaaaagtggaaacaagtcaaatatctgtcaactgatgaatgaataaacaaaatgtagcatatcaatataatgaaatatttagccataagaaggaataaagtactaatacaggctataaaatacatgaaccatggaaacattatggcgagtgaaagaagccagacataaaagataacatattgcatgatttcattcatatgacattttaaaaataggtgaatccatagagaaaggaagattagtagttgccagggccagggttgggaaatgaggactgactgctaataggaacagggcttcttttggggataaagtgttctggaattaaatagtggttatagttgcacagattgtgaatatactaaaaattattgaactgtacaattttaaaaggtgaattttatggtatatgaattataacatgattttttaaaagattctataaaaaaggttgctacactgttttctagtttgcattatttctgaccagaagtctgctgtcgtcttattttggttcttccaagtacaatgtgtctttgtgttcctctggctgattttaagattgccgccttttccctggtgttatgcaagttcattgttatgtactttggtctaactctttcaggtttcttgtgcttacactttattgagattcttgaatctgtgagtttattgcttttattgtgaactctggaaacttttatgtactatttgttcaaaactttttttttctgtgcctctccctaacattttgggcatgttgattacatatgtgtatgaggctgttggaagtttccccaaagctcactgaagctgtagggaatttttccccccttttattcattcttttttctgtttttaaatttattaatcttctgctgtgtctaatctgctattcatttaatccagtgtatttttcatttcagctactgtagtttccattttagaagttcaaatttgtctttaaaaaaaaaaacctttcatgctctccttaacatgctcatgctttcctcttccttcttgaatatctgaactatgttaatgctaaccattctggtgtccttatttactaattctaccatgtgtgacctttctggatttatttattgattggcttttcttaatttatgggtcttatttcctatttctttgcatgctgatattttatattggatactaggtgtgaatttcatcttgttaaatgttggatatttttatattttgtattcctttaaatatatttcattccaattctgatacgcagttaggtgacctggaaaccatttgtcctttttaagctttgcttttaagccttgttaaacagaattagagcagcctgtagactcaagctaatttttctatattactgagacaatgccgttcagagtactctacccaatattacatacattacatggtttctgctctctgtctattgtagcatatgctattcccagtgagagctcttagggttgttccgcctgctcctttggggttttttcctccaagcttcaggtaatttcctttcaagcatgtgctaatcagtacccaggcatccgtagtgtggaggtaagatgttctactcaactcctggggtccctctctgggcagctgtctcctctccagtattttgtcctgcaaactctaactaccttggtatccttgagctcccagctgtatctgtttgactctggaaaactatcagaacttgcctgggttcctccacaaggtggcctgaaaactctccaggcattaagttggattattgtaggatatctagtttgtttctcatctctcaagaattgctgccctctacttcctgctgtccagtgtctgaaaacaattgttttctatattttatctgctttctagtggcttaaggtaggaagttaagtccagtccctgttactctatcttggcccagagtggagatcaggttatgtattttttatattcccaaatttatttcactctgagtataggaagttataacattaaattgtctcccaactattcctgggagtttctcaggtgattcctctcctatgcttcagaacacatttctcaggttattcattcatttatttattcatataataggtatttatcgagtgcttatgatatccaggcactgttataggtgcttgggatacaatgaaagacaagaaagacaagctttctgcttctgacagtttacattttgttggggacagccaaactgaacaagcaaatatcagaaagcagcaaatgccacgtagaaaacaagtcagatgctgtaatagagagtgaatagagggaaggatggtaattaaccttaggagttaccgagaaggtgacacttgatctgagacctgaatgataagaaagtatcaccaataaaaaattggggaaagagaattccaagaagaggaactagcaaacacaaaagtcttaaaagaaaatgagggatagaaagaacagcgtggtccaaatttagagaatgatgatgaaagtaggaggagataggagagaaaggcatggacttgtattctcagtgtaaagacaacgtgagtgagacatgcaccagctactgcttattcctaccaatactggtctctgttctcccttgtaggcctagccaattctgttctgcatttaatcctacccctgaacaaatgctaattactctaaaccaatcatggtaatccctatgtatctggctagtgactggttttgaaaaaggtgagcgacagagacctggaaaatgagacctgagaggcagttttttaaggaaagattcccttatttatgaaaagagacccacagaaggaggtggcctctgctctttcattagaccaatgattatcaactggggacaaatttgtaccccaggagatatttggcagtatttggagatgtttttgtttgtcacatctgggagtatgttactggtatctactaagtacaggctaggattactgctaaccattttacaatgcataggacagcccacatagcaaggcaaggagttatccaaccccaaatatcaatatttctaaggttaagaaagcctacactagacactcttgggtctaaatgtgattgctacaactgttgtggccatcttgcaaccaggaatattagctgatatgctaaagatgaaaaagtgaaaaatagaaagaccctagggatgtgatgtctttcagctgctaaataaaccaacttataaccatatcagaacttcttgttgtatgaactattacctatgcttatagtttggactattttgagttaagcagttccatatgggaatctagagtccacaggagagatgacatattatttgggagtcaccaacaaataaatgaaacttgaagccttgggactggaagagggcatgggtagagaaccaacatcaggtaatgccaacatttatagactgggttgagtcagcacagaagactaggagtcaggaacagctaataataatatctaatgctttttatagtgattactccatgccaagcatttttctaaattctttgtaaatattaactcatttaatccttataaaaactttatgaggtagggttactattatcatcccattttacatacaaggaaagtgagtcatagctcaattaaagccaatttttccaaggttacaaaattagtaaatgtataagttgggattcaaatccaggcagtctggcactattgcttcaatgtgtcccctcctaaattcagatgttcccaatgagatagcattaggaggtagggactttaagtggcgattagactatgagtgctcctccctggtgtacgggattaggtacccttataaaaggacttgatggagggcttttgtcccttcttgcccttttgccttctgccataggaggatatagtgttcttcccctccagaggactctgcattcagggaaccaccttggaagcagagggaaggatgctaattcaggttaggagtcactgaggaggtgacacttgatctgaggcctgaatgacaagaaagtacgaccaataaaaatggaggaaagagaattccaagaagaggaattagcaaacacaaaagtcttaaaatggaaatggaaaatgtgtatttgaaggatagaaagaacagtgtagccagaatatagagaataatgatgaaactaggaagagatagaaagtggtaggaggtgagggaacctcacttaagggaaccctcactcgataatgaacctgccagtcttaatttaaaacttctcagcctccagaactatgaaaattaaatttttggttttttaaaataaactaaacagtctcaaatattttcttacagcagcacacatagactatgaaaggcaccaaagtctaaactatcttgttatacaacatttctagcatcagaaacgtggtttcatagatggtaagaaaggtaagtgcttaagaaaagaggaaatagtcagctgtgttgaatgctattaataaatcaactaagagggcagagagatgtcagttggatttggcaacatgaagaacattgatgaccttgacatgagcagttttcagttccttagataaaaaataagcttatacatgtggattcagaagtgaataggggatgagaattctagatttaaagtttagaattttatttaattgttatctgtttaattgttgtgtgaaaatataggaatgaaagaatattgtagactttaagtaactaagacctaaaatacataatatagacaagacaattatggtcaaattagccagacatgaattagaatacttcatttgtaacttgaaataattataaaataggtatgtgattgattttgccacctgccaaacattatcaatgaatttttcatttcatttcttctctaaatattcttttctcttatttttaccctctcattttgcatgctttgaagtagagacctgtgcctccagaaggagcacaatcatgtctatcaaattatggccttgactatcactgaggcattgaattccacaagtatgtgcctcttaacctctaatgagcagcaggttactgtaattctgtgtgtgaatttctgggacagacattacaggcgtttctctcattgtgataaatatctagggaatctcgctgcaatgttggcatagtaaatcttaaatttgagtatatcctagcatcaaattatggtgtactacacaggtgataaaaacaaactagacgaacatttttgtttgcatctactggctttaagaggctatcttatggtaccaatgtgttctttagagaattggctggtcatgtaatattcttctatatctctataattaaagtggtttgtagctcaaactcttaagctggactttaagcaaaatggccatgaaatgccactcttagtaataataaaatgatttttagggattaaaaagaatgatccaaattgggatacataaagaaagcatattgtcttgattattatttaatctgaatattttctctatggatacagtcatggccataattccacagaagtagcattgtgatatggtgtcaactgtgtattaaaacctgtgttcacagaggtgaaattattatatttctatattttaaaaagtcattatcaaacatcaagctgttgactattcctttgctaggttcattttaataatcacagagaaagaaaacactaggttgctaatatagagcccagaagaaatgtttgcaactaactagtggcacaattttagctagttatttaacccatatgagtctcgattttcttatgtgtaaactgggaacagtagtgtctatttggcatgtaataagttatcagtaaatgttatctaattccaactctagtgggctggtagcatcatatttatgtacaaaagtcaggacatgatcaatgtgatgattcccatgattcaaatggaatatgacaatcagggtaattgtggcctaggaaaccattaaacatacagaagatactcatttattcagatgtcaatgcaaatctagccctaaattaaagaggccgtattagataacttatcagagacattcatcctccaaactgaaacaaaagataaacatctatgttttgcctaaacaaatagaaagaatctaactgtgatgcaaattgggataaaactgtagaacttgcctgatcattttagttctggagtgtccctcacatcagtcaacatggcatgactccttggctttgatttttggcactaattgtgatctttaaaaaaaaactcataaattcatttgattgagtttctgtggcacagatcaagtttgtactggtagagccaagtcatgaactttccctctgcttttccttggctcactctccaaagttcttgctgctcttcctgcaaaggacagtgacttgcttggctgccagctgccatgcagcaagtctggactcagatttttgtctctaacaaaaccaatgaaagtctgcattcaggttttgtctgtaacaaaaccaatgtttggaaatgaagacactcagtttatcaatctcttagttgacagaaaacaactggtttgactaatgttttcatttcattagcaggtgattaatgccctgaatataatacatattgaggtttaatagaaagaatacaggcttagggatcagaaagactgggcctaaagtcaagactttaaagcacctctttgatttttaggttctttatgtatagaatggttgtaatcaagcctgtgccataacattttggtgaggaataaatgaggtagcatagtgtaaactgcttgggtttaaggaaaggtaactaaaagtggtatgaaagaggagaagagaatgggaaaggaggcccagttaggtgataatagtaatatataggtaagaaatgataagcatgtaacaatagtagtggtgagagattaaacacacacacacaaacacacaatgcttctgggatctattttagatgaaggagtagatgtagctggagggtaacagagataaaatgtaagactgtgggagaagcagaccttcaaggaaccaagatggctctagttttgcacatgtcaagtttaagatgcccactggacatccaagcagagttcagggaaggggtgcaggctgaaaatgcaaacacaagaatcatcaacatatggatgatatttaaagccatgaggccaaatgagatcaccaaagaaacacacgcagaaggaaaagagcagaagatcaagggttgagcattgaatggagccttgagaacaacaatgtccagaggtgagactgatgaggatgtgccagaagaggagatcaactaagatgatcttcttttctgaattcatttacattttcaatatgtttgaacacctttgtgattttccatagtaaataggaattttcttaacattcttccagaaaaatctagaaaaggaatagttgttataaa

SEQ ID NO: 1314 - DNA, 21995 bp, Homo sapiens
tgaggcagtctgtggaggagaggctggggaggtcgctcctccacccatccatctcctagcctcttcctgtttcttctttcactcttgcccctttagcgctttccttccttccacccatcccctttccctccctggtccttcttcctttcacttttcttttcttctctatgactcattcaaccaacaaggatttcttggaaatgtccttcatgccagcatggtgacaagtataggggacagagcaggaacaaagcagtgatgggaaagatggaaatggaatgaataattacttgaattcattaatcttgtagatgatcctctctccaaagaatgtgtgtgttgagccacaggcctccctcatatgcacacaaattaggttggtagcatcaaccagattctttagccaatcagctaaagtgtctgacctccttgtacctgcatctaatttagcacacgggttacaaatgtggtgcctggagtctgtgttggttcaactcccagatcttctactcactggctctgtgatcttggacaggtgatttaacacctctgagccaaagtttcctataaaactgggaaaaggccaggcgcagtggctcacacctgtaatcccagcactttgggaggccgaggcgggcagatcacgagttcaacagttcaagaccagcctggcaaacatggtgaaatcccgtctctactaaaaatataaaaaaatagccgggtgtggtggcacacgcctgtagtcccaactatgcgggaggttgaggcaggagaatcgcttgaacctgggaggcggaggttgcagtgagctgagatcgcgccattgcactccagcctgggtgacagagtaaggctgtctcagaacaaaaacaaacaaacaaacaaacaaaataactgggttaataatatggccttcaatgggttgttgggtgaggattaaatgagacagagcaaatgaacagcaagcagcatagtgcctacctcagagtatgtgcccattggatggtggctgttattcttgctcaagatgtaaaacctcaacagcctgccgtgccagatgaaaataaactagatgcagccgggcgcggtggctcacgcctgtaatcccagcactttgagagagaggccaagccaggtggatcacgaggtcaggagttcgagaccaccctggctaacacggtgaaaccctgtctctactaaaaatacaaaaaattagctgggcgtggtggcaggcgcctgtagtcccagctaccctggaggctgaggcaggagaatggcgtgaacccaggaggcagagcttgcagtgagtggagatcacgccactgcactccagcctgggcgacagagtgagacaccatctcaaaaaaaaaaagaaagaaaataaactagatgctagttaccaagttaccaaaagcccatttaaagttctgagccacaggttagaaacaattatgtgtactatgtgtacaagtttgccatagggaagagcttgcttggctgtgcattttataaaacgaagaggttttactgaccacctgtattacacaattttttttttttttgagacagaatctcgctctgtcgcccaggctggagtgcagtggcccttagttcactgcaacctctgcctctcaggtttaagtgatcctcctgcctcagcctcccgagtagctgggattacaggtgcccgccaccacgcctggctaatttttgtatttttagtagagacagggcttcaccatattggccagactggtctcagactcctgaccttgtgatccacctgcctcggcctcccaaagtgctgggattacaggcgtgagccaccacacctggccatattgtacaattcttgagatctgactgctaaaaaaaaaaaaaggagctagggaaatgtgggccacatcaatataatagctcttatttattgagcatttagtatgtgtcaggcgttgtgctaagcttttgatttacaataagtcacataatccttagctaacattattatcagcactttacagaagaggaagtggaggtcagaaaggtcatatcctcagtctcagtcactcagctggtgagtggcagaagcaggatttcaacagacgggtgcaaagcagagccctgctcctagtctctgagctgagtgccgacttagggaggcaatgttataccggtacttgcgcccattcatctgacgacagttagaacagtttcttggatactagacaggagatggggagacaaggagagttaggatagggaggtttttttgtttttgtttctttgttttttcttgagacagggtctcactcctttgcccaggctggagtgcagtgcgcaatcttggctcactgcagcctctgcctcctaggttcaagcaattctcctgcctcagcctcccgagtagctgggactatgggcaggcaccactttgcctggctaatttatgtatttcttggtagaggcatgatctgcccaccttggcctcccaaagtccagggattacaggcatgagccaccgtgcctggcccagatggtgtggttttgagaactgcgttttcataggaggaatcaaagagattgagcccagaaaaacctgagaggtttgagtgtcatagaggggatattctgtacagggggcaacagtctgtcaagaacatttcctgtgtaactgccactctctggcaattacacaactgctcccctctcgccctggctcaaaattccaagccctgcaggcttctggcctcaggtctcagaaatgcctgtctcacccttcttcctttctccacgctctgcttgtcacccctctcccgcctggtggccatctcctggcagtcttgctgatggtacttctccacccctctggctggcctctctgccattttcttacttctatctgtgcctgtctaccaccaatagagaaattatcctgaagcacttcttcactgtcacccgtggctcaaaaaccacactagctcttaagttttatcagtcgcttggagccagtcttctctacctgaccttttctgccttctgtcctgccccatccctcccatcctctgcctggtcctcactgtcagggtgtatccctatctctcagtgcaagaatgtccctgctccatgtcatccttcaaggggtcacccgcccccaccatggcaccctctctgtggcagctctgatacttactatctgtatcgcacagtgtaactctttactcttctctaattgtattacatgtgtcttttccccagggcaaagtggtctctttaagaataggcacaattaggccaggcatgatggctcatgcctataatcccagcactttgggaagctgaggtgggaggactgcttgagcccaggagttcaagaccatcctgggcaacatagcaagaccccatctttaaaaatataggcaccatttattcaggaactgtttatcacatctctgctgtctgcagacattatgctgagtgacagtgtggcgtaaggcagtatggcccttgtcctcttgcttacctccttccagggtccctggagctttatttctcacagtgccagcagagacctgtgtatatagtcagtgtcctttttcctctggttgagtgggggccaaggagggcccgagacttgagtctaaggcctctgtgttccctggagcgaatgtgttcttttaggcctgggtccatcttggctccaggcaggcctggcttcgcattgggggagactggtccagattacagctggaagcacagccagctctttggagaatgtgacccaaatatcaccccttgttgaaaaataaggtaacaacagctgtagcatttagaatagaaaataaaaagataatatccagcattttcccagtctctagcagtgactcttattttcgagtatttatccattctcaagtttttgctttggactatttaattttgttttttgttttgttttgtttgctgagatggagtcttgctctgttgcccaggctggagtgcagtggtgtgatctcggctcactgcaacctccgccacccaggttcaagcgattctcccatctcagcctcccaagtagctgggattacaggcatgcaccaccatgcctggctaatttttgtatttttagtagagacagggtttcaccatgttggccaggctggtctcgaactcctggcctcaagtgatctgcctgcctggggctcccaaagtgctgggattacaggtgtgagccactgcgcccagcctgccttggagtatttgaatgtggggaagttcaaaggattgaatgatggagccttgttgaatgctatagtagtaataatagtgatgacggttgactcaggaaaaggtgagagtgcagtttccctgctctcttcgttgttcctctgtgtttcctgcttactgcttcctccagcctgtgagcgcagcctcccctacagtggtttgcctgacctctcttgaagcaggttgcttttctagctcatgggtaaatattgacctatttgggtttcaaatgcctgcccctcgaaactcatgcagggctagaaaaacatgctgggagaacatctcttgagaataagaattgcttttggttaggctgtatcgtaattggcccactcactgattccttgcttgcaatggtcagcactgtgctggcctcccggtgggatggtggtggacaaaggcagggcactgctccctgccctccctctgggagtttgtggtccagctggggagataggactcatacagtgggaattcttggaggctgtataccaagcagctgcaaggatcctgaaggaggattcttggctgagtgggaggtagccctctgtgaccaccagatctcttctaacacttaagttttctggttttaagtggaattcagtcaagtgccaaaatgtctgttgtagacaatgggtgacgtgggctggcaggaaaagaagcttgcccttcttgtaaggaggggaagggaacagggatgggctgtggggaagtaggctaagaggaaggagtttctgtggtttgctaatccactggtattcatctccctgaaatgtccctgctcctaggcttctggcttataccagggcctcctgcctggtgtctctctctgttacgtgcacccaaagcccagtgcctttcttgcacatgacccagactttctctctcccctgtcatttcaaccttccccagcttggatccaagacctcccttcccagtcctctgaaatgagctggtgttttctgttaggcaaagctgccccccaggctgggaaatccaagagttagtctcatctctgtaagttggaccccagtgaggaccccagctgagtggaaggctggaggccaaaaaccggtaccactgaggttcccagacggagagggaagttggagcagtgatatagggagcaggatcaggccaggaggcagaactggcctgaccagtcagaggcccaaagaggaagatctgagcttctcagtttggggatagaggggttaggcagagactatgatgtgtgctgcttcaaaattacctttctagcctgtagggtaggtctcctccctgtgtgttccagccaggtagcttggttacccattctttgctgccttcttaggccagtgggaaaccttagggcagctgtgcattgattgggtagacgccattctggagcaggtgagaaaagaatcagctttgtgggagggtggggtcctgggaagatcccaccttgggacagcttagaggaagctgaggtgctggaagccgggacttacctaggtcctaggccctgccttgacgtgcaaggggaggagcctgtgagacttaaggtgtgccgcactcaccccgaaggccagaccttcactccgcacacatcatacccttacacgaaggatgctgttactctcatgctgtacccacctacagggggagaaggaggcttctagatctcaggggcagatgagggccaggtgggggcctcatgcagccctgacctcgggcttggtgtccaggcaggaatagagttggagcggtgccagcagcaggcgaacgaggtgacggaaattatgcgtaacaacttcggcaaggtcctggagcgtggtgtgaagctggccgaactgcagcagcgttcagaccaactcctggatatggtgtgaggcctgggggagcatggaggggaggggagaggattgggaaagtctctcttgggctgtattcaggatctccagttccttggtggggttgaggccttcttgagggccagtgtggggcctctgggtttcctcaggcacccatagcctagacatgcaacagatagaccccacaagataagaaggccttggtttgaagctgtggaccttcttaaaggtagaaaactggtatcgttttttgtttcttttttactttgagacagagtctcactctgtcgcccaggctagtacagtggcacaatcatatttgctgcagcctctacctcccaggcttaagtgatcctcctgcctcagcctcctgaagagctaggactacaagcctgcaccaccatgcctgtctaatttttgattttttgtagagatgaggtctcaccatgttgcccaggctggtcttgaactcctggatccaagagatcctcccaccttggctttccaatgtgctgggattacaggcatgagccactgtgtccagcctgagtactggcattgttaactgagggtgagacactagggctgaaagtcaagggccacaccggtgtttgagatgagtcaggctgggagggttccacggcaggtggtatagaaagagagcagacaaggccgggcgcggtgtctcacgcctgtaatcccaacactttgggaggccgaggtgggcagatcacaaggtcaggagttcaagactatcctagccagtatggtgaaaccccatctcaactaaaaatacaaaaattagccgggcgcagtggtgtgcacctgtagtcccagctactagggaggctgagacaggagaattgcttgaacccgggaggcagaggttgcagtgagctgagattgtgccactgtactccagcctgggtgacagggagagactccttctcaaaaaaaaaaaaaaaagaaagaaagtagacaagatggggaggatgcaggaggagactaagccttactgagatggggttgggaggagctggctcccaggccaagagggtgccagctaactcccactttgtgtctgggggtatccgcagagctcaaccttcaacaagactacacagaacctggcccagaagaagtgctgggagaacatccgttaccggatctgcgtggggctggtggtggttggtgtcctgctcatcatcctgattgtgctgctggtcgtctttctccctcagagcagtgacagcagtagtgccccacggacccaggatgcaggcattgcctcagggcctgggaactgacccagctggtcctgaaggagaagccaaatggctgcactggccgattctggtctccagaggaccttggtgtttgctctcccttgacccaccccagtgagtgccaaagggcagccccaacatgtgcacccctgcatttcctgtcatgccacagactggcccttgagggcagcctgctgtactggccatgctgggccagccccacctggagctcagtaaaaactgctgtttgattaaaagctggtatctgtgtgtgaaggtccccaggttggttaatcccatctgtctctacccctagggctgcttaaaaagcccatcacccaaaggactccacccctgggagatggctccttcctctcccttccctacttgatccagcccgacacagacagggagtgtggatgcaagaacacaatggcccccaaagcagacccttgaaccagtcctccccatctgagcctgtttctctgagaatgaaatctattatttttctgtcatcttggggatgcttagaggaccaatgagactgtagatgcgatgacaaagaagaaagcacttcaccaattttttttttttttttttgagacagagtttttgctctgttgctcaggctggagtgcaatggcactatctcagctcactgcaaactccacctcctgggttcaagcaattctcctgcctcagcctcccaagtagctgggattacaggtgcccaccatcacacctggctaatttttgtatttttagtagagacaaggtttcaccatgttggccaagctggtcttgaactcttcacctcaggtgatccacctgcctcggccttccgaagtgctagaattgcaggcatgagccaccgcgcctggcccaaaaaatttttcataaggctctcaccttcagataaatggtttcccctctgaacacttcccactcctcaatttctctttccacattctatctacctcaagctttacatcagactgcagatgggggaagtgacagcaagagatggggaccttaaagcactccttggtattcccatctccctccctcccttccttcctttttcgacggggtctctcctgtgtcttctctccctccctctttcgacggggtctatgttgccgaggctggtctcgaactcctgggctcaagcaattctcttgcctttagtgctgggattgcaggcgtgagccaccatgtccagcctgaattcaggcttttcaaagctacagggccatataggccagggaggcagtgccttcagggccatagcaaagatcattgggcaaaggcatggaagaaggaaataaagccacaccaagactgtggaaacagggcagcctctgcctgggctacttagctgcagttcaaactcaggtgtgagtggcaaggggaattcagggtcaagtgtgtaaaataagcagttccttgctgggtaaagtgagcgctactgacagaaaccagaataagcctgagttgtgtggagcttcaccccttacagagcgtgttagttttactgagcgcattagcgtcttcctctcttgggaaagatggaggaaagcacttggccctgcagctggtctgcaacaccacttacagactgcaaatttgggcaagccacttctgaggtaaaaagggcataatgacgcttagctcctgggtctattgaggggatgatcgagcgtgtaaaacatacatcagactaacagttctagatgctaaatagtacctatcatccaaatcattgagtgcagtggttcttaaacctgcttcacctgcataatttatacaagtgccattgcccaggccccaccacagatcagttaaatcagaatcttcgaaggtatcagacacgggtgtttctaaagctcctccgcgcccattctctcctctgggaattcatgtgtagccaggaatgaaaaggtcttagtacaagccagcagttttacagaagctagggatagcaacgggctgaaggtaacagtcccatgagctggttgaggccccaggttctccggcaaagagatctctctcagttggggaggcttgccccaccctttattattatgcctaacacataagaaatgcgcaggaatcaaacgcaaactggtgaaccaactagagggccgcgggggcagaagtgtccggcggggatccggacagcgcatccggaagcgccatgggccaacgctcgcaggaacctgaacccctgggccagcgccgcctttgctcgcagaggcctctagcatctgtactgtcgaagccctctgagcttcagggcagactgaagagccttacacaccagacacttggacgcgatcgcgccagaaatccccgggaattcagtcttggctccgactccaaaacaaatgattcctcaccagccagatctccatcattggcgttagtctctggtcacctgacttgttcaagccaatgagagggggccgaattagtacttccgctttccgtgctgtttaacgagccactatgcccgtccctcggatactctgattggccagcctctctcagctcgtcagtttattggccagcgccgctaggccgctatcgagcagggtccgagggctgtgtcagaaggctgggcagccatggcgtcctatttcgatgaacacgactgcgagccgtcggaccctgagcaggagacgcgaaccaacatgctgctggagctcgcaaggtgggtgcgcggggcttggggatagggtccaaccagcaggtttctgggctggggctggctggagaaggcggattaccaggggcagcggattctggggaggacagatgagtaatctggagtgttagtacgggcggcgagactgaggggtgtggggatgagcatctcgataatttgggccgtccgttgggccggcctggggcaaggggattgcgggaaagattggagctggagagtggtgggcgtgggggcggaaggacagcaggctctgggaggtctcagagaaggtgaggcatgggggcggggttggggccgtgtgctgtgagtgggtatattcatcagtaacagcaggcactgctgttactggacctggaatctggcttggtcttggaatctgggctctaccaggttattcagcgtagcctgagtaacttctctgaatctgttgcctcatgtgtaaaatgggaataaacactttacgtgctggggcggtctgatagcagttgtaaactatttcccatcgtgctttttatctagtgagcatctactaactactaagggtagctattattcctactagctgggcagcgtgtttattaatgtccagtggattatggggacaaagaaaaagcatagttttcctttgttctgactttacatccccttccccaggtcacttttcaataggatggactttgaagacttggggttggtagtagattgggaccaccacctgcctccaccagctgccaagactgtggttgagaacctccccaggacagtcatcagaggctctcaggctggtgaggacactgattctttctgctatttgggccagacccaccccttccccaagccagactgtggtctggtccttcagttttccaggtcaggtgggggcaagtgtccttcaggagtgggagcttgggaggcagagcctgtagcagctctcctgatcagcactccttcctaaagagctcaagtgccccgtgtgtcttttggaatttgaggaggaggagactgccattgagatgccttgccatcaccttttccattccagctgcattctgccctggctaagcaaggtactgcttctcttcttctagctctcaccgtgccctgggcccagtactcaagcttctttctgttcatggactgctgggggatggaagaagagtggcagttgggagcaggggagggtggttatcagcttatgaagatcagaccaaggctagaacactactctacttttctcagacaaattcctgtcccttgtgccgctatgagctgcccactgatgacgacacttatgaggagcacagacgagataaggtaggggctgatgcttaagtggaggggtcgtaatgggctccctgagtcctgtccccgctgccatcacttcccacctcagcaggactgggtaggcctcagaatccctggctctggctgtcttcttagtgactttgatttgtggtgagagcctcagcaatgcagacgccagaggcctgaaaacagagccagccccataatagctgcccatcccctcacccataggccttcagttttggcccctgcccagcatgccttctttccttcaggctcgaaaacagcagcagcaacaccgactggagaacctccatggagccatgtacacgtgaggaggttggggctgagtgctggccctctgcgtcttccttattaaccttgaatcctcattaaaggtttctttacccaccctgaggctgtattgatcacagacctggccaggggctctgcatcctccatcaggtctctacttctgttggggaaggtgatcctaaatcgcagaaggcaccaggctgcggttttcctccctgctggcccatctggactcatggcagtggtaaagaactggattactgcaatagccagggcttgggcctatgtgttcatggttggaaggcaaaatgtgtcagggtctggtacccagttaattacttaaagctgataaactaggctgggtgcagtggctcatgtctgtaatgccagcagtttgggaggccaagacaggtggatcacgaggtcaggagttcgagaccttcctgaccaacatggtgaaaccccgtttctactaaaaatacaaacattagctgggcatggtggcacgcacctgtaatcccagctacttgggaggctgaggcaggagaattgcttgaacctgggaggcagaagttgcagtgagctgagatcatgccattgcactctagcctgggcaacaagagcaaaactccgtctcaaaaaaaaaaaaaaaaaaagctgataaactagcctgcaccctcctcccactgcaatgtctagttaactttgtaatcccacaggttttctttttgctccattgagaaagccacttttaatattttaaagttgctctctgtaccacccccaccttccccccatgcctcctaaggaatcaaagttcaaaccagactctgagtgggggatgggtgagattatcagaccaagttagttctttagattgcttagaggcccagaagggtttcaagccctttgaaggggtatttgggtggcacctggcatcctttgtttctggcaacagagtgcactcagcactcctggggggcaagggcttcctcccatccttggcttatggaaagccatcccagatcaggccccccaactctccagaacaggctacaaacatgcaaattagaattcttttaatataaaaaaaagtactaaaatacccacgtggttctgctgtgttatttgccctaaaggaagtgaggggcagagtgaagaatcccagtgcagctcagtgggcccagaaatgggcctttccgtaggctaaggcgtgcccactccacctccaccagacttctatcccctctgctgttcccagcccccaattcctgcagcaggaaaccccagtggtctggctttggcactgggagtagaaggcacctgaagggctggctgggtgagtgaggacaggtgacctttaaaaacaaaacgacaccgtggggtggggaagcaggtcatgcagctgtggcagctggcagggcccactcctccatggcacaggtgggcatgggatggccacttctccagaagtgaggaagcccagatcccaacagaatactttctcaaaattgtttttggtacgaaataaatggaaagaagatatggggtggggtgctgtggaggccgggccagccaccctccccagaccttagatcatagcgatgctctcgggggcacagttgaggtgggtggaggtgctgctgctcccggaggacttgcaggcccggccaggggtaggctgcagtgcagccaccagtgtgtctgaggagactgccccaaactcgtagctgaaggtgccatagaaaatgaggatatcgatgacacacacccactcacacagggctgccccatgttgcagctgagaactctcatggacaaagaagactccacctaaaacgaggctaaggaaatgttcagtaggacatacggaaacctggcaacaccccttctgcagtctcaggcctcacctctccaaagggagaggtgttagtcctctcccccacatggcagtgttaggcctccaccccccatcctcttgggagggagaaaggttgagctagaggatgagttcctggctgccccgtcctgaaaggatactgaggaccagggtgataaaggcgatgacagccagcacacttcgcagataggccacagccaggtccagcggggcggtggccccttggtaggagagagcacagtgcaggcaaacaaagagcagccccgcagggaaggccacgccagctccaacgtagtgcagagacctggcatgatccacctgggcccagagaagggccagttggtgatgtggccatggccccacctctccacccctccttcaatgaatctcctctctccctcttccttcctctccctctttccagccccaaccttgaggtgccacactgcaggcagccaggccttgttaggtaaagtttaaggtttgcaggggagaaggggaagcacctgaaagttgccaaccaccaagaggcccgcagcgttggtgcagcctgtgatgagtgccgtggtgttaacccaagagtgccgactctgctccaggagctgcccgtagcgcaggaggcagatcagggccactgggggaggagagcacagttgaggccttcctccagccctggccctgcccagcgagcctgtcagcttcccccagacgctgtggtgctcctgccccttctgaggggcagaaaggaacagacaggcgggtggtgaactaggtttcctcaggctccagccagcagggtggctgtgtgggagtcagcttttggccttcaaggaaggggagaagctgcctctattgccttagcccttggtggggagggctgcacagaagggcttcctgggcctttctgtgtggggatcactgggctgggcacgcagggtcagggctaagggtacaactcacccatgaaagcacccatgttgccaatgaggctgaagaggcagctttctgggggataggagccacacttgctgcgaggagggggaaggacagagtaagaggggtgcaggaggcccggggggcccccattttggctcactggctctcccctgctttacctgcacctgctccttagcaggcaggccactgatttatgtgaagatccagggtccctcatgaacaactggttccaggctgggcccccaaagcagagctcatgtgtgtgagagagaagggagtgcccaggagtgttcgggcaaccctgacactctttgctgagccctgcggctggtttggctatccttgagccagaacacgggctgggcaatctgagggctccagcttaaatccaggtgcctccgcttattagctgtgtgacctggatgaggaagactgagcctgtttcctcacctataaaatggtgaaaacaatacctgcctcactcctgggaggatgaaaagagacaatgcatataaagcactcagcagagtgcctgccccacagtaactgtcaagtagtgttgttattaagtggctcttaggatacttattgttcctgagacccaaggacagctctttgcttgaggggctgtctgggaggcccttagatctccctgaccggcccaatgtccaggccttacctgatgagggggacatcgtccagggtgcagcaggtcttgggacccccttgctcagcagggtcaggagggcaggactcgttgtaggacctggcaggcaggacagggagtagactgggggaagggactgcccccaggcccttggcctatagcctcaggcctcaaagaggactctctcccagacctcccctacagggacagaagatcccactccccagtgcccgcctgaagcagtaaccaaaggggcaaagggatagtgggaagtgggtaggtggcaagaagccatgcctggggaccaatttcagagaagagcagtgaggctcagggttgcagtctggctcgtggcagcctcaggcccaagaggggacagagatgaaggaagctttagagcaaggttgtctgcagagtccttcataccagttctccacagggcatacatggtggttcatcacagccatggcatacctgtgggaacagaactgtcaccctggcagccttcccgagccccactcaacccaccccatgacccttctcttcaaccttgatttctggccccattcagcctcattattgttgctggggactcaagttgaggtccctaaggcttgatgccacaccagcacctgcagcatgcccccagctacaggccctctggaaattgccctggctagaagtatatttgtcagggccaccctgctggacagcagtggtgccagcttgtcccaaggggctgtgtgcccaggcaccaagtcaggcttttgagacacccagagtgaccctgggtaccaccgtggctatgacaggacaagagactttgtgtgcgtcatcaagctcctgttgccccccgggcacccccctttactcacacagtccatatgccagtgatggagaacgctgacaggctgacaggcaggaggatccaggcggtcatgagggaggggagccagggtggtggtggtgttggggggaggacaagaggtagatggggaagtgggggcggaccagctaccttgagatgtttctgccacaaccatcagctgtcctggcctggtggagagagatcaaagtccaggagtgggtaactggccgggaagggggaggggaagggggtcaacaccttatccagcgctcccgttgggtctctgagcgtccaaagtttgggctgagcccacggcagaacgtgaacaccctctggcactgggggcctccgcggtcaacccaaatgccaccggcgtgctgagagacgcaggcggaccgtaacatctggaagggagttaccctccttctgagggaccagggctgggagaagggctggacaaccgaagaggccacgccaaggagaggctgggtgccggcccagtggagcggtggcgagtcggcggcgcgcaggcaaccacctgaccatcggcgccctgggcgaggggcgggttcacgcggaaagcccagcccggcccggcccccgctcgcctgggcgcggggaccccggctggggccggaccctgcggccggcgaccccccaggacccgggacgcgagagtccccaggtgattcctggaagcccggaggaagggaaggagcccagtacgcacctccccggagcgccccgccgccgccgcaccctgctcggccccctcgtggcgccgactctagctgcggccctcggagcagccctgaaaggtttaaagggccgagcggccccgcccctggaggccccaggcctcgccgcgccgcccgccgggacgtggagtccgcgcagccccggcctcggtgcccgcgccctgcccgagactacaactcccgagcccccgcgcccgcgtcacgggggaaacgtgggcggtgtcccaacttcggaggacctgggcgcggagggctgtggcgtgaagaccgctctaaaaccgagatgactagaggttccgtttaaccgattcctgccggggaagcgtcagcaggtggggatctcggggcagcctgcattccagctctacctgggattgtcgccgtgcacatggctggaggagcgtctctccgccactgcgcacattttgcagcctgcaccggccaacggtgagtcctctaggaagctctctcaacgtggcgccccatgcctgcctctggccagggctgcggtgggtccagagaagcagacacaaagacttggctgtttcttaagaaatccaagcgcctgggatttggcttatggttcctgtggctcagcaaactccggaggagggctgctttcattagatactttttgctttcctgcatacaagtacacaatgtactagccagaaatcagtgtccaagacgtgtttcccgactgatcaacacttatttgaaataagacggcagagaccagaggacatccattctaaatagacacatgtaggtgtcagtgtagagtaggtaaggattaacatggccagtgttggtaagcaaagaggggaaggtgagagacccggaggaatctgggaaaaggaaacaggatagtgtgggaaaaattactgaccagcttcaccaaaaacttacaggctatgagtgcattcctggatgtttcttttttttttactttttctttttcttttttttttttttgagacggagtctcgctctgtcgcccaggctggagtgcagtggcgcgatctcggctcactgtaagctccgcctcacgggttcacgccattctcctgcctcagcctcccgagtagctgggaactacaggcgcccgccacctcacccggctaatttttttgtatttttagtagagacggggtttcaccatgttagccaggatggtctcgatctcctgacctcgtgatccgcccgcctcggcctcccaaagtgctgggattacaggcgtgggccactgcgcctggcccggatgtttcttaaattattgcaagggtggaaatactttcacatatcagaagtgtgcctggcattctgtctcaaaggcggtcccagcatctgttggagcccttgtgagatgacagatcatcacctgaatggtgcacaggcgcaggttgcccagcgtggggagctgaagtttggcaacactggtgaggcaaaggctatgtgaaacaacagggtcctgtgctttagagaagtagagcagaataaactgcacaatgacttgaagagggagaaaccttcttggacccagtggaaagcagaaatggaagcagaaaacctgttggagagccctttttcttttgagacagagtttcacttgttgcccaggctggaatgcaatggtgcaatctcggctcactgttacctctgcctcctgtgttcaagtgattcttgtgcctcagcctcccgagtagctgggattacaggtgcctgccaccatgcccagctaatttttttatatttttagtagagacggggtttcaccatgttggtcaggctgctcttgaactcctgacctcaggtgatccgctcgccttggcctctcaaagtgctgggattacagatgtgaaccaccgtgcccagcgggagagccctgtccttaaacacattaggacaagtagttaaaacagggccaagaagtatggctgtgtagtgatcactgtacaagcacacctggctgaataaaccagtgggggataaaatccagctcacctgccgctggctatgctttgtgcctcaggacaagggtgtgcttccttgctaattgacaggaaccatcttcctgcccaactgcattcccactgcgtaggcaccttatctgcccaatggggctgtgaaccctaattggaagctttgcaattcttaacactatatcttcttgagctgggtttgagtccctatccaatcaagatgaaggcctgagaggactactcaagttctaacatgatgtgggggcaaggcatagtagtccagatccgggacatgaggcagcttttggcttagtatgacaatctaatagttcctaaaatagaattatcccaggatggagctccgtatgacagaagggctcttcataggtagttggtagggggaattgtgtatcatgtaagaagtaggaccagatgtctttaaaaagaccttccaactctaatgctacatgagtctgtctagttgttatgttccaacagggacagctcttaaaatagtgtggcaaagcaagagatgagatttccagtgctgactcggtggtggaatgactttagggcaggtatttaacctccacttccccaagtacacaagttatttcacaactcttggcaaaaacagtgctgtaaaaatcgtaagtttatttgttaaaaaaaatactgtatttgaaaagtaccttccttctgggattttcaaataatttgtacactacattttattcatctacacattggaaatgagtaaactggtgaacatatagctttttatacatttaacacaaccagtgcaaattctcctgcctctgagaaggcagagaagccctttactcagaaggtcttcaattctagcattactccaactcctagggaaatttcgggtgggtgcctatggctgtatgaccatctgattcctcagggacaggacaggaattcagcaagggagcttaaaatattttaagtaattgtcaacattccatggtgactctccccaaaaatctagtggtaggaaaataatctgtacttattcctctttctgcacacaaagccctcatttaaatttgtgagcctgcttgggatccattacctagccattcagagatcctgtcaaatgcacagcagattggatactcaccatcccaaaggggttcctcccacctggatggggccaatctctagttgacagtgcccctcagagtgcaccatggagatggaatgtcccttccagagagacttttacacagggaaaagcatttgttggctgggctccaactctcatttggtacaaaaagctttacattcttttccctttttacattacattcttcaaagacttccgtgcttgccagctggataacaactcaagctctagtgtttactcttgcacagccccaaacccttggaaactcagcttcgttctatcagtgacatcacccattgtggccgaggaaccacaaaaccttaaaatacaggcttaaattcagcaagcgaagaacattccatattgaatgggcatgagatatgcctatcagattgtgtgtgtgtgcgcgttttttaaagacagccaattacatcgtatctagtcaaatgagcggattctaaagcagcctgctgggatgttccacttagtctaatgctgttgccactgtacgccacagcaccggacagtgttctttgggacatctctgggaaatgctctggaacatgctccttgatggaaaacactaatttttgaaagaagtagatgtctggaggcaggtctggtgaataaactgaatagtactgccttggaccccagctgaggggtggcagtaagcaatgaggatgggctataaagctgttaactggctaagggccatccttgggcaggcatttcagacacatctgtagagagggcagtagcatctccgataggccagctctgaaggaagcttaatgcttaatacagtcacactgcataaattagcttagaatgctctcttgggtaaaaaatattaatagtgtatatgcacttgaaaagcaaaattcctcaagaaaaaaagtttaatagcaaggagtttccatcagtcccggtctttgtgaggattaccacaacaaacacttaaaaggatacaacaggtacttattaaatgctgccttgccttttacctcttccttttttttttttttttgagatggagtctcgctctgctgcccagcctgaagtgcagtggtgtgatctcggctcactgcaacctccgccttccaggtttaggtgattctcttgcctcggcctcccgagtagctgggatggactacaggcacatgtcaccatgcccagctaattttttgtatttttagtagagacggggtttctgtgttagccaggacggtctggatctcctgatttcatgatccgcccgcctcggcctccctacctcttcctttacttaataagaatgcggtctaaattttcaggtgccaagcccccaaactcctcttctagccttctgaattgtgtaataaaaccaggaaacaggtgatccagctgtgcgaaaacagacctcaaatgtatttccagactaaaaagccagacttgcagtgaaatcctatgttccaagtcatcagatcagtttaaggactagaagactagaatgactgactggttctctgaccaggaagaacaggggtggagtttgggagagccttcttgacccaggaggctttggagggtagttaacattagaagtcaaaaggcacttctagcccagctgcctaagtagaggacaaagactttctcctttcaaaggagaactgagcccaggattggtaagtttaaggcacttaaccttgaccagctctgtaggtctggagcattctggtccctggccgctttcaccaccaggcccttctcacttatccacctcacttactgccccagcattcctttggcattgcgagctgtgacttgacacattttaatgacaagattgaagtagctaccttgcaggatagattttctggggtataggggacaaaccaacagtgccatcaggtgtcttaacacccggatgtggagaaacccctggggcaagggccta

SEQ ID NO: 1315 - DNA, 84985 bp, Homo sapiens
tctactataccttgtctgcgccttcatctctgacccagtcggttctctacccaacccaaaccccacccctccccacacaggcacaagtgtcctggccctcattacccagcatgctcagggaccacatcctaccccccccaaattaggagcactcacccacctgtgggagtatctggcccaggctgtgcacttctctgacgggcagttcgtgctgctggctttcagccgcctgtctccgcacacttgatgctgtttctattttttgatttgagtttaattataaagcatgctgtctactcccctcttccagcctcccctgccactcccaacttgtccactggttccatggcatggccagtgccaagcacagtcaggcacctttccctccaggcccaggcctctgtcccagcactgctaagaatcaaggcagctcagcccaggtctgactgtggcatattgtgtacatgtatgttgatagtgggagaaggggccgggcgcggtggctgaagcctataatcccagcactttgggaaaccgaggagggtgggtcatgaggtcaggagatcgagaccatcctggctaacaggctagccgggcgtggtggtggatgcctgtagtcccagctactcaggaggctgaggcaggagaatggcgtgaacccgggaggcagagcttgcagtgagccgagatcgcgccactgcactccagcctgggcgacagggcgagactccgtctcaaaaagaaaaaaagaaaaaacaaaaagaaaaaaagagatagtgggagaaggaagatcaaataaaccattttaaaaggtcccttggccggatgcagtggctaatgcctataatcccgacactttgggaggctgaggtgggaggattgcttgagcccaggggttcaagaccagtctaggcaatatagccagaccctgtctctactaaaaatacaaaaaattagtgagttgggctggtcgcggtggctcatgcctgtaatcctagcactttgggaggccgaggtgggcggatcacctgaggtcgggagttcgagaccagcctgactaacatggagaaaacctgcctctactaaaaatacaaaattagctgggcgtggtggcgcatgcctgtaatcccagctactcgggagcctgaggcaggagaatcatttgaacccgggaggtgggggttgtagtgagctgagatcacgccattgcactccagccttggcaacaagaacgaaactccgtctccaaaaaaaacattagctggttgtggtggcacacacttatagtccctcctactcgggaagctgaggtgggagaatcacctgagcccaggaagtcaaggctgcagtgagccctaatccttgaccatgccattgcactccagcctaagcaactggagtgagaccctctcccttggccttcaagggtattatagaagaagggcaggaagttcaagttggaaggatgttctgtggaggaggacagtgaagaggctagccaaaaatcacatgtaaactggtggcattgccaacagcaggacccaggtccggggccctcagttaggggccaaggccgatgggacaggtccaggataaagacctagaagactcaggctgagggaagcagcacaggcccacacacagacacaggtgtagagcaggtcttcagacagccctgggctgcaggcagaagcagtgtgtccagggccactcccaccctctgccaagctcctcccccaacccaaaaggcagggacacccaggccccactgtcccctgaggccagagagatggtctttaaggtctctccccatgctaactgtggtcagctaggaccttcaattgggcctactagaaatcttctctgtcatccacagacctttgtcatacacacataccttgatactactccccgcttgcactcccagatggtgggaacagggcacacccatgcctgcagccatacctgcactgggtctctgaggtctgagctccagggagctaaggctcagcccctcctggggctctctgagccctgaggggagctgctggagacagctgtggccaacagctatcacaaatatctggaacccccttcctctctcctcccctccccactttcccagggaacttggggtccctggccaagaagcctgagggcttggctgagaggggagcccactcccacctgtggagactgaagacagtggctgagagggggtgtaggcgccaggaggagccagatggagtagcaggctctagggccgaccccacgctgggcttccaccatcttctgtgtgtccgcctgggccagagcctccagcagcaccagcaggatcagtgccagggtggcaaagtggcagagccccatggcagggagtaaggaccagctctggaagagagatgagctctgtgttacaggcaggtgaaccaaggcccaggctggctgggacttgttggggcagggataagagctgtcacctaaacctgcttctgccttgagccctgtgcataaggtcaagtgagtgcagctgctgggagagatgaggaggtagatttggtatccatggcttagggacagagatgacctctccccatgggccccttatctttcagagtacctggacccagagctgctctgtatggctgcacaggctgcacactgcataactcctggggcctccagttgcacagtttggtggatgacacctccatgaattgtgcaatgctgtacccctgcctatccaacttccccaaagtcagctgcctgatgggaaagatgctgaggtcagaggtcagggagcctaaggccccaggctgagggagaagggtgactgggcatggtccgagatctgatgctccgccaggttcctgggtcctgtctagaggagagagagcaggcagggaatctgccattccatgggaaacatgcccccttcagaccttctacccacagagctccatgccacagcttggctacaggccaatctcaagcccagctataacccaaagtttcttatcacagtcacccccaaactctaaacttagcccctgatccttccctaatcctgctcctcaagatgcttatcctccagccagcacaggggaaggggtcgatgctgctgaagggcctcccttctgcttgggctggctatgccttcagagacaggaactgctcttaggggtgggaggcagggagagagtcaggccctgccctgggaggtttctgggaggaaaaagctactgctgttccagctcccaagcatgcccaggccagtcacccacccccaaatggcagcccgtctgtggcatggggtggtagggacagccaaagacaggcttgaggcgagacaggcaaggagttgtagaggaagcagaggtggaggcaggccctgctgggtggggagccaccgtggaggcctggccttagctcactgatgagaattagctaagcctggaaagttttctctgtggcactgtacctggggtccagacctagggggaaggggatgtggaggttcaggagggtccaggctggctgtgcagatgcctcagtgagatttaggggagcccccacaggctttcagctgaggcagggcaggttggccccaagaccaggtaggaaagtctcccctcttccattttatgctttccacaccctcgcatcctagtccttctcttctctttggggtctgaaggatccaggtggggtgggggatatgggttgggggtcctacaggagaattgcctaggccaggcccttgggtgagaccctgggtaggttaagggaacccagcagtttggagagagggccaggccccctttaatcctcacttccagccacacacagccctgccaaccaatcctggaagaatccaatcctatgtctgcagcctaggccctcacctggcctcttccggccaaccacatccagctttgccccctgaggcctcacctggcccctcagctctggccggcaccccgcagttgctggtccagcctgcagagctggtgcaggaagcctcggttggggaagacccatcggtgctgcctcacggtgatcaccgcctggcgcagggacagccgctggtgcagcatgaggtaggccaggaccagcgtggcagagcggctcacgcccaccacacagtgcaccaggaccttggctgaggaagacatcctggtgaaaaaccctgtcccacacaccggcccacccacgggctgggatggggacccaagttcctttcctgaccctgccttgggtgcactctgtgatcctgagcaagtcactcagcctttatggacctcagtttcctgatcggtaaaatgggtagatcaacacctgttctgcctacccttgggatagggtccgaatttcttttttcttttctttcttttcttttttttttttttttttttagtagagacaaagtctcactatgttgcccaggctggtcttgaactcctgaacttaagtgattctcccaccttggcctcccaaagtgttgggattacaggcgtgagacaccgctcctggcctccaaacctttttaacacttcaagagctggcccctgtcgcctcatctcagattgtccctcccccaccttcagctcgagaaacatggaggaacttgcagttccttgaggctgccatggtttctgacctccagccttaccacatgctattccaaatacctgcaaattgtttcccctggtctcggtctgactaacttccactactcatccaccaggttttggctgagacacggcttcctccacaggctttcttgaccgctcaaagtattgcttgaatcacaaagcagctcatcttttttgcatattacccatggatacctttgtagagggaagtccccccaccttcccgatcctctgggcttagcacccccgccgtgtgctcccagagccctccacactggcccactcttatgagtagctctcactatactattcgcaatttggctgtctttccaccagttccaagagggcagggatcctgcttcttaaagtctggattcccagtatttagctcagtgccaggcacgtagtggatactcagtaaatagctggtgaatgaatggataaatagcaaaagaatgtcaaagtgtgttggatactaaaaagtcatgtgagctgtaatcttgtcattcctgtcacatagatgaggaaactgaagtccagaaagggacactggcttgcccagggtcacacagtgagggacacagctgtcttctaggatggacacaaagccaggacaccagcctccctgggctcctatgctgtatcctgagtatttgaagatatatttcttttctagttaaaagtactttgggggccgggtgcggtggctcatgcctataatcccagcactttgggaggccgaggcagacagatcacttgaggttaggagttcgagaccagcctcgccaacatggtgaaaccctgtctctgctaaaatacaaaaattagccgggtatggtggcggatgcctgtagtcccagctacttgggaggctgagacacgaaaattgcttgaagcccagaggcagaggttgaacccaggaggcggaggagcagagatcgcgccactgcactccagcttgggtagcactgagactctgtctcagaaaaaaaaaaaaaaggagaaaaaaagtactttggggcagacatctaggtaccaaatggtgctttcccaaagttgagtgttgcagagaaagagctgttctgctgtttgggagaaatggctttcagcctcagggttgctcctaactcatggcatgaccttgtattccaggcctcagtttccccatctgggaaggaatcgggttcgacaaaatgctggagcactaagcagaggacttttttttggcggggggggatggagtttcgcccttttgcccaggctagagtgaagtggcatgatctcggctcactgcaacctccgccccccatgttcaagcaattctcctgcctcagcctccagagtagctgagattataggtgggtgccaccatgcccggctaatatttgtatttttagtagagacgaggtttcaccgtgttggccaggctggtcttgaactcctgacctcaggcgatccacccacctcggcctcccaaagtgctaggattacaagcatgagccaccacacacggcctaagcagaggatttttaaaaagcagggatgggagggcactgatgactgagaggaaatgaggcatcctccccatgaatgagcaagatgggatatgggcttggaccccaagtcctacccccaggcgtgttgagggcacggtggatgaagtcagccgcagaggagaagtaggcactgatgtcaaaatcagggaggtcgtgggctggcacccccaggtagctcacactgctgccgtagaagtcagggccgccctgacagtagaggcccttgtgggcggcgttcagcacgtgggtgatgcccagcttccacagctcaaagcggttgtttgccgtggccctggggagggcaggaagggcacttgatgccggccaagccatgggaccaggagggaggctgtgcctggccccctgctgcagagggaccgagccattagggtccaaagagagtccaaccccagcaagctccaagtggggtctgactccacagccctatacccagagccccgcactttctggtggctgagccggcggtgtgtgtgtcgggggatctttagaccctctttgcttcctcaatgcatctgtccctgccttggccaggacaggaaggaagggattgcttcagccctggaacctggctgcccctcccttcttgccccatgtcctcccacgcatatccgtcctctactggctaccacctcatacctgcttctaacctacaaatgtttagaggcaacaccttctctgattcaccttcagtcaggcttctccaccgtctgtatccagaggagggaggctgggcccagaaacagggggctctctgtctaccttatctcatgccccaaatactatttcctgggcctctgcctctacacttgacagttgtcctggaaatgtttcctggaactcctgggagactccctgctttcaggcaggcgaagtccctgctctccctggtggccatacctggtcactgcactgacctcagcacccccgggggtcctggagaaggtccctggcctgggatggtcagagcagagctatttctccttgtttccaccctcctgtgtctggtaaagcgaccaagaactgcctctccacgtccccacccccatgccccttggccagctaccactcacgcatctcctatgaaaaggttgggccaaacttcgtccacacggctgcaagaagacttccctgcccgcaggagctcctccagctccaggatgctggggcaaggcgtggctttgtcctctccccccagctctgggagagaggtctcagccatgggccagcccgcccacccctctgcctctgtggtcactcctctctgcctctccagtgtcatttctccttcccagagattgacagggacaggtgacagaagcaagtgactcagcaagtcacaggggcctctggagtggacaagaccttttcctccccaagcctccccccacccccaaactccatgagaacacagaatcagagagacctctgcaagtcagctaccaccctgaacctcagtttcttcatctgtaaagtaaggataatcacacctacctcagagaatttgaggattagatgaaacaaaggacatgctgggtctgacacatagtaggtgcttagaaacatctgtggaattagtagatgtagagccctgcctaaggctattaggttctgaggactgagttaaagtagagatccagggtgcagaggaggtggctggttccaaggatgaatgatagaaagaactgaaagaagtgtacagtctaggtgggccacaaattgggcaggagctggattggatgtctgttggatgagtctctgaattacggaggtcagggacagttttctgagttgtagagtcagagaaatatgggtaagagacatggagagcttcctttaaagggtgcccacaagattcatggggggagggggaaggtgtttttttttgttttgttttgtttagacagggtctcactctgtcacccaggctggagtgcagtggcatcatcttggctcactgccactaccacctcccaggttcaagtgattctcctgctttagcttcctgagtagctaggattacaggcatgtgccaccatgccacactaatttttgtgtttttagtagagatggggttttgccatgttggtctgactggtcttgaactcctacctcaagtgatcagcctgcctcggcctcccaaagtactgggattacaggtgtgagccgccgtgccgggccaatggggcaaggtttgaacaatggtcctgtagtgaagatggctaacttctcagaagagaaggctgaagagggccttgtatgtcaaatggggagacgggaggtgagtgttgccctagactttgagagccaaaggggctaactgtcatcagaaacagtgggagggagattcctctgcctataagggctttgggtcccaaaatagaaactgagaaaggtcaacctgtccttctgccagagctggttatcagcaagagagatgagatgtctcaccctctctcatgtgacttctcagtggccctaatggagctgggaagggtatgagctgcagtggggaggttcccagctgcccttggccttaagaccagtttgaagggaaaggccacaccagggcatcccatggaagcagtctacactcatgtctatcccattcagaaccattgaagtcggcccggcactgtgtggggaggcaagaccaaggaggggctcgtgtccaggttacagctgggtttggacttggtttatgccaatgctagacctggcttgggaggagaccttccctcagggtggtgcagcatggtggagtgaggaaaatacaggatctgatgttagagagatttgggttggaatatcagtttgcaatatgtcaggcagtatgtttctttacttttctgtgctataggatcccccttgcagaattagcactaggattttttttttgagatggagtttgctcttgtcgcccaggctggagtgccatggcgtgatctcggctcattgcaacctccatttcccgggttcaagcgattctcctgcctcagcctcccgagtagctgggattacaggtatgcaccaccacgcccggctaatttttgtatttttagtacagacgaggtttccccatgctggccaggctggtctcgaactcctgacctcaggtgatcccgcctcagcctcccaaagtgctgggattacagacgtgagcctccgctcccggccttagcacaaggattaaatgagatgtttatatggcgtttggcatagacactgtcaaagagtaaatgggcaataaattataacaatgatcattgggggctggctattggagaagagctggctctctccagaggaattcggattacctccttctaggccctaaccccatttactgatcccacaggccccgccccggctccgctagccccgcttcctcctgtcgctttggcctccggcatgacgcatgcgccctcgggctcctccgcggcagcatctcggttctcctctcgggcccatctggagcctcgcgtcttttccagtgtgggccccgccccctgccggtagaaccccgtccccggccggtagggccccgcctcccgaagcagttccggttcggctccgagcagctgccggcgcggcggtgacggcggccgggacgatgcctgcgcgcagtcgccaccgcccccgcctccactccggctccccgccccgggctccgcccccgccgcttgaggcgcttcactccggcgaggcggggagggccccggactccgacggcggctcggacgccgactcggaggtgggtccggggagcccgactcggaccgcggaggtgagcgggagctgaggctgaggagaggggagcttggggggcgcctgctgccaagggtgagtggggagtctgggatggagccgggggctgccgagggaccgcgacctggaggggccccggggagacggttgagggaaccgggatagtcagctctggaatggaatctgaagcaaatggaggttgtcgaactgagggcctgaaggctgagggataagtggaggccgaggaacgagagggagagagcgagagggggaggcttgaagagcccagagcttgggggcttttgaaagctgcgcagtgggggaaaaagatcgaaggtcctgcgggaatgtggacccggaagaagagatgctctgggtttggcagcggggatgaggagtcagaggagcaagacctgggccggtgttcccttcccagggcgagggagggcgatcggggctgggactggagccctctcatggggttctcctcttacggagccctcttatccgcctcccaccccgggtggggctggtggtgatggagggcaggatttaggtttgactagaaggaggagggctgttggatgggaaatcgtctggcctcaaggggtgagggaggcactgaaaaagagaagtgtggtcaagaaagaaaaggagcccttggggatctaattttgggctttggcatttttacaggtgccttttaaaacatcaaagatcactagggcaatgtacttggatcgtggggctttctcgttcgtgcacagtggatcattttaagaatcttgggtggaaggggcggtgtgaatcactgatttgcctaaaggactgggggaagtagtggagaggaagtgatgtttgaagaaggtagtggaagacgtgattctgaaaatgaagatatcatttggatttattgacagtaatggtgtcctttttttcattgtaattttttcgtagctaagtttaaataccagacatgttaagatcctaaaaatttactatattacctttaagttttaaaaacttgaaacaagactttggatactcagattttaaaaattaaacttgaaacaagaatttggacacttggattttacagatactcaacatggactggttccactttcaaagttttaagttgacacatgtatttgccacatagtaaatgtatggtcaatgcaagtttctgggtgaagggggcacagtgaacttgccacagtctaggcgcaataccaaatcttcctctcactgataaccccaggattggacttatctcttgaaaattggagaggtacctttgactgattggcaaaaccaatattgaaatactattttgcaggtattgtgtgaatagtatttttagtagagtgatttggaaaaataaggacagaggatgcttgtagttggcagccaacacaactgggacaggtgggtatacagatgctttttatagaagacatagttccaaaacataattatgccagaaaaagaatgattgcaatatttatattcactttagtagagataaattgacttccttttgtgattgttaagtcataacatggttccatgaagtctttgactttagccacatgtctcatatgttttacaactttttatgtgattataggtttgtaaagttgttggccatttcttttctcttccttcttttcttttctttcctttcttttttttttttgagacagagattcgctgtgttgcccaggcttaagtgatcctcccacctcagcctcccaagtagctgggagtagctgggactgcaggtgggcgccaccatggctggctaatttttgttagcatcaagcgttttctaaatgcttgattaaatctaaatggatatctactgtttaatcttcatgagatgataatttgatttgcaacagcttttaaattagtttatgtgtatgggctatgtgacataccctcagatgcacagtggaatagtaattgtttcttcaaaggatatgtgaattcttagctaaaaatgctgagattgttaaagtattaattcccttttctttaacttaatacaaattatcttcagttgaagtttatgtaatattactgtttgttggttttatctttagagtgagatcctctggagaccttatcttcatacttagttgtgaataaaagtcatggcatgtaaaaatttgctgaactgcaatataagaactctattaagattacagcttaatgttattgcaaaattaaagagaaactgttagatggagttgtacaattaacatattagcatgtctaatagttttttaatttttgtttccctttgtcagttctcacacccattgaataaagaaaatcagtttttggctaggtgtggtggcttactcctgtaatcccaccactttaggaggccgaagcaggcagatcacttgaggtcaggagttcaagaccagcttggccaacatggcaaaaccccatctctactaatactataaaaagaattaatcaggtgtggtggctcacacctgtaatcccagctactcaggaggctgaggcaggagaatctcttgaacccgggaagcagaggttgtgagctgagatcacaccactgcactccagcctgggcaacagagtgatatgtctcaaaaaaaaaaaaaaaatcggtttctctaaggcagaagaagccatcatgactgcgatggcagaatatgcagacatatttaggtaaatcagttttgatttcagtaccataaccccccttctgcaaaagcttattcacattgcacagttgcttataaacatttttttattttgttaatcattagatcctcaatacttcttcaaaactttgctgttactgattaagacattttcatggcttttctaagaattgaaatttgaacactttttttgagaaacttaaatcacagatgtttccatgaatagtattattattgttttataagaatgccatgttaacaagctattctttcaagatttttacttccaggcctgatgtaatatatggtgttaattgttgggtgtacctagcatgcccgttaatttatggatggaaatctttcctgtcttcagattctacccccttcatttttcatatgccagtggattgttaatgaactaagattgaattcactttttaattttaaagcttctgtagctttgattctctttggacatcaaactgatttatacgagatatgaatacaattgcatattctgctaaattacctatgaagctcttttgaatgattgtggtatttggtgaaaaaatacagtatgagctaatcaaaattcttttaagggatttaggttatagaggaggactatactatttcattcccagattagattaaatgttttacttatttgcagagatgacaggggagagccttgattattttcacgtctcatgtatttatatttgtttacaaataaagagttacttatttgcaaaatgccgtatctttaatacttgcttacatgtgattttgggaattcttttggaaccagtttttgttcttgtttttgttttgctctaagggtatgatgtaacacattgaggggttaatagtagggcaagaacagagaaagccatttgacaacagatatcatcaggacagtgatgcttactttaggtcttgtggttttcttggccttgagaaatcaagatgttaactaaaaataggagagcatgggccaggcacactgggaaaacagattggtgtttacatgctaccgctgttgcttcctggtaatttgccatatgaatgtgtgggtatggatttgtaacagacctgtgatgtgaatattcctgaaccccctcctcccatacacacagtaccatcatcacagatctgaagcctaacctttagctgagttcagtgacttcatgtttccgtattgaaatgttctgttattgggtcctcacaatactatagaatgtaacatactgcgggcacggtggctcacgcctgtaatctcagcactttgggaggccgaggcgggcggatcacgaggccaggagatcgagaccatcctggcgaacacggtgaaaccccgtctctactaaaaatacaaaaaaattagccgggcctcgtggcaggcgcctgtagtcccagctactcaggaggctgaggcaggagaatggcatgaacccgagaggcggagcttgcagtgagcggagatcacaccactgcactccagcctgggcaacagagcgagactccgtctcaaaaaaaaaaaaaaaaaaagactattaactaagaaaaacttggttataatagtttcaccacagtgtttcaccataaaacaatgttttatgatatgtacctcagaaaagagtgttgtggggcagggcagtgaattatatttatatttgtctaagtattttttggtagttttttttttttaaagatagggtctcactgtctcccaggctggaatacagtggcgcgatcatggcttatgcagccttgaactcctgggctcaagcagtcctcctgcctcagctttctgagtagctgggactataggcgtgtgccaccacacctggctaatttttttaaatttttcttttgtagagatggggtatcagctatgttgaccaggctggtttagagctcctggcctcgagcagtcctcccacctcagcctcccaaagtgctaggattacaggtgtgagtgtcttaaatttttgaagtgcatttagttaagcttatgagttgtggcagaggacaagaggtagtaacatgagtatctgttatcttgatacttgttctgttgtcttgaaatttttgacagataaattctagttggaggtgagaaccatggattctgctaatttagggccttcctataggttaactggtgtcactgagtttttggaaatacttgcaaatctgttttagtttggaactttgagattaaatggaattgatgtcagttccatcaatataatattagcatgaaagccagagatttccaaaaccatacattaaaatttggctgcaaatccaatccattttcacaatatttaatggagtttgaagtcttgagccagtttctcattttccattatattgattagattttggatgtagcatatttatttatttatttagagacagagtctcacttcgttgccgaagcctggtgcagtggcgtgatgtcagttcatagcaaccttcgcctcccgggttcaagcaattctcccacctcagcctccccagtagctgggattacaggcgcgtgccaccatgctcggctaattttttgtgtttttagtagagacgaggtctcactatgttgctcaggctggttttgaactcctcggctcaaggcatccaccccccttggcctcccaaagttgggtttacaggcgtgaaccaccgcagcctgccagtgtagcatatttaaaaataaagattttaccagctgggtggggtgactcatgcatgtaatcccagcactttgggaagctgaggtgggtggatcccttgagcccaggagtttgagaccagcctgagcaacatagtgagacctcgtctctactaaaaatacaaaaattagccgggtgtggtggtgtgcacctatagtcccagaactcaggaggctgaggtgggaggatcacctgagcccaggaggtcaaagctgcagtaagctgtgattgcgccactgcactccagcctgggtaaagagtgaggccctatcttaaaaaaaaaaaagggtgggcgtgatggctcacacctgtaatcctagcactttgggaggccaaggtgggtggcttacttgaggtcaggagttcaagaccaccctggccaacatggtgaaaccttttctctgctaaaagtacaaaaaaattagctgggcgtggtggcacgtacctgtaatcccagctgcttgggaggctgaggcaggagaattgcttgatcccaggaggcagaggttgcagtgagccgagattgcgccattatactccagcctgggctacaagagtgaaatgctttctcaaacaaacaaacaaacaaaaaagattttaccaaattgatatgttaaactgctagcctggttagaataaaaattagaattttagatacttagcttctttactggtttgctgtggcattgcagccaggtcaggaaccctttaccaaatttatcaccaaagtcctatcatcgtggaaaaatttttggtataactgagaatataaaatggacggtaatatctgtcagattcttactcattgaggggagacagttctggatttggtgtagataacttggtgcagcctgatagtagaagttagtttaaaggctatttggaaccagaaaaagatgttatttggtatatatgacaactttttttgagtgaaattataagagttcacggttagagcagcaaaaaagtccaagaactgaagtgcagccaagagaatgatgatgtaactgaggagggaatttaattcttttaaagatgctgccctaaattctactgctcagaagtgggacataacaaaacagaaaatcaccactaaagagtttcaaaatggatggtaggagttagtgcaaggtctttgaaactgttttgtaattattgcagattttatcgatgttttggaaacaataccctgtgcttgctaagaaaatgcaaaataggctgggcacagtggcttgcgcctgtaatcccagcactttgggagggtgaggcaggcagatcacttgagatcagagttcgagaccagcctggccagcatggtgaaatgctgtctctactaaaaatataaaaattagccaggtgtggtggtgtgcccctatagtcccagctacttgggaggcagaggcaggagaattgtttgaacctgggaggcagaggctgcagtgggctgagatcacgccgctgcattccagcctgggcgacagagcaagactccgtctcaaaaaagaaaaagaaaaatatctttctataagtataaagagaaaagagtagtttttgtttgctgaatgaaaatgttttcatttatggtaaaaattttaaaatagtatggaaaaaagttggataatcccaaatactataaactacagagttattaatcacaaagtttagccatatatgcccaaattaaaccttatcctcctacatcatagtttaggctttttgctttcataagaattgtttttatgttctggtttatggatctgcaaacatgtagtctttattatgtggatattagataagctaaatgtatttgatttagctgtatttcagcttcagtgcatctataatatataattgccctaagaaaaatttattaactctagctttatataatgtttgaagtctcttcctcagtgtttatcttgggatatggatcttaatttttttacgttttatacatcatttggaagctgtttaacttttaaattttgtaaactaaatcagtaatgatttgttttttttttttaatttgagacggagtttcgctcttgttactgaggctggagtgcagtggtgcgatctcagctcgctgcaacctccgcctcctgggttcaagcaattctgcctcagcctactgagtagctgggattacaggggtgcaccaccatgcctagctaatttttttgtatttttagtagagacggggtttctccatgttggtcaggctggtctcgaactcctgacctcaggtgacctgcccgccttggcttcccaaagtgctgggattacaggcgtgaatcaataataatttatacaaatagcacatattgtatttatgagtcaagttttatcagttgtgaattcctttaggggcatttgaatgtagggcttttaaatacaatcacagaatttagaatagaggacagttgcttcagctggttgtactccaatatttttgatgattttctgcacacacatgcacacacacgtgcgcacacgtgagaagtgaaactacaagaaaaatccagcatgtttaagtcactgtaatcaccatctgaacatggattttgcttctgtaaaagtaagcatattgtaaaggtttcattttgttgatatattctctgtattttaaatattgttagctgggcacggtgactcactcctgtaatctcagcaccttgggaggccgaggcaggcggattgcctgaggtcaggagttcaagaccagcctggccaacatggtgaaacctcgtctctactaaaaatacaaaaaaattagctgggcgtggtggcgcgcatctgtaatcccagctactcgggaagccgaggcaagggaatcggtttaacctgggaggtggaggttgcagtgagccgagattgtaccactgcactccagcctgggcgacagagtgagacactgtctcaaaaaaagtaaagattgtccagtgatggattagaggctattttggtctcttgtgtgttggtataattaagcccagtggaatagctgtgtctttctagtttttagtgcctatcactttaggaagtttcccaattcccaaactgtacagaagtgctttcaggtatcaacagtaatcagttacatcactgacatactttttattttattttatttatttatttttgaaatggagtctcgctctattgcccaggctggagtgcagtggcacgatctcggctcaccgcaagctccgcctcccaggttcatgccattctcctgcctcagcctcccgtagctgggattacaggcgcctgccaccatgcccagctaattttttgtatttttagtagagatggggtttcaccgtgttagccaggatggtctctatctcctgacctcgtgatccgcccgcctcagcctcccaaagtgctgggattacaggcgtgagccaccgcgcccggccagcgtcatactttttaaaatgttggtgagtggtatgctcctgtggaaatatttattaatagttaaattttatgttaagtcgttatatgagcagtgcatattgatgtgtagagcaatgcattgagtaactagaacctctattttatattattgtttctcagtttatgtagcttaattacgttgttatgttgaaaagtaatttccatcttttttttttttttttttttttttgagacgaaatctcactctgttgcctgggctggagtgcagtggtgcaatctcagctcactgcagcctccgcctcccaggttcaagcgattctcttgcctctgcctcccgagtagctgggactactgtcgtgcaccaccacacctggctaatttttgtatttttagtagaggtggggttttatgttgaccaggcttgtcttgaagtcttaacctcagtgatatacccacttcggcctcccaaagtgctgggattataggcgggagccaccacacccggacttttgagcagtttctgtttgctaagcattattataagtgcattattgtaagtgcattacatgtataattccatgcaatcttcacaacaagcctatgaagtaggaattctcctcattttacagataaagacagtgaggcccaagaaagttatgtaacttctgcagggtcacataactgtgagtggtaaatcctcagtttgaacctaggcagtttaattctagagccagtactctttactttctgggctgtatatcagatgttgttggcaaatagcttatttatctgaagcttaactctctagccttagtttcttcagctgtaaattgaggaattgtactagatctctcaggtcacttccatttctaacctaagaactctgtcatcctgatttacaaaacacaacacgtttaatgtttcaaattactttctgtttgtaatctctggatcccttatgagataaaggttaagctgtttccaacatcacactgttaatgggtcatggaactggatcagatcttttctgggacttcctggttttgctggttgcctcatgcatatacttagtgtgtatatgcatatatgggttaataattgaatttaattgaccttcttaatttttttttcttcttttttttgactgagtctcactttgtcgcccaggctggagtgcagtggtgcgatcttggctcactgcaacctctgcctcccaggttcaagcgattctcctgcctcagcctcccaagtagctaggattacaggcatccaccactatgcccagctaatttttgtatttttaatagagacagcatttcaccatgttggccaggctggtcttgaactcctgacctcaagtgatccaccctctttggcctcccaaagtgctgggattacaggagtaagccaccatgcccagcgactttcttaattttctatttatatctgtttaaatgagatttgcttcaaacagtgaaaaataatactgctttcattttctttcttttttcaaaatcatatcacatcattttcttaaaaaaaccttttctctctgattataagtattacattcttattgtatggaatatagaaattttagaaatttttaatgtagacagtgaaagggcccattcaaggagtaaatattactagtttgatatttatttatttaaaaatatacacatataccatatttgctattttttgggacattgtgcttcttttaaaattttctcagtttttattttgaaataattataggctgggcgcagtggctcacgcctgtaatctcagcactttgggaggccgaggcaggcagatcacctgaggtcaggcattcgagaccagcttggccaacatggcaaaaccctgtctccagaaaaaaaatagaaaaattagctgagcgtggtgggggcaccagtaatcccagctacttgggaggctgaggcatgagaatcacttgaaccctggaggcagaggttgcagtgagctgagattatgccactgcattccagactgaatgatagacggagactctgtctcaaaaaaaaaaaaaaaaaattcttggctgggcactgtggctctctcctgtaaacccagcaccccagcactttgggaggctgacaggaatggatgcttgagccgtggagtttagcctgggcaacatagcaagaccccgtctcttaccccttccccaaaaaatcctcctctgttagcagttttctgacaatttgtattataaatgggtatttgcgataaaaattttgttagatgctttttttatttatatgctcctgtgttttttctcctttagcaggttaacatggtgagttacgttgtttgattttcaaatattgaaccagccttgcatccctggaatgaaccctgtttggtcatgatatataattaattttatatattgctgaattctgtttgctaatatttggttaagtatttttgcatctatattcgtgagggatattggcccttctacagacaccatctccatagtgccaggtggagaagggttaagttttgtaccttgcttgctgggaaggaaatggacacctcatgcttgcttcccaccccacctcaccccaccccaccccaccccaccccaccccaccccaccccaccccaccctgtgcagggggttgggcgggtaaaggagatgagggttgtgggtggctttgttacctccgatataccactgagtggtgttaatcctgagtctccagcaggcttcctctggtagtacctcggcaaggagcaggaggggtgcctcataagtgctgtttgggtttgaagtccaagttccccaaatggactcctctgacagcatgttaagagagggggagagacttgttactgctagacaatgatgacaatcccagctccctacttggtcttctctgataccaccctggtgtggagagagatatggccggattataacctgacaggcttaaaaatcaaggctctccatttggcctttcctggtgagggtgggagtggaaatggggctggttttttatgtggtgtttggctggaatagagtgggttattgtctaaaagtcttacatcttgctaggctgtctctttttctggtcctttggtttttcttttctttcttttttttttgaggtggagtctcactgtctcccaggttggagtacagtggcatgatctcggctcactgcaacctctgcctccagggctcaagcgactctccagcctcagcctgagagtagctactcagcctcagagtagctactcagcctcagagtagctgggactacaggcacactccaccgcgcccaggtaattttttgtattttagtagagacggagtttcaccatgttgcccagggtggtctcaaacttttcagctccagcgatccgcctgcctcagcctcccaaagtgctgagattacaggcgtgagccactgcacccagccggtcttttgttttttcttggagctttttttatctgcacctttgacatttccaggttgctagcttctctagtatccactttgggatatatatggcaaaataaacaaacaaaacacccaaagagctcactactgtgttgttccttgggtcccaaggtgcctggccagtcagtcttcctcttcatttctcagagtcttcttatgtttattttatatataatgtccatagagtaataggaaaaagtatgtctactccatcttcctgcaagcagaaatccatttattttttaaaatgtacctgtcagaggccaggcaccatggctcatgcctgtaatcccagcactttgggaggccaagacgggcagatcacttgaggtcaggagttcgagagcagtctggccaacgtggtgaaaccctgtctctagtaaaaatacaaaaattagccaggcgtggtggcgcacgcctgtagttccagctacttggaaggctgaggtgggagaattgcttcaacccgggaggcggagattgcagtgagttgagatggtaccattgcactccagcctgggtgacagaacgagactccatctcaaaaaaaaaaaaaaaaaggtacctgtcagaaaaatctagagagcaaaacggtacacatactgaagagtagctctctcttctgttcctctactttttagaagctgtttccttcattctgtcttcatgtctgtcattatattccatcctgtctcacaatctgttttacactcttaagacaatttttctttctttttttcttttttttttttcctaagatggggtctcactctgtcactcaggctggaatgcaatggcacagtcatggctcagcttcctaagtagctgggagtataagcacatgccagcacagccagctaatttttttgttgttgttgtttttgtttgtttgttttttacagagatgggatttcacgatgttgcccaggctggttttgaactcctggcctcaagtgatcctcccgcctccagctaccagagtgctaggattataggtatgagccaccacacctagccaattattctttctaaaacacactctgattatgtcatcctctttttcagctatctgcagagaatcccattgtgtgtagaatgtttttaacttgacagaggtttccatggctctctcaggtcctcgtttccaagaaggaacaactgttgtgtctaaaagggctactgccttatgcagcctatttgctgcatgaactgtgcatgatgtatgcccagggacaagccttttaagaagttcatcatttgaggctgggtgtggtggttcacacctgtaatcccagcattttgggaggctgagacgggaggatcacttgagcccaggagtttgagaccagcctgggcaacatggcaaaaccctatcgctacaaaaaaaagtacaaaaattagcccagcgttgtggtgcacacctgtggtcccagctacttgggaggcttaggtggaaggatcacttgagctcaggaggcaaaggttgcagtgagccaagattgtgccactgcactccagcctgggtgacatagtgaggccctgtctcaaaaaaaggaaaaaaaaataaagttcattatttgaaacatagtcgagcccacagctatcagggacatttctgaaacaagtaccttgggcacctatgtgcttccaaagctgtatgtgaagctacataactacatgagttgtgccattcgcagaaaggtagtcaagaatcgaacttgtaaagcctgcaaggaccaaacatgtctacctgacttagacttttgagtgctgccccatgacctccaccaaagtccgtataaggagccgactccttaaggactgaagaaaaactatcttctggaaaaagataaagtggagattatactaaaaacaaaaacaaaaaggttttcatcatctggccccagtttatattttcaactttttatcttgttattcccctgtgccttttacatactgatggttcaccactgtttcctgccttcatactttggtcatgcaatttcctctgctagtatacttttatttttatttattgatctatttatttatttttaaatttttgctattgtactttattcatctctatccacataattttactactcctttaacgcttagctcaaaagtcacttccaagaactcttttctgattttaccaactggaaataacttctcttttccaactcctttaactttccaatttttagcaaattagataaatatccactttattagtcttttgaggattgagtgaactaattatgactctctttaatatccctttctagactgtagaatcattgagagcaagatctgattcagattcatttggatgaatgccacattgcctagtgtaatacccttcatatagtatgtgtacagtaaatatttaatagatgaataaatgtaacatatgagtgcttttgcttttttttttttttttttttgagacagtatcttgctgtgtcatccaggctggagtacaatggcatgatcatagctcactgaagccataacctcctaggctcaagtggtcttcccaccttggcctcctgaggacctgggactataggcacgtgccaccacgctggctaattttttttttttttgtagggatgaggtctccctatgttgcccaggctaatttcaaactcctaggctcaagcaatcctctggccttggcttcccaaagtgctgagattacaggcctgagccaccgggttggccggattgtatcctcagtgccttagtgtctggcatctctatataatagacacttagtaaatgtttgagactgaacagtgcaaaattgtgattcaaaaagtcttcattaggctgcgcacggtggctcacacctgtaatcccagcactttgggaagccgaggcgggtagatcacctgaggtcaacggttcgagaccagcctggccagcatggtgaaaacgtgtctctactaaaaaatacaaaaattagtggagagaggcggcttgtgcctgtagtcccaactactcgggaggctgagacaggagaatcgcttgaacctggaaggcagaggttgcaataagctgagattgcgccaccgcactccagcctgggcacagagcgagactctgtctcaaaaaaaaaaaaaaaaaatctttgttatgtaatgtaactttgatacattcttctgctgataactagaaaatatttagtattttatatttgagatttagttcttgcagaagtacaagagccctcagttcatgtgaggcagtatattgtcatgggtaagaatatgaactttaaaatgagattgcctaggttgaacagttctctgtactacttgctagtacaagttgatcttggggaacttaacccatttatatcagttgtcacatctataaaatgaggaaattaatagtacctactttatatagttgtgaggattatttgggcatataagtcaaacacgtagaacagttcctcagacactgtaaatgccatgaatgttagctaatttattgttacttcctgaaaatgcactgaacacggttcagaacttgagtttgtgagttagggtgtacattctttttaaggaataacactctgctgacatcacatatcctctagctgtacatcctgtctgcttcctactattttaactaggtattgaatggatagctgataatcccagttacatgacagacagtattcagcatgtaaatgttaaataaacaagtcctcttgagacattttaactcagaaaggattaactagttcatgctaaggaacaacatgtacttttgttcactgtatttcctttgaagaatattttatttgttctggttgaatatactttcccattcagtgcagttaactcttcctaggtgataaaccctttaccggtctttactgacaaattaaaatgactatttaacgttccctgtattattttgaaccttaaaactgttttaacagccctctaaaattaatctggctctgatttttttttcttctttaatttttttttttttttttttttgagacagagtcgctgtcacctaggctggagtgcaatggcgcgatcttggctcattgcaacctccgcctcccaggttcaagcaattctcctacctcagcctcccgagtagctgggattacaggcacatgctaccacgtccagctaatttttgtatttttagtagagacagcatttcaccatgttggctaggctggtctggaactcctgacctcaagtgatccacctgcctcgacctccaacagtgctaggattacaggcgtgagccaccgcacccgcccttctgtttttttaaattttaataaaaacaaggtctccatatgttgcccaggctggtcttgaacttcttcgctgaagcagtcctcctgagttcgcctcccaaagtgttgggattacagaaatgagccaccatacccagcttagatatttttaataacaggtgaattctgaaatctacattggtgtaagattaaaagaatacatatggtattgttccattcatataaagtacaaatgcagggaaaactaaactatattgtttatggatatatgcttaggtagtaaagctataaagaaaaacaagggattatcatgaagataggtttgtggttactatgggtggtcggcagggggtggggaagggaattattgattagaagtggtacacagtgatactgggctggtgccttggggtgattacagattaaaggaagtgaatagttgcaagcctgagatgaaaagatttgcttttttatccagctgtttgtattgcattattaatacatgcatataattggttttagtgcctaaatagcaaaatttcagacacatactgacgaaaatgtattacttcttctgcaaaagggtcttttaacaaaagttgacactttcgtaatatagaagccctacttttcctccatacttctttctgtattctgaatcacctaaaaaaaaaccatctcaactggatcttttttccagtgtgcttttcttctaattctaaagatatttattatatcttctttgtacttcctcttcttcttcttatttttttttttttaaagactaggtcttgttctgttgcccaggtgcagtaatagctcactatagcctggaagtccccagctcaagtgactcttttggacttctgggtttttttgtttgttttgagatggagtcttgctctgtcaccaggctggagtgcagtggcatgatctcggctcactgcaacctccaactccctggttcaagtgattctcctgcctcagtctcccaagtagctgggattacaggcatgcaccaccacacccagataatttttgtatttttaatagagacagtgtttcaccatgtcggccaggaggctctcatctcctgacctcgtgatccacctgcttcggcctcccaaagtgctggaattacaggtgtgagccaccgcacccggcctggacttctttaaagttaaaatgattagctagtttcatttggcatctttagatttgaatttgtcatctacgtaggaaaaagaagttatataatcttagggacagtagaaaatggtttgtttatatagccttagatacataacaaagccattaatgttttaagaaacaccccaaagccatctgagtagctacatgaatacatatgattggagatttgtgttaggtttagctgtgatcttaacccttgacatcatagtatagtggttaagagtagaggaaataaacaactaggtaaatctagaatacaggttattctacaaagaactaccctgaacttgtctccccctaaaaagaaacaagagctagggcactgttctagactaaaagacactagcaagatgtgatgaccaagtgtaatacatgaacctaaattgaatcctgatttttggaggaaacagaaataaaataaatttgaggggcaattaggggagatattatggttaattttcttaggtgtggtaatgtgtattgtacttatttaggaagttgtcattattattagaagatgaataacaactggatgccgaaatatttatggtgaatatcataatgtctttatattaaacagttaagaagtgtcttcaaaataagatatgaatgcttaaaaaaaaacacctatgatcagccaggcacggtgactcacgcctgtaatcccagcactttggtaggccgaggcaggcagatcacctgaggtcaggagttcgagaccagcctgaccaacatggagaaaccccgtctctactaaaaatacaaaaaaaaattagccgggcttggtggcacatgcctgtaatcccagctactcgggaggctgaggcaggagaattgcttgaaccgaggaggtggaggttgtggtgagccgagatcgtaccattgcactccagcctgggcaacaagagcgaaactccatctcaaaaacaaaaaaaacactatgatcattctttaaatctctggtaggatttagtagctttattttcaacccatcctttagctccaaggaaaagcagcatgaagtgatggaaagagtactgaatttgttgtcaaaattcttggagtttaatttcagcatcaatattaactctctaggtgactttaaatcatttaaattataataatttaaataatttgtgtaaagcaaatctggcaaaatgtttgaatcccaaatttgaatcctggctcggacaatttcaagtaggaccttggtcacttcacttaacttttctgtgccttcattgtctcgtgtaaaatgaagataatagtaatgtctacctcataaaagtgttgtgaggattaaatagtattataaagataaagtgctcagaatagtgcctgagcattcaacaaatgtagctgctgctgctgttattgttttatatttattttattatctattactttgaagagagcttggaagactcaagaggtagaaaatataaaacagaagtccaggcaggcagaaccctcaaaacaactaggcaaagatcaagcagttgttgttataattaggaaatgagatcccacatgaaatcaccctgcagggtctaacctgtagtaggtattcataaatgttagtttccttctgttatccctttctttccttcctcattttatagtattatttaatctgaggcttgcagagcactatgtgaccatccattctaattctgcttcttctctgcttctggtttgtataacattgagtcttcgaggtgcctttgcacacatcttatttcatctattacattttgatttgatgttggcttgttgcctctactaattactacataatacagttgaataaaatatagtttaagcatatacacagaactgtctgaaaagaaaaatcacgctctagtgttgactgaagatatataatattaagaaaaattataggttattttatattaaaacatatactaattagaagcttagaatctgtctataataccaaaatctaatagccagaaaacagaattttgattattaaaaataactgatcaaatttatctacaatttatatatttctgataattaaagaaataagtgagtctccaaaatatggtaagaatattttttaaaaatctataataaatctttaaatctctgttagaacttgatagcattattaactcatcctttagctccaaggaaaagcagcatgaaatggtggaaagaacactgaatttgttgtcgaaattcttggagtttaatttcaacaccaatattaactctctagatgactttaaatactctaaacatcttggcatctcaagcctcactgtgcattagaatcacgtggggagctttttaaaaaatgcagatataaaatttctgtctcttctgagattctgattcagttgtcctaggatgaggcatggacattgatacaaatacactgtaaaatttcagactattctaatgtatagccagggttgaaaacctttgtatatgtagtttccttggaagcctaggcaaaggaggcatcaaagagaattggctttttatatcctacactgtctaggagagagagagactgaaactgggagatgcaaacaaccttttctagacaggtactctctgctctgtggcactgatgttacgttaggtctcacaggaagctggattagattttgcccaagacgatctgtttttctttgccctgattacttgctctacaagtagcgttctgattattaaatcagcctcctagacacttcagaattataaaaggatgtgcctgagataatgcttgagcattctttttagacacttgagtgtctagaattggttctctagtttatccattagtaccttgtgagtttgcttttagtctctcttggtttgaccaactctggggaactgacagggtcaagttttgatctctaagggtgaataccagatcctgattcctggtaaatttaccaaattagtgaccctgtgttatctcttgacatttggacattttaaatttatggatataaaactccctgaagccgtgaagaatttgtaataaagtattataataaaaatataaataaagagaaatatgtaataaaatctttcctgtatactcttaagactgaaatagctgtccaaaggcagatttttttttttgccagctatggtggctcacggctgtaatcccagcactttgagaggccaaagcaggaggatcacttgagcccaggagttcaagaccagcctgggcatcctagggagaccctatctctacaaaaaataagaaaactaattgggcttggtggtacacacctgtggtcccagctactcaggaagctgaggtgggaagatcccttgggcctgggaggtcaaggctacagtgaaccgtgatcacactactgcactccagcctgagcaacagagcaagagtctgtctcagtcaatcaataaagaaagaaaaaggcaggtttttgttttgtttataatgatcctgattgactgttggtggaaatgtaaatacagccattatggaaaacactgtgaaggttcctcaaaaattaaaatagaggctgggtgtggtgactcacgcctgtaatcccagcactttgggaggctgaggcaggcagattgctggagctcaggagttcaagaccaacctgggcagcatggcaaaaccccatctctacaaaaaaaatacaaaaattagctaggcgtggtggtgcgtgcctatagccccagctacttgggaggctgaggtgggagaattgcttgagcctgacaagcggtggttgcagtgggccaagactgcaccactgcactccagcctggattacacagtgagaccctgtctcaaaaaataaaatgaaatagaactaccatacgatccagcaatctctctattggatatatgtccaaaggaaatgaaatcaggatgttgaagagatactgcactctcatgtttattgcagcactattcacaatagccaagataaggaatcaacctaagtgtccgtctacagataaatagagaaaatgtgtgtatgtctgtgtgcatgcaccatattcatattcagccacaaaacagaatgaagtcctgttatttgcagcaacatggatgaatctggaggacattatattaagtgaaattagccaggcacagaaagacaaatactacatgatctcactcatatatggaatctaaaaacaagttaatcttgtagaagtagaaagtaggatagtggttatcagaggctagagagaaaggataggagaggaggatggatagaggttggtcagcaagtacaaaattacagttagctccatccatgtccctgcaaagaacgtgatctcattcctttttatggctgcatagtattccgtggtgtatatgtaccacattttctttatccagtctatcattgatggacatttgggttgattccatgtctttgctcttgtgaatagtgctgcagtgaacatacgtgtgcatgcatctttataatagaatgatttatattcctttgggtatatactcagtaatggtattgctgggacaaatggcatttagtgggagctgaacagtgagagcacatgtacacagggaggggagcaacacacactgggcctgtcagtggggggcagccgggagagggagaacatcaggataaatagctaatgcgtgcagggcttaatacctaggtgatgggttgataggtgcagcaaaccaccatggcacacgtttacctgtataacaaacctgcatgtcctgctcatgtatcccggaatttaaaataaaataacaggccaggcgcagtggctcatgcctgtaatcccagcactttgagaggccgaggccggcggatcacctgaggtcagtagttagagaccagcctggccaacatggtaaaaccccatctctactaaaaatacaaaaattagctgagcgtggtggtgggcacctgtaatcccagctacttgggaggctaaggcaggagaattgcttgaatccaggaggtggaggctgcagtgagccaagatcacgccactgcactccagcttgggtggcagagtgagactttcccccccccaaaaaaaagattacagttagatgagaagcgtaactggttttctgttgtacagtagggtgactatgactaataataatgtatatttcaaggtagctagaagattttgaatgttatcaccacaaagaaatgatagatgtgactggtgtggtggcttatgcctgtaatcttaacactttgggaggccgaggcaggaagatcacttgggcctagaagtttgagaccaacctgggcaacatagtgagaccctgtctctacaaaaaagtaaaaaaaaaattagccaagcatgatggcacatgcctgtagtccccgctactcaggaggctgaggtgggaggatcacttgagcccaggggtttgaggtttcattgagctataattgtgtcattgctctccagcctgggaaagagaacaagaccctgtctctagaaaaaaacaaaaaacaaaaaacaaatgataactttaaaattatatatgtgctaagtatctttatttgatcatcatacagtgtatacatgtattaacatattacactgggccagacgcgatggcttatgcctgtaatcccagcactttgggaggccgaggcgggctgatcacctgaggtcgggagttcaagaccagcctgaccaacatggagaaactccgtctctactaaaaatacaaatttagctgggcagtggtggtgcatgcctgtaatcccagctactcaggaggctgaggcaggagaatcgcttgaacccgggaggcagaggttgcggtgagctgagatcgtgtcactgcactccagcctgggcaacaagagcgaaattccatctcaaaaaaaaaaaaaaaattacactgtaccccataaatgtgtacaattatgtgtcaattataaataaagttgaaattttaaaaatgatctgtggctggccgcggtggctcatgcctgtaatcccagcactttgggaggccgaggcgggtggatcacgaggtcaggagatcgagaccatcctggctaacatggtgaaaccctctctctactaaaaatacaaaaaaattaactgggcatggtggtgggcgcctgtagtcccagctacttgggaggctgaggcaggagaatggtgtgaacctgggaggcagagcttgcagtgagctgagatcgcgccactacacttcagcctgggcgacaggacaagactccgtccgtatcaaaaaaaaaaaaatcttgtttagaaggacattggggaactgaatgaattattattttgattgctgctttttttttgcacatttatttaataaatgtttattgagaacctaccatgtgctaatcatataggccttagtaatcatcttgattactctatctttcctaaaaataaaacaaaaataacctaacaaaaacccactaagctcttctgctgcactgagtgctacttttcttttcttttcttttggtttttttttggctagatacactctcattttgcctttcctcccttttctttttctttaatttgtagtatggtacttgtctgctttcatgttcttactactgttgaacctgcttggtagatgaagtagccagatcagagcttttgttttgtgtaagttactaataggttattttactattcaagtctttttcccctgtcactaagtacttggttgagaaaaaataattgaatagctttttgaaataaaacatgtcattcattccaaagaatgcaaaagtacatatagttaatgagaagagagctgaaaaacatatcctgcttagtttcccaggaagctaaggggaaaaaacataaacttaccttgccttacctagaattggaccagaatgtggaccttatatgagacagcttgaagccttgacctttgggtacttagcttgttctgaaatcaacaattcagaggactaaagagcctttggtaatcagtcagggttcacttgcaagagagagaaacttctttggtctgggctaggaatgacttctactacaatatttaaattggcctgtcagaggaatgctacctttgctacagtcagaaggttggcattaggaggccaacatgaaatgctgagtttgagaatgcgccatctcaataccaaaaaaacccagtaaaaacataggcaaaagacttgagtaggtgtttctccaagcaaaatatacaaaggtctagtaagcatatgaaaagatgttccacatggctaatcattactgaaatcaaatcaaaatcacaatgaaatactactttatgtcataaaatggctactattaagaaaaagaacagaaaattacaagtattagcaggaatatagagaaattagaacactttgtgcatatttctagtaggaatgtaaaatggttcagctgctgtggaaaatgatatggtgactcctcaaaaaatttagcagaattactgtacaagccagcaattccacttctaggtatatacctgaagtaaaagcagggacttgaacagatatttgtttacccatgttcaaagcagtattattcacaatagccagaagatgaatgcagcttaagtgtccatggatggatgaatgtgtaaacaaaatgtgatatatacatagaaggggatattattcagccttagaaagaaaattctgggctgggcgtggtgactcatgcctgtaatcccagcactttgggaggccgaggtgggtggatcatttgaggtcaggagttcgagaccagcctggccaacattgtgaaaccccacctctactaaaaatacaaaaattagctgggtgtggtggcaggtgcctgtagtcccagctacttgggaggctgaggcaggagaattgcttgaacccgggaggcggagcttgcagcgagccaagatcgtgccactgcactccagcctgggtgacagagtgagactccgtctcaaaaaaaaaaaaaagaaagaaaattctgacatacactacaacacagatgaaccttgaagcctaagtgaaatgagacacaaaagaacaaatattgcatgattctacttatgtgaaatatctagaatagggaaattcataacaacagaatatagattagagaataccagggactgagcatgagggggatagtgagttattgcttaataggttacagggtttttgcttggagtgatgatgaagttctgaagttggatggtggtaattgtggcacaacattgtgaatgtatttaaggaaacagaactataacacttaaaatggtaaaaatggtaaattttatgtatagttaaccacacacacagaaaagagcatgtatctgttatgcaggtattaggaaaccactactacttgccccacaactgcagctgcttcatgacccttacaaagttagtgactgaaacctggagaattatgtgcatgtggtcagcatttccataatccttgtggatagccaaaacttcagtaaaacaactcccatttcaccatctgttttccatatctcatgagcatctcatgagcatctagttggctgaacctgattcacatttgaatcctagtagcaagggaccctgaggaataatgattagcttttcagactgtgtagtaggaggaaacgactagagggagactagaaaggatactgagtgctgcttcatcatatctgccacaggcactgagtcagaggtgattcgtagatggcagtgctccttttagtcaggtcaccatttccagtagtattgagaatgtcctgcagctgataagttggagaggtagggtggggacaaagtcattatctctttttgcagttaatgggctgattgtgctatggtatttgcagttttaatgtggtagaacacatttggattatttaaattattgtaaagagatttgggtcactctaatgggatgcattaaagactcattgactaaagactatctgggctaatgtttaggagtaccaaatgtaaggttgttatgtttatgataagcttttttcatttcatcaagtatggatataagaatataatagaaaatatactgagttcttttgctcttaggctgctgaaatctctaattagtatgaactaaatttgtttggagagaaaagaaacaaatttactagtaaagcatttacttgctgaaaattgcacttcttaaaaacagttttcaaaaattctaaccagaggtcacccaaaagataagatatttcatattgttcagaacagtccggtgtttttatctgttatctgtgacttaaaactaagtttgaataattcctgttgataatcggattctgcaggaatgactgttctctcagcaccttgataggtattgacctttgatgcttaagtggttttttctttttttttttttttttttgagacggagtttcgctcttgctgcccaggctagagggcaatggtgtgaactcagttcactgccacctccgcctcccaggctcaaacaattctcccgcctcagcctcctgagtagctggaattacaggcatgcaccaccacgcccgattaatttttttttttttgcatttttaatacagacagggtttcacaacattggccaggctggtctcaaactcctgacctcaagtgatctgcccacctcggccttccaacgtactgggattataggcgtgggtcaccacccattaacattttggacaagtaccaagctttgcatgaaatgctttttaaggtggaccacgctttaatggtgtaataagagttagtatttaaatcagatttgttgatacagttattccacttctagaaatttaacctaaagcaatgcaatgccatttataataataataaaatagtgaacaattgttaacaatggggagatggataaattattgtatagtcatacaatggaatgttttaaaactatcttttcaaaagatatttaatagcattagacaggactcatgcaataatgttaagcaaaatgatacagaattatgtatgatgtgatttctctttatagaaaattttgtgtgtgagagaaatataacaaattataaggagtgatcctttagggattagttttcaaattttctgttcttcagtgaatatatattgcttctatatatttggctttttattatagagagacttaattataaaagattcaaaccatgcagaaacttgcagactaaaaaccctaaaaatccttcctctgtccccgacctagagaaatggagaccaattcatcaatttgtttttatatggattttgtttttggtgtcacatctaagagatctttacctaacccaggtcagaaagattttctcctagaaattttctagtcttaggttttatgttaggtctatgatccattttcagttaattcttatatgtggtagaagtatgaattgaggtttttacatatgggtatccatttgttccagcatcatttaatgaaaagactgtgttttctccactgaattgcctttgcacatttgtagaaaatcagatatctatatatgtataggtttgtttctggactctatattctgtttccttgatttatgttaacaccactttgtcttgatttgagtactgagataggcagaagtccccgggttcaagcaattctcctgccttagcctcctgattagctgggactacaggcaagcaccaccaagccgggctaatttttgtgtttttagtagagacagggttttgccatattggccaggctggtctcgaactcctaaccccaagtgatccacccgcctctgcctcccaaagtactgggattacaggcttgagccaccccgccctgtcaagatacagaattctaaaatgactcctaatgacctatgcttttgtataatgggagggacctgtaatcccacctaatcatgggatatcactcccatggtgactaagaaagggagattatcctcagtggacctgatctaatcagacaaacccttaaaagggactgggcttttcctggagaaataatccaagtacaagggaagggaattcaacacagaagaagctgctgatttttgggaaaagaggaggccatgcagtaaagaattcgagtggtcggtaagcttacggtaatttgttacaaagcaatagaaaacaaatacaggtagttgtataataagtgtttaaatcagctgtttatgaaatgtatcaatatctacaaaattaaaggcccgttgggattttgattggaattgggttgaatgtgcagataagtttggggaaaattgtcctcttaacagtattgattcttctgacctactcatttctcatttttaggtgttcgtcttagcagtgttttttgttgttttcagcatataggtcttgcccatgttttgtcagatttatccctgagtatttaatattttttatgctattataaatggtattttatacattttaatttttgattgtttgttgctagtatatggaaatacaattgatggctgggtgtgatagctcacgcctgtaatcccacactttgggaggctgaggcaggtgaatctcctgagctcaggagttcgagatgggtctgggcaacatagcaaaaccctgtttctaccaaaaatattaaaaattagccaagtgtgccaagtgtggtgcgcatgcacctgtggtcccagctacttggaaggctgaagtgggagaatggcttgagcctgggaggtggaggttgcagtgagccgagatcgtgccactgcactccaacctgggtgacagagtgacaccctgtctcaaaaaaaaaaaaaaagaaaggaagacaattgatttttgtttgtcgatactatatgtggcaatcttgctaaactgacttattctagtaactgtttttggtatagtctattgaattttcaacataaataatcaagttgtcagcaaatagagttttatttcttcctttttaatctgtatgccttttactttttttttttttttttcctcgagatggagtctcactctgtctcccaggctggagttcagtggtgcgatctccgctcactgcaagctccgtctcccgggttcacgccattctcctgcctcagcctcccgagtagctgggactacaggtgcctgccaccatgcccggctaattttttgtatttttattagagacagggtttcaccgtgttagccaggatggtctcgatctcctgacctcatgatccacctgcctcagcctcccaaagtgctgggattacaggcgtgagccaccacgcctggcctgccttttgcttcttttttttatcttattacactgaccagaacttctgatgttttgtagaagtggtgagagtgacggtcttgccttgcatcttttttttttccttacacttgctttttaaaaaaattttatttttatttttgtttttgagaaagagtctcactctgttgcccaggtggctcactgcagcctccaccttctgggttcaagcaattctcctgcctcagccttctgagtacctgggattgcaggcacccaccaccatgcctggctaatttttgtatttttagtagagatggggtttcaccatgttagccaggctggtcttaaactcctgacctgaggtgatccgcctgtctcagcttcccaaagtgctgggattacaggcatgagccaacatgcccagcctttgttattgatttctgccctcatcattattatttccttctgctttgggtttaattttctctttagcttcttggtggtattattttagctgatattagtggatttccatttctcccaacctttgtgctattgttaacatatgttttacatatgttataaatcccacagtacattgctttttgtttaaacagtaaattatcttttttttgagacgaagtcttgttctgccaccaggctggagtgcagtggcacgatcttggctcactgcaacctccgcttcccaggttcaagcgattcttctgcctcagcctcctgagtagctgggactataggcgcgtgccaccacgcccagctaatttttgtatttttagtagagacggggtttcaccatgttggccaggatggtctcgatctcttgaccatgtgatccgcccgcctcggcctcccaaagtgctgggattacaggcatgagccaccacccggcctaaattatcttttaaagaaacttaaggccgggtgcagtgcctcccatcactttgggaggccgaggcaggcagattacctgaggtcaggagtcttgaaaaaccaaacaaaacatcaatacaaatgaatatccttctatcctgaaggacaaatgaatgaggacagcatcctcttccttttcccacaatgtaataattcttgatttgagtgtttatcatggccttataagtgcattgttggctattaaaaactttctgtgcttccttacaacaagcaaagttaaaagctggtactgcggctgggcgcggtggctcacgcctgtaatcccagcactttgggaggccgaggcgggtggatcacaaggtcaggagatcaagaccagcctggccaacatggtgaaatctcgtctttactaaaaatacaaaaattagcctggtgcagtggcacgggcccataatcccagctactggggaggctgaggcaggagaatctcttgaacccagaggcagaggttgcagtgagcctaggtcatgccactgcactccaggctgggtgatagagtgagactctgtctcataaataaataaactaactaacttaaatagtaagaaaaaatgtatatatttatgcatgtggctaccattttggtgttcatttctttgtgtagattcatattttggtatggtaacattttctttctgcttgaaggaccttaaatttttgtagtgcatgtctgctggtgatgaaatcagcttttgtgtgtctgaacaagtatttgcctttgcttgtgaatgatatttcactgggcctacggttttaggttgttgttttttttttctttcagtactttatgttgtttcactgtattctagcttggcttgagcccagtaagaaatctcttatcattcttacctttgttcctaatgtgtctgttttctctttttgcttttaagattttctcattgtcactgtttttaagtaatttgattttggtatgccttggtatagctttcttcttgtttcttatttttggagtttgttaagcttcttggatacacatgtttatggttttcaccaaatttggaaaatttttggccattgttacttcaaatattttttctgttctctcttgtcttttggaagctgtttgatgttgttccacctctcactgatgttctttctttggtgtgtttgtgtgtgtggtaaaatatatacaaccaaatttataatttaaacttttttttttttttttttggagttggagtcttgctctgtcacccaggctgaagtgcagtggcacgatctcggctcactgcaacctctgcctcccgggttcaagtgattctcctgcctcagcctccagagtagctgggattacaggcacccgccaccatgccaggctctttttttctatttttagtggagatggggttttcacagtgttagccaggatggtctccatctcttgacctcgtgaccgcctacctcggcctcccaaagtgctgggattacaggcgtgagccactgctcccggctgaaatgatttttttatatagttcagtggcattaagtacatttactgtgttgtgcaaccattatcaccatccatctttagaacttttaaaaaatcttcccaaactgaaattctgtacctattaaaaaatgactcattctccctgctcccagtccctgacagccaccattctactttctgtttctgtgaatttcactactctagttacctcgtataagtggaatcatacagtatttgtccttttgtgactggcttatttcacttagtataatgtctttaaggctcatccatgttgtagcatgcgtcagaacttccttcctttttaaggctgaataatagtctcttttttaaagttctcttttttttctgtgttttattttgaaaagtttcttttcttttcattgtttttttgagacaggctcttgctctgttgcccaggctggagtgcagtggcgcgatctcagtccactgcagccttgaactcctgggcttaggtgaccttcttgcctgagcctctgagtagctgggactacaagcatgggcaaccatgtctggctaattttaaaaaattatttatagagacgaggtctcactatgttgcccaggcaggtcttgaactcataggcttaagcaatcctcccacctcagcctcccaaagtgttgggattgcaaccagcgcccttgaattgtttctattgttacttagttacatttattgctcttaccttctgcagtggctcagcagctgttagtcccatccagggtatttttcatctcagattatttcattttatctctagaacttggagttgcgttagtctttttttacttatctatttccttttttgttgagatggtgcaggggcaggggacatctccctttgttgctcaggctgaccttgaactcctggccgcaagggatcctcctgccttgcctcccaaagtgcagggattacaggcgtgagccaccacctggccattatgtgtctatttcttcatttaactttttggacaaatgtaatacacaattatcataactgagttaatttccttatctgctaattttattaaatgtgtcagttcttgattgattgattcttctcctcattataagtgatactttcctgcttctttgcatgcctgacaatctttgaatagattccagacattatgaattagttgttggacattatgaattcattgttgggctctagatactttggtatttctattaatattcttgagctttttgtgggatgctgttcaactacttgaacagagtttgatccttttgagtcttccttttaagatttgttaggatgaacccagagacatgtttagtcaagggtagggtttctcaatagcagcaccatggcatttggggccaaataattctttgttgggggaggggatagtcctgtgcattatagaatgtttaacatcattcccccccaaagttgtaacaaccaaaaatgtcttcagacattgccaaatgttccaggaagtggggaggattgcccgcagttgagagttgctgccttagggttagttttgccttactactatggcaagatctttctgtgtactctacccaaagctgttcatgagaccttttttcaatctggctctttggaataggtacttttcttggcctcatgtgagtgctgggaattcaattgggtggtctttccttggtcttggttagtttccttacatacatgtgctgataggcattcagctaaatattcaagagagacccgcagatctctggagttcttgtctgtgtatctcgtctccagtattgtgccccataaacactagccatcttgattgccccaaactctcagctccatctcttcaactcagtgagcctgccaggcctcacatgagtttcccatcctgtgcctcttgtggctgggaaactcaaggccgtaacctggggcagtagggttcaccttatttgtttcctggctctcagggattttcctgatgtccagtgtcttgacacttttttttttttttttttttttttttttggagacagagtttcgctcttgttgcccaggctggagtgcaatggcacgatctcaactcaccgcaacctccgcctcccgggttcaagccattcttctgcctcagcctcccaagtagctgggattacaggcatctgccaccacacctggctaattttttgtatttttggtagagacagggtttctgcatgttggtcaggctgttctcaaactcccaacctcaggtgatccgcccacctcagcctccctaagtgctaggattacaggcgtgagccaccgcacctggctgaaacttttttttccccatatattttgtttgttttttggttgtttcaggtcagaggataaatctggttcttgttagtaaatcttggtcagaagcacatgtcctttaacagatcatttatttgtattaattattgataaaagctgaattcttaaacatttactaatctaatttccttattttatcaatttgtatttatcattcaaagtctcctgttccctgtaattcctttggtacaacataaatattaaattggccctaaagctttttatcatcttttaatatacctctttcatgcaggctttcacagggttagctaagtagtgatttagtatgggcctcttaactattatatagtagcatacaattaaagggcatgcactgacctgataaagcagaacagtgaaatgtgtcatgcttttagggcattcccacagcaggctcaaagacttccaagagacttccacgtataacttatattttctagcagctaaaacgtcagcatcaaagcctattagcctgattgaggttgtaaagaactggtgagctaagacagtggaaaaaaacatataaaagaagagaagaatcattttgaacagagtatgagaggaaactgtcctaacgaataatgctacaagaatgggagtgacatggaacccattggtggtaagctgttagagaaaggggaatgttaacagactagaaataatgtgactgaagaaatctggccttgtattttttatttatttttttttatttttgagacggagtcttactgtgttgcccaggctggagtgccgtggtgtgatctctactaactgcaacctttgcctgccaggttcaagcggttctctgcctcaacctccctagtagctgagattacaggcgcccgccaccatgcctggctaatttttttgcatttttagtagagacggggtttcaccatcttggccaggttggtcttgaactcatgacctcgtgatccacccgtctcagcctcccaaagtgctgggataggcgtgagccaccatgcccggctggctttgttttatgtgaaggaaacttgtctctcagatttgctatatcataaccactacagagattatagcatgtgcttgttggatatccaaggatgaagtaatttagtcagagatactttgggtaaaagaagatatgtatagtaggtagggtgaaagcatctagttatccatgtgaactaaaacagcaaaatcatatttctaatggaattgtatatatgatataataaatgatataaaataatataataaatgtataagttccatgtgttaaagtgaataaatcataattctttgacatttgaggtggtgatgatatgctacagctaaaaagagttaagagtttttgttattccataatgcataagaattagacaactttgtaaaaaatacagactccttgtaaatggatgttataataattttcaaagacagggaaactatgtgggtcaataatataagttcttttgtgaaacaaaatatgacttaagtcttccaaaaattacgattgcttttagtaataaagaaataaatacttaatgtttaactgacacttccctgacattcatctgtgggtggattttatcaagcttatttcttgttttctaaatagttttgatgatataaatggtgctcatgtagttagtgtctgcctttgccaagttactgtaagtcttcgtggcaggagtttatgtgggtagggaaagaatgcagagcaataccagctttttttttttttttttttttttttgagacagagtcttgctctgtcgcccaggctggtgtgcaatggcacaatctcggctcactgcaagctctgcctcccaggttcacgccatcctcctgcctcagcctcccaagtagctgggactacaggcgcacgctgccatgcccggctaattttttgtatttttagtagagatggggtttcaccttgttagccaggatggtcttgatctcctgaccttgtgatccacccgcctcggcctcccaaagtgctgggattacaggcgtgagccaccgcgcccggccgcagtaccagcttttaactttgcttgttgtaaggaagcacagaaagtttttcatagccaacaatgcatttataaggccatgataaacactcaaatcaagaattattacattgtgggaaaaggaagaggatgctgtcctcattcatttgtccttcaggatagaaggatattcatttgtattgatgttttgtttggtttttcaagactttgaaaataaagtttaatctaacatatatagagaaaagtatagatcacaattatacagcttgatgaattttcacaaaaggaacaaactcatgtaactaatatgcagatttttaaaaaagaacatttgtattagaacagtttttctttttttcaagctgggtaataggcacataggtgttcgttgtatcattttattcttttatgctttgaagtttgcctaccatttttaaaaaattatctcaggtggaaatacaatcttcagaggtctggaaagtgtcagaaaacctacaggctttaatagttgagaaagtacttttgagaaatagtgtttttttccatgtaggcctttgtctcctatgtatctgatatactttataaacctgagaaggcccaagtaactgaatgttttacaataaaagaagaacataaatagagctgtgtgaaatcaaagtagtaaaaattattggtactttttaaaacatagcaccttattggccttttattctgcagtataaagtctgggtcatcaaatttgtgagtacatggaaatgacagttttcttttaaaaattttattgctaaagtccgtgatagtttaagaataaaatgccctattcagttctataatgtaatattcaaagctgtagaaagaactgagttattattgagattcaaatatatgtctagtttaaaggcttcatatctgttatagaaatcattatgtgtgcagtagttagaaatacgcttaatctaaagggttccctggaattacagttatctactttcctttatgtttatttccccccaggtggggagatacgttttccatgaacatggagatttcagaaatcggatttttttctcttttctttgatttttaaaaatataataaatcttcctatatttcttgattttatgaaaagtattaaaatgggatttttctcagttctcgagtaggctttttaattaaattgtgactcatgcagtggaaaagccatttgtaaaatgtcgttctgtaaaaatgtttggttattaaattttcttctgctgttggagtcatatgcataaaattattagtgtgttaatctattgaaaaccattcattattgaataatttttgtttcttttactctagaaaccaataggatagtgtaggtaaattactgtttctggggtgcgtgtgtgtatatacatatgtgtgcgtgtgtgtgtgtgtacatctctctctctctctctacatatatatatatatagttttttgtttttttttctttgagacgatctccctctgttgcccaggctggagtgcagtggcacaaccatggcgcactgcagctttgacctcccagactcaggtgatcctcccacctcagcctgccaggtagctgagactataggtgtcccaccatgcccaggctaaaatttttttttttttttttttttggtagagataggatcttgctacgtggcccaggactggtctcgaactcctgggcttaagtgatcctcccaactcagcctcccaaagtgctggggattgtaggcatgagccactgcgcctggcctgtttctggtgtatttatgtgtgtttgtctttgaagaaattgttaggacatactgaagcttttgttttgttttcctgttttctctctacaggcagcggaggaggaaatggcaggtcctaatcaactctgcattcgccgctggactaccaagcatgtagctgtgtggctgaaggatgaaggcttttttgaatatgtggacattttatgcaataagcaccgacttgatggaatcacattgctaacattgactgaatatgatctccggtctcctcctctggaaatcaaagtcttaggggacattaaaaggttaatgctctcagtccgaaaattgcagaaaatacatattgatgttttagaagagatgggctacaacagtgacagtcccatgggttccatgacccctttcatcagtgctcttcagagtacagactggctctgtaatggggagctttcccatgactgtgacggacccataactgacttgaattctgatcagtaccagtacatgaatggtaaaaacaaacattctgttcgaagattggacccagaatactggaagactatactgagttgtatatatgtttttatagtatttggatttacatctttcattatggttatagtccatgagcgagtgcctgacatgcagacctatccaccactcccagatatattcttagacaggtaagttttgtttctagttgctaagtttgtaggatgttgctataattaacagcaatgatactatatttatgataattatattgtttcttattgtggtagatgtatactttccatttgctttatctggcggtataaaatgctttgaaattacctttttcacttagagtaaattaggccttaagcctaggtgtgtgagaaaaaccactgctcttttaatttttcaatttaatttaattttaattttaatttaattttttattttgagacagtctcacactgcactgtcacccaggctggaatgcagtggcatgaccatggctcactgcagtctcaacctcccgggctcaagcaatcctcccacctcagcctcccaggaaactgggactgtagacatgttccaccatgcccagctaatttttaagttttttgtagaaatagagtcccaccgtgttgcccaggctgggtgaactcctaggctgaaacgatcctcccaccttggcctcttaaagtgttgggattacaggcatgagccatcatggcctggactgcttaatttatttttgtgtagttatagctccttgggtactttagattttttgagacagagtctcgctctgtcacccaggctggagtgcagtggcatgatcttggctcactgcaacctccacctccctggttcaagccattcccctgcctcagcctcctgagtagctgggattacaggagcccgccaccaggcccagctactttttttgtatttttagtagagatggggcttcaccatattggccagactggtcttgaactcctgacttcaggcagtccgcctacctcggcctcccaaagggctgggattacaggtgtgagccaccgcgcttggccaggtactttagattttaagagggtatctggaatgatgtttgtaataaatggaacttggctgcctttttttatttttttttaaatgaagaatagggttctgctttttcaaaaatattgatggtgtcatatcaccaaatgaattggaactatcacaaagaggacaagtggattcagtgatagcatgctgttttattaaatattgaatacataaaaaaatgtagtatatgtgtaacatatgaaaaataagaatagggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcatagtggcgggcgcctgtagtcccagctacttgggaggctgaggcaggagaatggcgtgaacccgggaggcggagcttgcagtgagccgagatcccgccactgcactccagcctaggcgacagagcgagactccgtctcaaaaaaaaaaaaaagaaaaaaaaaaaagaaaaataagaatagaacagtaggccaggcatggtggctcatgcctataatcccagcactttgggaggcccaggtgggaggattgcttgagtccaggagttcaagactagcctacaagttcaagacttgcaacatagcaagacccccatctctccaaaaaattaaaaattagccaagcatgatggcacatgcctgtagtcctaactactcaggaggccaaggtgggaggatcacttgagcctaacaggttgaggttacagtgagctatagttacaccactgcactccagcctgggcagcacagcgagaccctgcctgtctccaacaacaataataataataaaacagtaaacaagtactcagaactgttttcacatttttgatttttaaatcttttaaaaatttgggtattactttcttgtttgttagtttttggttttgtttttgttttttagatggagtcttgctctgtcacccaggctgcagtacaatggcacgatctcagctcactgcaacctccgcctcctgggttcaagtgattctcctgcctcagccttccgagtaactgggattacaggcacccaccaccacgaccggctaatttttgtatatttagtagagacgaggtttcacagtgttggtcaggctggtctcgaactcctgacctcaaatgatccgcccacctcagcctcccaaagtgctgggattacaagcatgagccactgcgcttggccccttgtttgttttttataaaacattttgcccttctaaaagtgcctttgctgggcattagggctcatacctgtgatcccagcacttcgagaggacgaggctggtgggatcacctgaggtcaggaattcgagaccagcctggccaacatggtgaaaccccgtctctactaaaaatacaaaaactagctggatgtggtggcggacacctgtaattatctcagctactcaggagactgaggcaggagaattgcttgaacctgggaggcagaggttgcagtgagccgagatcgcgccatcgcactccagcccgggtgtcagagtgagactgtctcaaaaaaaaaaatacataaagtaaaataaaactgccgtgtagtatttgtatttgaaaatgaaatgaatttaaaatgtccgtgttcctatgccagaataatgtatacatctcattttgctccctgtcaaaccccaactaaaactatagtaaagaggtttttttttttgttttgtttttgttgttttgagatagagtccaggctggagtgcagtgacacaatctcggctcactgcaacctctgcctcccgggttcaagctattctcctgcctcagcctcccaagtagctgggattacagacatgtgccaccatgcccagctaattttgttgtatttttagtagagacaaggtttcactgtgttggctaggctggtctcgaactcctgactcaaatgatccacccacctgggcctcccaaagtatagggattacaggtgtgagccaccatgcccggtgagctgtagtaaagagttttttgtttttgttttttaagtaagcccacaggatggagtggataaaataggagaaaacagccatacatttttggaagttggaagatggatggatgagtggcaattgacaaacccaaaattaacctaattataaaatttgagcaatggggaaaactgagaaccaaccccgtttatattgcagatttctccaaagtaaggagaacttactgaaagctgtttaagaagttgttatatccgtgtatcttgtctccccttctatacagtttttccaactgtaaacagaagaccactaggaagtaaggaagaaatcatgtggctgtctggggaaaatagtactttaggcaaagcaaacagctgggtgcaaaaatctgaactgggagtgttcctggcaggtttaaggaacaaccagtgagagatgagcagatctgagaggagacaagaagccaggttgtgtaaggacttgaggaccattgtaaggacttcagctttcattctaaatgaaaagggaaggcactggaaagtactgaggacaagagttgagggatctaacttctattttaaaaggtcattctagttgttgtattgagaataccctggggtgtgggtggggatctagagatcatttaagaatttattaaattcatctagacaaagattttagattggatgagaacagtggtagaggtggtatgaaagagtcaaattctatatatattttgaaattagaaaattagagctaacagaatttgctgatgaatttggatttgatgaattaagagagagaaatcaaatattattccaagatgttttttgttttttgttttttttgagacagggtctcactctgttctccaggctggagtttagtggtgcattcatagatcactgtaacctcaaattcctaggctcaagtgatctccttccttagcctcccgagtcactacgactgcaggtgtgtgtcaccacacctgcctgatttttaaatcttttgtagagatggggttttgctatgttgcctaggctggtctcaaacttttggcctcaagtgatcctcccatccctgcctcccaaagcactgggattgtaggtgtgagctaccaccccccagcctattccaagatttttaacctgaccatctgtaaagatggagttgccatttacagagatgggaaaactgtggaaggagctgacttggagggaaaattaagggtttggttttcgacatgtcaggtttgaaatatgttttgtagcaaattcagatgtcaaggaagagatggaaatatgagcagaagttcagagagattgagagagacagaaatctaggctaagatttgggaatgggcagagagagagaacagtatgccagaagccaagcaaaaaaaaaaaaaagtattttaagaagtttaggaacaattggctgtagcaaatgctgctgaaaggtcaagtaagatgaggataattgaccattggctttagcaacatgttggtcatcagtgactatgacaagagttaataagggcaaaaatgggttataataggttcaggagagaatgtgagatgtattggaatttacatgaaggtactccacaaatgtgaaacaacatgagcacaacagtatttgttgtgacattgtttgtaataattataaatattgtaaataatctaaatgcttacccatgggaagctggttgagtagactatcatacatctatacagtggcatactatttaatcatagaaaagaatgaagacaatttctgtgagctgatacaaaatgatttgcaggaaaaactcagcaacaatagcactatgagcacacagatcgtggttttaaaatactgttcccaggccaggtatggtggctgactcctgtaatcccagcattttgggagacccaggcgggaggattgcttgagcccaggaattctagcccagcctggacaacctagtgagatccagtctctacaaaaaattaaaaattagctaggtgcggtggtgtatgcctgcagtcccagctacttcagaggctgaagcaggaggatcacttgagcccaagagatcaaggctgtagtgagctgtgatcatgccactgcactccagcctgggcaacaaagcgagaccttttgtttgtctcagtaagtaagtaagtaaacaaataaatacataccattcctcacgaaaatgaactagaccagggctgagaccaagcaaacaaaaattgtggggtgagaggggaagctcttcaagaataatacgagcaaataaatgtgggcagcatgattattctgcctcctccagtgtattcaggcaagtcatcagtagatgataaaatctattaggtgaaaggccactgagggggagcttattcacatgatctgaaagtttcatctcacctattacttaattacagagggaatgaggtagctttacaatggcaagatctgacatgcatcaccttaaccaaatgatcaaatgtagtagcatcacagtgggacaaacagacattatgtgcattggacgtgatgtccacagcatcacctatgtaatcatcttgtccaaaaaaaaaaaaactttaacctatatctaatcacgaagaaacaatcagacaaatccagaacatggaacattctacaagacagctgacatggactctaaaaatgtcagtgtcatggcaggcaaaatccagggggaaatgtaagggaaattgaagagacaaccaagagccacgtgaaatttaattagatcctatatcaagaaaacaaaaataatgctatacaggacatttttgggacaattaggaaaattggaatatggactgcatgttaaataatggtactaaatcagtgttacaatgtccttggtgtaatagtatattgggttatgaggaggatatccttgttcctagagaaacaaaggggagaagtgtcataatgtctgcaacttacttcggggaggggttcacctccccgaaaagagtatgtgtgtatatgtgtgtaggtatgtatagaaagaatgaaagcaagcaaatgtggcaaaatgttaattattgtaaatgatgagtttaggtgaataatatagtgttgattcttttaactttttttgtagatcagaatttttcacgttaaaagaattaggcaaagaaatgatgagggggagagagagagagagagagagaataggaacagagaaattggagacatatgctatatgatagcatgtttgttgtattgataataagaatgactcaatgtaggggggtaatgatggtagaggaaagagagggtataatgttagaacagtgcccttgagtagatgaaaaggaatggtaccttgtggctgggagaggctggccttaggcccttgggctgttccttcataacagaggggaaggtagaaaataggaaaataggtggaggttgccatatgtgatggtggagcacaacgaagtgctctcctgattgtttttattttctctgtttaaagacaaaatggagaggaggatggaggcttgaggaggaaggatgagatgtataaaataagccatctaggagagtaggagagtgaatagacttgtgtaatgcattagcagcacttaatggtctccttgaggttagtagtcatattagcattgtgtgtttttaccagcctcattcaacagcagatacaggtatggaataggtggagaactggatttaagcagggttgagtattgctaggcagtacaatgaagggaaaagtggcaagggagtggttttaatgagggaccatggactgatatggatgaggaaagaagtaaggccgggcgcggtgtctcacgcctataatcccagcactttgggaggctgaggcgggcagatcacctgaggtcgggagttcaagaccagcctgaccaacatggagaaaccgcatctctactaaaaattcaaaattagccaggcatggtggtgcatgcctgtaatcccagctactcgggaggctgaggcaggagaattgcttgaacctgagaggcggaagttgtggtgagttgagatcacaccattgcactccagcctgggcaacaagagcaaaactctgtctcaaaaaaaaaagaaaaaaagaaggaagtaaaggatataaggtagatgaaaaaataataaaaaacaagcaaaaaataaaaaaacaaagcatagtgggagagcaggaaatggtccagcagaacaatgaggcttttattattttaaagtatacaggctgagtgcggtggctcatgcccgtaatcccagcactttgggaggccgaggcaggtggatcacctgaggtcaggaattcgagaccagcctggccaacatggcgaaaccctgtctttactaaaaatataaaaattagccgggcgtggtggcatgctcctttagtcccagctactccagaggctgaggcaggagaattgcttgaacctaggaggtggaggttgcagtgagccgagatcatgccactgcactccagcctgggtgacagagcgagactctctcaaaaaaaaaataataataaagtatacaattcagtgggttttagtgtatttacaaagttgtagagccatcaccactaattccagaacattttcatcatcctgggaagaaactcatacccattagcagtcatactctattccttcctttctccagaccctagcaaccactaatctactttgtttctatgaatttgtctattctggacatttcgtataagtggaaccatacaatatcgggtctttttgtgtcactcagcataatattttcaagattcatccgtactgtagcatgtatcagcactaccttctttcttattaccaaataatattccattgtatggatgtaccaattttgtttatccatttatcagttgataggtgtttgtgttgtttctactttttggctattattaataatgctgctatgaacattcatatgcaaagttttgtgtagacaaatttttttttctttttctttttttttttttgagacagagtctcactctgttacccaggctggagtatagtggtgcaatctcaactcaccgcaacctccatctcctgggtcaaacggtgctcatgcctcagcctcctgagtagctgggattacaggtgcacaccaccacacccagctaatttttgtatttttagtagagacggggtttcaccatgttggccaggctggtctcaagctcctgacctcaagagatccgctcatctcagcccccacaaagtgcaagcattacacgtgtgagccaccacacccagcgggacatgtattatcaatttgcagtgaggatttcaaaccaaattttgcctaattctttttacttactatgccactcactaaaactccatggtcttaaacatctaaactttattcataggagaatggtagcagatgctgtcagtgttccttctatatcccctcagatcccttttccattttcttgcacatggatactcccaacatccagcagatacgtctccgttggagggctgctctttgcctacttggagagaaagccaaaaaatacttggaaatttacttcccaccagcagctgttcttaaccagtgactcatttctctttgccctaattgggacgacatttagattggacctacactgtcccaaattacccataagcctgagcgaaagttaccctttcctgagttctccacagggctttgcttgatgtctcacccttgctttgcttccttgccttctaatctcataacccactaccctgtgggttttctttgagaacatttccctgtaattgactttcacactgatgtttgtttcagggtctgcttctgaagcttattttacacaaatccaatatgttcagcatatagaaacagaaaattagaagaagataggaatgtttctagaagcaggcccacctacagcagtgagaagtgagagctgataaccataatagcaagggaggaaacaaaacactataaaaagcaaacataaataatggaaaaactgcatcaatctggggcttaactgcccttcatttctcagtagtctccaaggtcattaccatatacagtgtaataatcagtgttcatagtgatgactctaaattactaaagaaaattaaatttttttttttgagacagagtcttgctctgtcgcccaggctggagtgcagtggcgcgatctcggctcactgcaagctccgcctcctgggttcacgccattctcctgcctcagcctcccaagtagctgggagtacaggcgcccgccaccacgccaggctaatttttttttttttttgtattttttagtagggacggggtttcactgtgttaaccaggatgatctcgatctcctgtccttgtgatccgcccaccttggcctcccaaagtgctgggattacaggcgtgagccaccatgcccagccaagaaaattaaattatatccagaaaaaagacatatccatgtataatgcattttaaaagcttagctcaaaataatataagggattgaatacacatttgacaggttcctcacaacagtccactaaaatggcagtaaaagagtgaagaaactgtataatcccatgaaagcaaaaacagtgctaataatgaaagtttggaaagtagaacgctaagtacctgttgtgaggttgtgggtggaaggtggccctgcccaagaggtaagtttatttgtacttcagagctcccataaaacagaaagtaccaagcatcactcaaggccaggtacagataggagctaaataggggaaagttggttaaaaatcttcttaagcctgggcaacatggtgaaaccctttctctacaaaaaatacaaaaattagccaggcatggtggagtgtgcctgtagtcccgggtattggggagtctgaggtgggaggatggcttgatcccaggaggtggaggttgcagttagccgcgattgcgccactgtactgcagcctgggccgcagagtgagaccctgtctcaaaaaaaaaatctacttaagcttttagacctgctctactctgacagaagactagtggtctgttctccagagcagttgaatatgaagcactgttgacttagggataccgtgtccagatgagaacagagctgccatgttttaaagaggattcattaaaagtctatataccaatcacagagacttctagctcccttccttaagtagccagacttatttctcatctcccctcctacccaaccccagccttccaagaagggtaagattcctttccttggaaaacctgaagaaaaacaatgtaaatagctggttgggatatccttttctaatcaaccagatctctgcgcaccctgagtgcgcagagaaacccaaagcttgacagagctcagtctatgcccacagaatgtctcatcttttttagtactttactgtcaaatatgaatggtcagtcaagaaaccagacgtctgagaaaaacataagcgcaaacagaaaaaaaaaagtaaattggaaaacaaaataaggagcagacgaacacttaaaaaaaaactttcgtgttttcaagagaaataagagatgttgcattctatgtgacagtaatgagaggcccaaagaaaattcagagaaaaagagcttttgggggaaaaaaaaaaagtagagatttaaaatccagcaggggctgggcgtggtggtttacacctgtaatcctttgggagcgctttgggagcactttgggaggccgaggtggccaggtcacctgaggtcaggagttcaagaccagcctggccaacatgggaaaaccccatctctactaaaaatgcaaaaattagccaggcgtggtggcaggtgcctataatcccagctactcgggaggctgagacagggagaattgcttgaacccaggaggcagaagtggcagtaagccaaaatcacgccactacagtccaacctgggcaacagagcaacactccgtctcaaaaaaataaataaataaaaaataaaatccagcaggattggccagccaccatggttcacacctgtaatcctagcacttctggaggccaaggcaggtggatcacgtgaggtcagcagtttgagaccggcctagccaacattgtgaaacgctttctctactaaaaatacaaaaattagctgggcgtggtggtgggcacctgtaatcccagcaacgcgggagactgaagcacgagaattgcttgaactcaggaggtggaggttgcaatgagccaagattgcatcattgcactccagcctgggcgacaaagcgagactgtgtttcaaaaaagtgaggctgggcacgtggctcacgcctgtaatcccagcactttgggaggctgaggcaggcggatgacctgaggtcaggatttcgagaccagcctgaccaacatggagaaaccccatctctactaaaaatacacaattagccgggcctggtgctgcatgcctgtaatcccagctacttgggaggctgaggcaagagaattgcttgaacccaggaggcggaggttgtggtgagccgagatcgcgccattgcactccagcctggggaacacgagtgaaactccgtctcaaaaaaaaaaaaaaaaaaaaactgaattgccaagatgagagttaattttattctaggaaataaccatgcaggaggattggaaaatacaaccattctaaattggaataaaagggagaaggctctaggagagattgccctggaggaaaaattgaaattgatagtttggggatgagttagtaataagcactcaggaaacacagagcaaactaaaaaaaagaagaatttattagctccagagaattacaaaaagttgtacaagagaggaatttttttttctttttttctttttttttgaaacagagtctcgctctgtcacccaggctggagtgcagtggcaacgatctcggctcactgcaacctccgcctcccgggttcaagcagttctctgcctcagcctcccgagtagctgtgactacatgtgcctgccaccatgcccggctaatttttttgtatttttagtagagacggggtttaaccatgtgggccaggctggtcttgaactcctgacctcgtgatccacccgccttggcctcccaaagtgctgggattataggcgtgagccaccgtgcccagccatgttttctttttttaaatacctttatttccctagttataaaattaacatgtcattgtagaaaagtttttagtagaaatgtacaaagaataaaagaaacgtcaataattctggcacccagagatgacctattggactattttgttcgtttcagtctccttccccttcctttcttcctcccttcctccctaccttccttctttcttccctctttctttttttcttttttgagacagggtctggttctgtcgcctaggttggaggcagtgatgaaacctcggctcactgcaacctctgcctcccaggctcaagccatcctcccacctcagccttccaagtagctgggacttacaggcgcgcagcaccgcatctggctaatttttgtattttttgtagagacctgggagttggggttgttcaccatgttgcccaggctggtctcctgaactcctgagtttaagtagttggcccacctcagcctcccaaagcactgggattacaggcgtgatccaccatgcccagcctctttctttctttttctctccctctctctcctttttctttcttaaagtgacctgtcctttattagtgggtaatcataggagctgtttggtggggaggaaaaagggacaaattgaaaatagaaaaaaaaccagggttacaaaacaaggggggatagagagaaagaggtaaaacaaaaaacaaaaacaaggggccaggcgctgtggctcacacctgtaatctcagcactttggaagtctgagacgggagaatcacttgagctcaggagtttgagaccagcctgggcaacaaagtgagaccccatacaaaaaatacaaaaagttagccaggcatagtttcacgggccttgtagtcccggccacttaggtggctgaggtgggaggatcacttgagccctgggctgtctaggctgcagtcagctgtgatggcaccactgtactgcaacctgggtgacagagcaagaccctgtttcaaaaacaacaacaacaataacaacaaagcatcaagttcaaaccctgattgtttgcactctgaaaagagcacttcatgcaagaaatgggcctttctcccattgtcctttgtgggtagtcctatatccagatctgctgtgctataggatgggagaaaagggttgccacttctttttttttttttttcctctggtatttgctgtcagagaaccctaactgggaatcaatggacaagaaacaggttccgataggtgggggtactttatgacacagattttttctcccagtttctccaaatatcattttctgtaagagataagttatataaaaccaattttaaggtcattattaaaagagcaccttactgaaaagggtggcatcattcacatgtatacttcttcaattcaaaatcatttttttctgttccagcgttcctagaatcccatgggcctttgccatgacggaagtatgtggcatgattctgtgctatatttggctcctggttcttcttcttcacaagcacaggtacctcattactccattaaatgactgaaaatgttttgactcctgtatcaagatcataaaatcttaacctttctctttgcagtttccttgttaatttccttctctggtcattgtgacatagttattaacaaaggattttgagtttgatcagtaagagtcagcctaagataatatctacatatttagtaataatcctgaatgcattttgcacggaaagatcagagatgccctatggctgatcgtgctcatctctgatctaaaaaaaagaggctgggcgcggtggctcatgcctgtaatcccagcactttgggaggccgaggcaggcggatcacctgaggttaggagttcgagaccagcctgaccaacatggagaaatcccgtctctactaaaaatacaaaattaactgggcgtggtggcgcatgcctataatcccagctacttgggaggctgaggcaggagaatcgcttggaccccagggtcggacattgtggtgagctgagataagaaagccttttctttccttagaaacaaactggaaaagttactttctgtaggatagaaactcttccaaggacattctttggtcacatgtttagatggaagaaattttctctgctttgaggaggcccattaaaaaagagattattggccgggcacggtggctcatgcctgtaatcccagcactttgggagggcaaggcaggcggatcacgaggtcaggagattgagaccatcctggctaacacggtgaaaccctgtctctactaaaaatacaaaatattagctgggcatggtggcgggtgcctgtagtcccagctaacttgggaggctgaggcaggagaatggcatgaacccaggaggcagagcttgcagtgagccgagattgtgccactgcactccagcctgggcgacagagtgagactctgtctcaaaaaaaaaaaaaaaagattattagccaggcacagtggcacatgcctgtaaccccagtactttaggaggctgaggtgggaggattgcttgagcccaggtgttcaagaccagcctgggaaacatgaggagaccctgtctctacaaaaaatttaaagattaaccaggtgtggtggcacatgcctatagtcccagcttctcaggaggctgaggtgggaggattgcttgagcccaggaggtcaaggttgcagtgagctgtgattgtgccactgcactccagcgtggggtgacagagccagaccctgtctccaaaaaaaaaaaaaaaaaaaaagaaagattattttgtacaacatgtacatatagtctgtgtggtttacttcagatggtatgggaagttgctaaattggaaagtgtgtcttggcactttcaccaaaaaatatagacgaaagaatttatttactttcattttatttacttttactgcttcttgtggagcagggctaactcacaggcagtgtacccagagtcagccaggaaaaattttttaattaaaaaaaggaagcctggggggctcctttcctagtttaatgggcaggaagaattagtggatttaagtaaaaaacaaggcattgtaaacaaaaaatttaaagataaaattagtagatattgcataagagctcctgaggggctttttaaaaaactgtagatatgtgagcttttgagattgcttaaaaaaaaaaaaaattgtagcttctgctctccattgtctttggaacactggagagaggaacaagggtagttgcttgaggttttgacctttctcctcaccaggaagtgcttgaggtaaaccacagtgatgagctttaggtcctaagcagcagttatttcagtgttctgaaggtgaaaagaaaggttggtggttactattcttatcatacttttaggccacattgagccatattctctcccattttgtcctgttttgcagcaatattttaaattctggattgcttaaaaccagaggtggttttaaaacatgtgtatcattgctgctttctggttaactttgcctcacaagatctcatgaacttgaatttatctactcttcaaaactggagtttaccttacaggaaaccttggtaggtttaacaaagcatagaggtaacccgttaaatccaagtgttaatgtttacttagtcaaagaaagtgtttctcaaagtgtttgtaccactttcattagaatcacctgggtgcttgttaaaatgcagattcctaggttccatctcaggagtgcacactaatgcttgaaacatacctagccttgtgttcagtgctttctctgagggtgggaggatcatttcaaaaatatgtgatgtatggtccctgtcctcaggaatattagtccaacagtactggtgttgtcacagtgcagttcatgattacccaagtgacagttactcagaatttttatttgatatatacttgatataaacattttttttaaaacatagtgttttatagcttaagtttaagttaagagaagttagaatgagtattcgatagctactatcattaactaatttacagtgggtttttttgttttgtttgagatagggtcttgccctgtcacccaggctagagcacagtgacatgatcatggctcactgcatccttgacctcctaggctcaatcagtcctctcccctcagcctaggactgcagatacacaccaacatgcctgactaattttttatagacaagatgttactgtgttgcccaggctggtctcaagcgatcctccttcctgccttggtctcccaaagttctgggattatagacatgagccactgcacctagcctacagtgttattaatgagcaaaaaattccctggaatcacaggtgtttaactttacctcctttttttgttttttatttttattttttgagacaagtctcattctgtaacccaagctagagtgcagtggcacaatcatagcttgctgcagcctccaactcccaggcccaagcaaccctcccacctcagcctctcaagtagctgggatcacaggtgtgcaccaccacatccagctcatttttaaattatttgtagagatgaggtctggttatgttgcccaagctgttgtcaaacttttggactcaagcaatcctcccaccttggcctcccaaagggctgcaattacaagcatgagccaccatcctcggccaactttatctcttataaataatttaagagcaattttcagtaataggactaacaccaggcttacttgtcttctgtcttgtataactcttttactttcttttagccatattttctttttttttgagacggagtttcactattgttgcccaggctggagtgcaatggcgcagtcttggctcactgcaacctccacctcccgggttcaagtgattctcctgcctcagcctctcaagtagctgggattacaggcacacaccaccacgcctggactcttagccatattttcttatcagtgaaatgatgctcttagaatctaatttaggtctgtattgttcattatggcaaaatttaaattaactaaaatgaaataaaatttaaaactcagttcctcagtcatactggccacatttcaagtccgtaagatccacatagtatataaatagcttcttggacagtatatggaacatttccgtcattgcagagaattctgttggacaacgatgcttttgatggtctttaagatttctgtcctcttcaaagagtctagtgatttttctgtttgctcttccttgaagtaaatatttgatgcctggggttttttggtttgttttcttctgatctttccccctttttggttgatctgttacaggtcaatacttctgcgaaggctctgtagtctgatgggaactgtattcttgcttcgctgctttaccatgtttgtgacctccctctccgtgccaggacaacacctgcagtgtactggaaaggtagcctgctaccttctttatcattcttgtttttggtgggttgatggcacactatatgcaatagggctaagattttgcttatagtattaaaatgtgctttttagtatctgcaatgtctataaaaaaaactatagaaataatttggtaaaagtcttaagccagattctacctctctcttatttctgttgaaactcgttctatgctatggagctatagaaaacaagtttctttcggccgggcgcagtggctcatgcctgtaatcccagcactttgggaggccgaggcgggcggatcatgaggtcagaagttcaagaccagctgggccaagatggtgaaactccgtctctactaaaaatacaaaaattagttgggcgtggtggtgggcacttgtaatcccagctactcaggaggctgaggcagagaattgcttgaacccgggaggtggaggttgcaatgagctgagatcgtgccactgcactccagcctgggcaacagagcgagactccatctcaaaaaaaaaaaaaaaaaaaaaaaagtttttattttggccgggcgcagtggctcatgcctgtaatcccagcactttgggaggccaaggtgggtggatcacgaggtcaggagtttgagaccagcctggccaagatggttaaaccccatctctactaaaaatacaaaaattagccaggtgcagtggtggacgcctgtaatcccagctactcgggaggctgaggttcaatcgcttgaacctgggaggcggaggttgtagtgagccgagatcgcaccactgcactctagcctgggcaacagagcaagactctgtctcaaaaacaaagaaagaaagaaagaaagaaagaaaacaattttctttcaattatcattttccctttcccaccatccttagcattttaaaagtttctcatatggcatgctctggttccttcactgtcctcctcactcctttaaaaatgttgccggccaggtgcagtggctcacgcctgtaatcccagcactttgggaggccaaggcgggtggatcacctgaggtcaggagttaaagacccagcgtggccaacatggtgcagtctactaaaaatacagaaaattacctggtcgtggtgacgggcacctgtaatcccaggtactcggaaggctgaggcatgagagtcacttgaacccaggaggcggaggttgcagtgagccaagatggcaccattgtactccagcctgggcaacaagagtgaatctgcatctcaaaacaaaacaaacaaacaaacaaaaagaaagttgcagtttgacgacatactcagcactctaaactttactctttctgagataaacaaaataatggctgacttttggttttcattttatattttgtggatttgttttggtgtactgtagacatctcttctcattaaacagaagaaattatgcagatgggaacaaaataagactgttaaaatcgcctgtactttatatacaaaattggctaaaatctgtatacaaatttgcaaagaattttgtccaaattatatacaaatttggacaaaagaactctacttttctaggcctctatgctttaattctgtgttctcacatattcaaataaatgtatgtgttaacacctttgtaattattttaatgttgtttgtaacagcattcacgttcacttcttgtactgcaatatcatagctgaaatgccaacaagggaagattaagcagccaaaggagatcaagagctaaaaatatacccctgagctgaagggtgacaaaactttctcctggtattaggaaggcttagactgaccagtaagaaagggggaagggttgatatgacacaggatttcatgtaaaggaaatgttttatttttaaggtaaaagctgttttgaggtctttttttctttttccaaaaaggaaaagtaattttttcaaattataaaattatatgtttattataaaaattcaaattatatagaaatgtatatattaaaaagtaaaaattcacctgattcttttttaccacaccctataaataatacagttaacagttgtgtgtatagccacacagaccatttttaagcatacttacacactcatataagtttttttgggtttttttttttttttttttttgaggtggagtctttcccagtcgcccaggctggagtagtgtggcacagtcttggctcactgcaacctcctcttcccaagttcaagccattctcctgcctcagcctcccgagtagctgggaccatcacacctggctattttttgtatttttagtagagatggggtttctccatgttggccaggctggtctcgaactcctgacctcaggtgatccacccgccttggcctcccaaagtgttgggattacaggtgtgagccacagcgcctggccctcatataagttttcatagatacttttgaaacaaggtaggattatattgcaaacattgttctttaacctagttttccttttctttctttctttctttttcttttttttttttttttttttttttgagatggagtctcgctgtgtcactcaggcgggagtgcagtggcacaatctcggctcactgcaaactctgcctcccaggttcatgccattctcctgcctcagcctcccgagtagctgggactacaggcgcccgccaccatgcatggctaatttttttgtatttttagtagagacggggtttcactgtgttagccaggatggtctcgatctcctgacctcatgatccgcccgccttggcctcccaaagtgctgagattacaggcgtgagccatcgcgcccagcctctttagcctatttttcatttaatagtatgttgtttacttttttctgaagaagtacatgtggtcatattcatctttttaacagtattccattgtggataccaggctccaaatgatgtacattttggttgtttcaaaattttagtatttataaacagtgctatagtaaacattcttgtacattgtgcttttgcacttactcagttatctccttaagataaattattgcaagtaaaattatagaattaaaggacatgcacattaaaaaatataatatgggctagacaaggtggctcatgcctgtaatcccagcactttgggagtccaaggtgggcggatcacttgaggccaggagttcaagaccaggctggccaacatgatgaaaccccatctctactaaaaatacaaataattagctgggcatggtggcgggcacctgtaatcccagctactcgggaggctgaggcagaagaatcacttgaacctgggaggcagaggctgcagtgagctgagatcacaccactgcactccagcctgggtgacagagcgagactccatctcaaaaaaaaaaaaaaaagtggtatgtgttgctgaaatacacacttgaaaagatgagtttttcactactgccaacatgtatgcgtgtcagctttctcaccctcttgccagcagtgccattctgattgatgaaaggtaatatctaatgcttttatgttcttatttttttatattttacatgtttaatttattttgaatttgtttctgtgcatggtgtgcgcagtttcttcaaaatagtatgctgtgtacatggtatgaagcgtttcacccaaatagtattctagttgattaggggagattttattgtattttagtcattgtttttttaagacagattctcgctttgtcacccaggctagagtatagtgtggcatgatcatagctcactgtcagcctaaaattcctggtctcaggcagtcctcctgcatcagccttctgagtagctgggaccacaggcacacgccaccacagccaactgatttttttttttttttagacggagtctttctctgtcgccccggctagcgtgcggtggtgcgatcttggcttactgcatcctccacctcctgggttcaagggattctcctgtctcagcctcccaagtaactgggatcacaggcgcctgccaccacacccagctaatttttgtattttcagtagagatggggtttcaccatcttggccaggctggtcttgaactcctgaccccatgatccacctgcctcgacctccgaaagtgctgggattacaggcgtgagccaccgtgcctggcctaattttaattttttttttgtagaaacaggatttcactttgctgctcaggctggtctcgagctcctgacttcaagtgctctttccatctccacctctcaaagtgttgggattacaggcatgagccaccatacctagccaggacagattttaaagaagaaaaatataagcttattacactgaaaagagaaaattttccatagctaagggatttaattgtaggacagccactgaggagagggatatccgtgcatagggctgcaacatatgctgcaaaaataaattagataccatccttctatggtataaacagccctttttctgtctctaatgactgtttttatcagttggttatatatagatatttctactccaatctgacctaaatactgttaattgctttgaattataatataacctacttattgacccgtattatttgcagtaattgttataaatagaaatcaaatcccttacagtgaattccataaggtagtttcattataataaattaattgcttgaaattgcattcctggaagtaaggggtttgaggacagaaccaataacatgcctatttttgaaatttagaaacacttaatgcatatttctacaccttctcttgtcaaaacatcctattcattctgctccgttgtgtttcagtttttattttttggaaggatatatgagacatttaagatgggaaaggatggagagataactgccttttgactggcatcactagtttcctatccttggttgagacattttcctaccagtctcttctgtttatttactacatgattttttactttctcaagagtaatatatctctaagcccgtgttcatagcgatcacagaagaaccaaacccatgtgtattatctttctttctctctaataataaattcttcttcctttctttccctcaaatgaggcagaaagggaaagctgggcagtgtataatcagcaggtgagattcctaatgagattgtgatatctatgaggttgtttattttggtcatatttgatagaatctttaagacatagggctttggaattgggttccctgggttcacatcctgactgtgttacttactagctatgtgacctctctaagccagtttcctcatctgcacaattaaatcacttcataggattgctgtggaaattaaatgcagtaacatataaagcacttagcagcatgccttgcacatagtaaatgtacataaaattttagcacctttttgtaccattattatgttattattaaattgtattattataataatactagtatgcctttttgtgtgtggtttttgttgttgttgttgtttttttgagacggagtctcgctctgtcgcccaggctagagtgtagtcaggctagagtgcagtggcgcgatctctgttcactgcaagctccacctaccgggttcacgccattcttctgcctcagcctcccgagtagctgggactgcaggtgcccgccaccaagcccggctaattttttgtatatttagtagagatggggtttcaccgtgttagccaggatggtctcaatctcctgaccttgtgatccacccacctcggcctcccaaagtgctgggattacaggcgtgagccaccgtgcctggcctctttttttttttttttttttttgagatggagttttgctcttgttgcccaggctggagtgcaatggcacgatttctactcaccacaacctacccctcccgggatcaagagattttcctgcctcagtctcctgagtagctgggattacaggcatgtgccaccatgcccagctaatttttgtacttttagtagagatgggttttccatgttggtcaggctgatctcgaactcctgacctcagatgatccacccacctcggcctctcaaagtgctgggattataggcgtgagccaccgcaccctgcagtatgctttttttttttaagtgactgtccctcttttgtaaagcagttgtcactcaaggtcttcctcaaaatggactgcttttttaggcgtatgtgtgggagttgggattaggtttggctattgataactggaaattcaaagtggctatggtttaataaacacacaatggtttattctctctcaaaaaagagtctgaaggtaggtacacaaggtctggtatgataattttacgaagtcatccaaaaaaaccccataattcttctgtctttctggtctgctatcccaatacttggcttgtatcctcaaggccactttgtggtccaagatggttgctggagtttcacctccagttgaatgagtctgagttgtagactaaaaaaaggaaaggtaaaaagttagaaaagacttcctcaaaactgttgtctcttaccttgataagtagccttcccagaaacccttaacacttctacttagatcttattgtacagaacttagtcacgtggccacacctagctacaagggaggctgggaaaggcaatattttggctgaattcattgctgcctcaatatatttgagattgtgttaccagtgaagaaggggagagtggatgttgaaaggtagacattgatctccgtctgtcatagcctatgtcttattggcaagaatagccaagcaactactactgtgatattggattaaaaacttggagatgtttttgtattatagagaactttttattataaaggaactcctagtaaaggagttcatgttacagtgatttcatttatttatttatttatttatttatttttaattaattaatcaatttttttgagacagagtcttactgtgtcgcccaggctggagtacagtggcgcgatctcggctccctgcaacctccgcctcccaggttcaagtgattctcctgccttagcctccctagtagctgggattataggtgtgcaccaccatgcctggctaatttttgtatttttagtagagttggggtttcgccatgttggccaggctgatgttgaactcctgacatcaggtgatccacccacctcagcctcccaaagtgctgggattacaggcatgagccactgtgcccagtctgatttcatttaattaccaaaatatttctgagtacagccaagctttgcccacccattcttgaagtctggctggaattcattagactgaaggcctagatgctttggcttagatcttatttctaagttattcagcatttgaatttcaataggaatggatgttgggaagttcccacctccctaagcatttgaagcactaattcataacttttcttcatagatatatggcagtgtatgggagaaattacatcgagcctttgccatttggagtggctttggtatgaccctgactggcgttcacacatgtggagattacatgtttagtggccacacagtcgtcctaactatgctgaatttctttgtcaccgaatgtaagtatctttttagtgcttctatgcgtattaggtaactagctgcagtgaaggctgtgggaagggtgtcagatcctgtgaagaatggcaaaacagcctgacctgagaaacgtgactgagaagcattggaaggaatgtagctttaaaatgatctttctgtccttttcctagatacaccaagaagctggaatttcttgcacactttatcctgggttctcaacctctttggaatcttcttcatcttggctgcccatgaacattattctattgatgtgtttattgctttttatataacaacaagactctttttgtactaccatactctggccaataccagagcatatcagcagagtaggagagcaaggatttggtttcccatgttctctttttttgaatgcaatgttaatggcacagtacctaatgaatattgttggccattttcaaaaccagcaataatgaaaagactaattggatgaatactatctttctaatgaatttgtgattaaatatataatagttgttgaaaatgagtaactttgcgttctccccctaggttgttcttagatgcctggcttatgtgttgacaaagtaaagttttctgttctgagcaaagttatgattataaaaagcaagaaagaacaatcaagagtccttatgtagctatttgaacagaaagcttaagtagatgttttctgccccttctctttaggaagacttaatgttgtgattgaagtcaggctgtacccttacctgttgagtatttgcttattgaactttaaacaagtcaacttgagcagtttgctggttgaggaattttcattgatttccagtagggctctagtcaagaaataatatgttttgaagctccttattacctttagaagaagaaaccctaacaagtgacagtacttgttctttggactaatctttgtttcattttaaaaaatgcaaccctgggacatgatctgttttactgacaaagagtttttgccttctgaaccatctttaaatatactgagcataccaggatgcctgaaataagaagagaatgaaagaggccatagatgacgtgacagagtactggctaggatgccattggtctcctcattaatgcaaatgtagggctggcatatttcaccaaagatgcaacaaaagatgcagtgccagtgtgaccctcagtgagtattcatgagggaaaaatggctgcatccataaaaataaatgggcttaatgttagtggtataggtacccagaataacttctttgtgctatagttgttagatgacagttcaattttatgcttttttaatggtgttattaaatgagccaaataggagtgttttaccagatgttagataaagttcttaatgccgttaagtagggaggtatgcatgcaaagaattgttttctcctgaaaagaaacttacagcacgcaaaatataactttttggtttttgaaatttatcattcttggctgttggaagtaaacagtctcagacatacttggatatgaaaaagtttcgttgttttttacttttaaatataatggtgtatatacattctttctatttagtcttaatttggcagtcaggaagtgatataacttagctgctatttacaacactagaaatttagtactttaagtaatttcacatctatgataacatttgttactttatttttaatgatttttttacagtagttatgacagtaggatggttatggaattggaatttaaactcccaactaatgagcttaagctgcttggaatattaattatgtagtttttacattccattttaaaacaaaaacttagaaaaggtgctggcattctgaggcctgcaattaggccacatagcagaagcttgctccttccttatctgggtgaaatattttatttttgcactttgagtcatattcccacccctgtataagctacataggagcctgaatgaattgggtaggaaaggaaattatgcaaacaagtctcagctagtgctgaatgaccccaatttgggtctgctgtgaacatcatttttgtatttctcacttgagaaatgctgcaaggcaattcaacttttatgcttttaaatctcacaactcagaatctgatatcttaaatcactgattctgttacatgctaggaacaaaatgccaacatctcatgtaaagaagttgcataatcatgaaaaataaaggatgtttcctatgccagttagagtggtttgacccttcaggtaaaaagatatgttactgttatttttctacgtgacagaacagactgaatttagctagggaggcagtgatgttggcttttgggaaagggttcaaaaaactgtatggcaacattaatgctaaaatgttaagccgagtgcagtggtgcaaggctatagtcccaggttctgaggaggctgaggcaggaggattgcttgaggccaggagttagaaactagagtgtgttataacgcctatgaataaccactgcattccagcccgggcaaggtagcaagacccattctcttaaaaacatggctgggtgcaatggctcacgcctgtaatcccagcactttgggaggccaaggcaggcggatggcttgaggtcaggagttcgagattagcctggccaatatggtgaaacctcatctctactaaaactacaaaaattagctgggcatggtggcacgcacttgtaatcccagctacttgggagactgaggaacaagaaacacttgaacccaggaggtggagtttgcattgagctgagatcactccactgcactccagcctaggtgacagagtgagactccatctcaaaacgaaacaaaacaaaacaaaacaaattagagtgggtgcagtgtctaatgcctgtaatcgcagcactttgggaggctaaggcaggaggatcacttgagctcaggtaaaagagaccagcctgggcaacaaagtgagacctcatccccacaaaaagttgtttagaaaattagctgggcgtggtgatgcatgcctgtggtcccagctacatgggaggctgaggcagaaggatcacttgagcccaaggaggttgaggctacagtgagctgtaatcatgccactgcactccagccttggggacagagtgagaccctgcctcaatcaatcaatcaatcaataacaaaaacttaaatagctattaacctcagtcttctttccttcatataaattctattctaagaccaaatagaaaaataaatgtaactaactttgcagagctattgacattgagagacctaacaacagactgcaatggggattgtaaaataacttttcagccttgcacttgctcatatatgttttgagaaaaatgtaagttaggtataacttattgttttaactattataaggcagtgtttacataaattaatcatctctttcttggaaaacattgagacaaatttattttcagttttacttaaacatgaaacctgtattttagttgctttttgttttgtccagaaatttccagattttgtcttcattttttttcctggttaaaatctaaaccatagtgaagatagtatttatgtttacattttatctgtgaatgtggctaagcagagaagctacatggctttggtctacatattttttgaccttgtatttggttctgtagttgcagacttgtgaaggcttacatcatcatggagactttagtaaggaaggaaccaaaaggtttttggtttggggatgcaaactggaggttatgttacaagtcttcaatgcattttctgtgttcctggcagcagtgttgcctttttttttcttttccttttttttttttaaagaccaggtagggtagtgttattgaagggtaattgaagagtggtagagagtaagaggttttgaaggaggcaggtttgctgttatcacaaaataatttgggggaaacctttcgtggctgtgctgcaagaattctttatgtggctatcctctccatagttttctgaccagaattgcaagggcaaaaatagaacttctagctctatttatttgtatcctttgaaatcagaacttatccttagaaccagtcagttaaataatgcggactatgcctataatcccagcactttaggaggctgaggcaggcagatcacgaggtcaggagttcgaggccagcctggccaatgtggtgaaactccgtctctactaaaaatacaaaaattagccgggcgtggtggtgcacgcccatgcctgtagtcccagctactcgggaggctgaggcagaagaatcgcttgaacccaggaggcggaggttgcagtgagccgagatactgccactacacttcagtctgggtgacagagcgagactccatctcaaaaaaacaaaacaaaataaaataataatgtgggctattcagaagaaaaagtcagtgacagagagaccagaacccattggatcaagagacctgcagggattataactctttactctgtgagcagcggtgtttcgtgccctgtctctgcctgtgtgtttttactaagaattccagaaatcctgtaatttgtaaatgggaaacagaggaaccagattgttttatagctgataagaaacagtctgttttagaaacatctgtttggaaagtattactcatgtattcacaaagtcatatttataacactagtcttctttgactgtattcaacaaaaggcagtttcaccattaatttcatagtaagcttttttaaaggattctagatctaaattgcctaagaatgttaaccacattcttgttttaaactctctaatttaataaatgtaattattttatagtcttttatagacttacattttcttcatactaaaggtaatgataatatagtcatttgccagtactttaaggtattcaggcatttgagacaagaaagctgtcttgtagaatagtccaattgctttcttaaacagtactggtttcatttagacagtttctaagccagcaaaggtgtcaattttaatgccaacttgacagtttaacagttagtgtttgtaagcagtttagcctgaattatcccatactgctgtagaggagaattgttagtaacatcaaaggtcagaatgcttcaggtgactaataagaatggaaagagactgagtaggttttttgtttcttttccctgtctttgagtaactttgaatgactaaaattagtatgaaactaggttttggacccccttctcacctcacccggatgtaatgccaccaatttcaaataactaaaatgtgaccaattactttgcttcaagttctatacaaatatctctgaaatctgtaagccatatttcagctattctggtttttataatacattctaccctaaattaaccaaaggactttttattcagtgtattccatgtttcagcataaggaaagtttgtgcctgatatggcaggagaaagaacactatggtaatttcattgttacttcaggtctctttcaatctgaagaactgggttgtctggagaattgaacatagccaagcaatattatcaattagtaatgtcatcttaaaaatgttcacttttactaagttttattcagaggatctatgtattattagaaaaatgaagtatttctgacatggaacaaagaaagtggaaactggtacttaatgggggaagcaaaattagctgggactaaaacggacatgttttgttttgtgaattctacctaaatgtctctctatccacagagaaactagtattacttgaagatgtgaaagttcctgtggtagccataccttgaagcacagtgtttgtacataagtaaatatcttgattctaaattaaatccagatttaactaatatatattattttatatctttgttgtattaaaatgtttaaaaacactaaaaataaaacatttgaaagttggattacagtttcttattgaaatgtctttgcattattaatggagctggtcagttttttatataatgaattttagtttttgcaaatgattggccaggtgtggtggctcacgcctgtaatcctagctctttgggaggccaaggcaggctgatcgcttgagcctaggaatttgagaccagcctgggcaacatggtgaaaccccgtctctacaaaaaatacaaaaattagccaagtgtggtggtgcgtgtctgtagtcccagctacttgggagactgaggcaggaggatcgcttgagcctgggaagtcgaggctgcagtgagccgagatgatgccactgcactccagcctgggtgacaaagtgagaccctgtctccaaaaaaacaagcaaatgattgagctctgcaactttaaatctgtggaacttagtccagaactgtggagtagttagaatgctaagcattgtcacaggtacaggaccgtatcagcttgatccgcaactgaacttgtcttcttgatcactgctaatatgtagcctctgtagcgctggcccagctagtctttttgagaactctgggaaaaaaatagtccagaagagacctcaaggagcttggtggagtagaaaatgcactgggtttaggctctgatgacctgggtatgagttgtgtttctgacactgattaagtttttcttcaaacctccacttaaccttatttaagtggaaaaaagtgcctaccacataggttgtattaagggccaatttatgaaagtactgtagccttgctcacggagatgttaagatgagggtgctgagttaagagagtgcctcagaggagctcagttgccaccttcagctggaactttgaagatgcacaaatgatagttttaaggcttctggtagagtagcatgacatttaaatgccgtatattctcagttcacggggctcccatgagagccagaaatacagaaccaccaagacctgctcatattccagctttaggagccctgggtcacattatgaagtgaatgtctgtacctgatgggtttttttgtttttgttttgttttgagacggagttttgcttttgttgcccaggctggagtgcagtggcatgatctcggttcaccgcagtctccacctcccaggttcaagcgattcttccgcctcagcctcccaagtagctgggattacaggcatgcgccaccacacccagctaattttgtatttttggtagagatggggtttctccacgttggtcaggcgggtctcaaactcccaacctcaggtgatctgcctgcctcagcctcccaaagtgttaggattacaggcatgagccactgcgcccagcctacaaacatatttttttaattttaaaggtttacattattttactccaattgtagcatatacatatatatgtacatatacatgtggtttcataccttgcttatttcacttaacatgttccagtgccttccagccaaggatgaaggacacaccttagttgaataagttgggtttattgtttgttataatggagaatacacaccatggggagttgtggggcgtctcagtgggaaggtgttggaaaggataggatgtgggcttgagttatgcagcttctggggaaggtttaactgaagtgggaatctgttctgattagatgggggtatttctattattgaatatcttaatatatcttaacaaggcaggaggagctgggtgtggtggctcacgcctgtaatcccagcactttaggaggctgaggtgggcggatcatgaggtcaggagatcgagaccagcctggccaacatggtgaaaccccgtctctactaaaaatacaaaaattagctgggcgtggtggtgcacacctatagacccagctactcgggaggctgaggcaggagaattgcttaatccacaccattgccaaagcaatatattacagaatttttttatgtttgccaattttatagattttattttatttatttagttttttgagacagagtttcgctcttgttgcccaggctggatgcaatggtgctgtctcagctcactgcaacctctgcctcacgggttaaagtgattttcctgcttcagcctcccaagtagctgagattataggcacctgccaccatgccctgctaatttttgtatttttagtagagacagggtttcactgtgctggccaggctggtctcaaactcctgacctcaggtgatccacccgcctcagcctcccaaagtgctgggattacaggcgtgagctactgcgcctggcctaaatttatagattttaaaatgatatcttaattccctagctacaaaagtaatcttcaaaagtgtttcttcttttttttttttttctgagacggagtcttgctctgtcgcccaggctggagtgcagtggcgcgatcttggctcactgcaacctccgcctcccgggttcacgccattctcctgcctcagcctcccaagcagctgggaccacaggcgcccgccaccacgcccggctaattttttgtatttttagtagagatggttttcaccgtgctagctaggatggtctcgatctcctgacgtcgtgacccgcccgccttggcctcccaaagtgttgggatttcaggcgtgagccaccgtgcccggcccaaaagtgtttttaagatacagggcgcggtggctcacgcctgtaatcctagcactttgggaggcgggcggattgcctgagctcaggagtttgagaccagcctgagcaacacggtgaaaccccgtcgctactaaaataaaaaaattagctggggtggcagcgtgcgcctgtagtcccagctactcgggaggctgaggcaggagaattgcttgaacccgggaggtggaggttgcagtgagccgagatcgcgccactgtactccagcctgggtgacagagcgagactccgtctcaaaaaaaaaaaaaaaaagtgtttttaaaatagtaaaatgataaggaaattggtggagtggtgacaacttggtatacaaaactttctagaagactaaactgccaactatgacttattaaagaccatatgactgtaagatgttgagggggaaaagaaatgattttccaattatactttttaatctttttttgtgtgtgtggagatgggggtctcactatgttggccatgctgatcttgaactcttggcctcaagcgatcctcccaccttggccttccaaaatgctaggattataggcataagccactgtgcccagccaggaagatgatttagcagattgaggagtgtttctcctgtttaatttttaacatagtctttacattggccatctcttgtcattcaaaagtagcatttttttctgatcattgtcttccttgagcacctgtaggaggctaagtcctgtctggcccaagggaaaggccagaggactcagttgctctctgttttaaagttctgtaaagagtcatgttgatactggtctgcctgcagtagctatttttggccctaccatcacctggaagaccttccaaagacccagctttacctgtggagggcttcattatagatgtgtgagatctgagctatggaagatgttttgaaagaatatttattaaacatttattgggtacctattctatgccaggcactgtttaagtgctagtggttcagtggtaaacaaaacaaagccccggccttcaggaatcttactttctagacaataaacacatatatgagagagagagaaaaaaaagcattcctggcagttgtcaactagtaattgacctgggtacagtggcattctcctactgaacataagcaattctatagaatatcatcatcagatgaggaccctgcctggctgtaatggatcctcttcacttgtaatcatgcctgaacagcaataaagacactgtgcagccataaaaatagccatacacgccgctcctgattaacatgggcaactattactttgttccttcataagaattaagattccgaattgccccaggtttctgaaagcactcaatccagagcagcaccctacttggttgctttcctaaaccttccttaagaacacctaacacaagcccaaatcctgtaccagccccacctaacactctcttactgagattcccctcccttctccaggtgtttagtctttctcgctgcaggaagtttaattaaaaacctacctttggctgggtgcagtggctcacacctataatcccagcactttgggaggccgaggtgggtggatcatttgaggtcaggagttcaaaaccatccttgccaacgtggtgaaaccccgactcttactaagaatacaaaaattagtcgagcatgatagtgcacacctgtaatcctagctacttgggaggctgaggcaagagaatcacttgaacctgagagacaggttgcagtgagccaagatcatgcactccactccagcctggaggacagagtgaaagtctgtctcaaaaaaaaaaacaaaaacaaaacctaacttagctttactaaggtgtgctcctggtgatatttagctagcagaaattgccttcaggcagcccaaacagcta

SEQ ID NO: 1316 - DNA, 31642 bp, Homo sapiens
atactgaaaactcagccatgggcttcagaacaagacccagctgtctcaggctcttggctctggcaagcaggatgtctcactgtcacaaacccagaattttcaccaaggagaaggtgaccaggggaacaggccggagagcggcctccagtgttgatgactgtttaagagccaaaatattccagtaattgtgtgacatggggatccctggcccaaataacgctgcaaccacaggaataggctcactgccaggaaaccaggaaaccgatatttggagcaatagacagactactcttgtacagtggaaaagtccttgcagaagggaggaagatggaaggggaaagcccaaaagcgttcctctcccttcctgcccctaaaatatagccctgagctggacatgagtgcagcctcaggagaacttgacgaagaaatgttccatacaggaaattgcctggcgaggccattttgagttagttataccagctctgggcttcactcaggagaagctgtccagtaaatgcctgagggcacccaaggcctctgggattcaggggaatgcacgctctcctttgtaccccttgattttgttggcccaaaagcaagcctgctagctcaaagagtgattcatttccccctgtgccttctgggaagttggattctgtttttcaacaaccaggcaagaaatgaagtaaggcccaggctgactcgccccctcttctgtccctacagaggtacatgggtgagtggattccagggtggaagacaaacctgaaagaaggccaaggtctagggttactatggcaacagcatggcagggcgtggtgatgttgaatgaccgcggccccgaagtgatgaaggagagagaaaggaagcaggtcttcctcaattcagccttgagagtgaagcctccttattctgattaatctcaaccctccactactcaaaaatagttgatggctccctattgcctacaaaataaggttcaaaggcctctatttatagtcaaggccctccctgatctggtcaccccctgcctgttctgcctcagttcctcctcttgctctcatgtacccagtggctgcagtcacagaaagtcttgttttcccaggtttcctatagcgtcctacctctaagaatctgcactctctcaagatctcacagataccactcacctccctaaggcagactgtcatcccaccatcaaacgtggttgacccgataagaatgtttgcccccacccccaccatccctattagataggacatttcaaaggtggggacctgttgaccctgctgaccctgcattccttcagctcacctggccccagtgccagctggatatgagagaggcccaactgatatttgttgcatgaatgaatgaataaatgaatgaatgaatagaaaaggttaagccagaagcaaggtcaccgagctatttgttctgcatcaccaccccttgacatggccctggaattgattgggcaaatatttagttcagctcctcagatttcaaaatgcccttttggagcattaaaaaaaaaaaaaattaaaaagacttcatgcaggagatcttgcctctttagagcagtgcctgagtccacttttcccgttgctgctcccctgtggggtctctcatttgtgtggcccttgttacaccgctagagaggtaggcctctcaacagcagcaatgagtgctcggaggaaccgtgcctgtttgtgagttcagaagttatcttccagcaggaaaacaaagtctttctgtactttgcaactaggggaaaaggcagaggaagccaatgtgagtggcagtgatgtagcctagtggaaggtgacaagtttgcacgactctagtaaattggtgtgtagagaaatgcagcgtgggtttattcggtttttcattctttcattcaacatctagttacagagtggggtttggccatgtttgagataggagaaaacaaactttttttcaagttctcaacactacagttcacctctggtcaccaaaatgtgtgtgggatttctccaaccaccaaattgtccagcagacactaactgggtgtcctgcagttcaattcaattcaattccaacactatctacctggagataatgttggatcccatcagttaagagctctgtcgcacaagactgcccctacttcagatgccagttgcaagtagtaggctgtcacctatactttatgaccaactggctataaagtgaggttcccacaactccctcctcaggttcagttcattagctaggagggctcacagaactcagggaaacacttacgcttactggtctattttattaataaaggatacagatgaacagccagataaaagagagtcagagggccaggtatagggtactgggcgcagagcttccatgtcctccctcagtgtaccaccctccagaagcctccgtctttcagctgccccaaagtgcccaaaccctgtcctttttggggtttttatggaggtttcattacacaggcatgattgattacatcattggccactggtgaccaactcaacctgcagcctctctcccatctcaggaggtcatgaggaggggggtgagctgaaagctccaaccctctaattccatggttggtttccctggtaaccagattctttatgagcctacccaggagcccaccaagacttgcctcgctagaaaaaagatgttcctgtcacccaagaaactgcaagggatccaggagctcttcatcagatgctcttgtcactctggaaattactaagctctcgggaatcaggtcaaagaccaaatattaaacaaacgattctcttagtacccctatctacaaggatcctagaggcactgtctcaggtactcgagccagagactaaatgtatatttcttattattaatatgtcacagtttcacaggctgctagccaggaagccagagggacctccccagtgtaaaatttggattcagacaaggctgcagtctcagcttcttcactaacaatgcactgtggggcaatcgctttacctgtttgggtcttaatttcctcacctgtacatggcagtgtcctctgggcacagagacctactgcagctgtggcagtggaaatgggaggatggacatgggatccgctgaagacacagacctgggagcccctggcttctgactccatggagtgggtgaagggcacaccagtctgcttcatccctgactgcctgggagtgggcccttatcgaagaagaggcagaactaatatgaacagctcctgtgctctgagcacctgcaatgagcaaggcacggtgccgagtgcttgccaggaggtatgaagaggccgcaagcatccaagtatagaacctggactttggagccaggatgcttaaatctgaatctgaaatccagcaattactgagtgtatttgtttgctagtgctgctctaaggaaggaccataaatgatgtggtttaaccaacagaaatacattgtctctcagttctggaggccaggaatctaagatcagtgaggaagaatctattccacacctctcccccagcttcggaaggttttctggcaatcttgaatgtcccttaaatgtaggagcatcacctcaatctctgcctttctcctcctgtggtgttctttctgcgtgactgctggtggccaaattcctcctttgtgaaagaacactagtaatatcggagtaggggcccactctactctgttatgacctcattttaactaattacgtctgcaaggaccctatttctaaataaggtcatatcctggggtgctccaggtatgggcttcaacacgtgaatttggagggttgggggcaattcaacccataacaccgggtgagggacttgggtggtctctctgtgcctcagttccctcacctatggaatggagatgacaatacctaactcataaacctatcgtgggtgtttgctgagttcctgtacgtaaagcacttaagctagtggttcagcattagtgccttacaaatgttaactgctgttatctcattcatcttttgtaacaactgtgtgctgtgcaacaagggtgacaactggtatgcctgccagagctgggcaggtcacacaaacagacgaagtgggctgccagtgatggggcccaggcaggtgagacagtaagagcccccatttaaaggcattctgctcaacattgttacataataatctatggcatgaaactcacctatggaggcgagagctccttgttgctcttgatgtcaatggaaaaaattgaccatgacctacctggtccttaggtggggttaacagctattctgaaagaagaatgctgatttgacaagaactgggcgtgaagccaaccatgtggtctagaaaggacacaattgcctttaagccaaggcctaagcctatcaagactgagttaatgaggctgccccatcaagccagcggaggtcagccctcaccagccctggctggctctctggctgcagagttgctgagcagggctggagaacagaccaaatggggccagccaagttcgcacatcctcagagccacccgctcaagtgtttagctctcctggggtgattgacttcagtgggagcgtggctctgccatgattcagacttctggcctccagaactgtgagagagtgaattcctattgtttcaagccacccagtttgtggtgattaattatggcagccaactaacattcctcttttcctccaatttcataagaacaggtgttgctcttcttgacactcagctgtgtgttctcttggcctcctgctccctgggggagtctccttccattaataaccacctttaacctccctttcagcttcttcccccaaacctgggaagtccctccttccaagccacagctccctctgccccacctccttcccagccttctcatcaagaagcaatctgccttgaccatctctttgacttctcagcctgctggccctgggctcctgctcccaccttcccacccagatcaccctggtggattccatggaccagtgaccatcctcatctacttgaatgttctgctgcatctgacactgacagtgatatcccttgtcctcccttgtttactgccctggtcctcctccttcccagccatcatcacctttgtgagctctctccctctctgctcaggcttatgccgagggtctcagcgttctatgcttcatcctcttctcttgtcctctccttgccccaggacacccctgatcccatgtgcttccttcattttatttcctgtctctgttcttgcctccaaatctctctttagacccattcacctgtgtcatctctgccagcaggcaccacaggcccttcaggctcactaggtccaaaactgaactcatcatcctccatacaggcttccaaaacctacccctcagctcacaccaggtccattctccttccttaatgtgtctcctcctctccagcctcacccccgcttccttggcccacaccaccatcatctctcgcttggattatcacagcagtgtcacttggtcctgtcttgatctccaggtgaccatacccgtgacagcccaagataatttatccctcctttacttacagaatgaagttcaaccctggttcccaacccagcaggacttccaagccctccatctggccctgatctggcttctctctgtcctcccttcctcctctctgatgggctcccggtgccccaccacccccttagcctgtactgctatcactcctgtggttctctcagcccaaaatgcagcctcccactgctgtgctgtaagctattctgtctgttcactcctctccacccagccagggctgataaaaacctagacaaggttcaaaaacccagatccaaggtcaccaccttcacaaagcttttcctattccattcctctctccaaccacgggagaatggaccattcctccctgtgtgtctttattgtggagacatgtgtcagagcatcgactctctatctttagttcatctattgagatattgatctctcttcttgaggccaggggtattttctgggacatggttagatctcaataaacattgatactggagggatgaaatgaaggaaggatggatagaaggctataaggatgggtggatggataaatggatggatggatggatggatggatggatggatggatagatggatggatggaaaaatggatagatggatgggtggatggatgaatggatggatggatggatggatggatggatgaatggatgaatatatgggtggatggatggaaggaaggaaggaaggaaggaaggaaggaaggaaggaaggaaggatggtagaagaaaggtagtaccagtatgctttagctcatgcaggcaaacagatgatgggcagagggaagcatggtggctgattacaggaggatcatagcagatgtttaaggcaagattgacagccccacaaagactgagaagagaagataagaaaaatgggaaagttattaagacacaagacctagatcaggagctagaagctggatcccagaacaaggcaagagcctaatgactcgagtagccaactcatcccagtttgccaaggtctttgccagttttagcactgaatatcccacaccatcggaaattactcagtcccagcaaattggaatggttggtcaccctactagtaattaagaccagtgccccacttcagagcagaagcatcagccaggccctgagtgacatcttgtaggctcttgaactggtctcactcaatccccatgaggcccaataccatggaacagagggcagggaggctgagggccaagcagaggagcacctgtgctcagcagggcaaggcatcacaggggccaacattggtttccctgcccttctcccagaaaccacctccccactttgatcctttcccatgccctgctaggctctaggacaccaaattctcatattctagccactggccctccctaggcagtcaccctgggtgttatggactgaattgcttctcccgcaaattcttatgttgaagttttagccctcagtgtgactgtagagattgggcttttagggaggtaattaaagttaaataaggttataagggtggcactctaatctgataagattggtgcccttttaagaagaggaagagtaatcagagagctcgctctcttcctctgcccaatccctctcttggggggtgtgtgtgtgtgtatgtgtgtgtgtgtgtgtgtgtgtccagtgtgggctcacagggaagaggtcatgggcgaacagagtgaaggcaaccatctataagtgccagagagccctcaccagagaccaaccctgacggcaccttgaccttggatttccagcgtccagaactgtaagaaaatacatttctattgtttaagacatccagtgtgtgtttaagccaggccagtgtgaggtattttgttacagcagccagagaagactgatacactggggtgccatgcccccgagactccttccaaatctctcctttcaaaacgcaccaccctcagtcctgattccttcagagctctttctgcatggcagtgggagtcatgagttacctcagactttcccccaaattctcaagacattccttaagatgtaagcttgggaaacggcatgtgatgtctttccctcgtgggtggtcagagcacagacagcacacacaggctggagacggcccacaggaaaggtgggctaaccacctttcccaaagtagtttcatctggaacccatttgggcggtgttacactagtttctgatggctgctctaagaagttatcacaaacagtggctcagacaacacaaaattcttctttcatggttgaagaggccagaggcctcactgggctagaatgaggatattggcagggctccactctttctggaggctctaggggaggatccattcctttccctctccagcttctagaagcttcctcactccttggcacctggctccgacatcacattgacttttcccttcctgcttctaccatcacatcaccttcttctgactccaatctcctgcctctttcttgcaaggatccttgtgattgtaattaggacccagctggataatccatgacaatctcttcaagatccttaacttaatcacatctgcaaagtcccttttgtcatagaacgataacattcacaggttctgggtattaggacacggataacttcggggttccattactcacccataactggtatgcagtgctgatttccatcctgtaggtacggtttagggatctctaggtcaatgagataatggactcttgctcatgttacatggcataatgggaagaaagccaaacctagaaaaagagggactcaggttcccttgttagagcctcttcttactaactgtgggattaggggctgattccctgacctgctgtgttctgtcttctctccaattcaatgggaatgaactgtgagggcactgagcaaaaactaaggtctcaatacctagtagtagtgggacttgcctctggatacccagtagtgatcctgccgcctgtttctggatatcctacagtagcaatcccacctgtttctggatatcctacagtagtgatcctgcctgtttctggatatcctacagtagcaatcccgcctgtttctggatatcctacagtagtgatcctgcctgcttctggatacccagaagtgatcatgcctggttctagatacccagtagtgattgtgtttcctctagatacccagtaggtattgtgcttgcttctagagatgtagtagtagctggacttagctctagatacccagtgctcatctctagactgggctgagatcagtgtctcccttgaagggttattgtaaggatgaaaaaagataatgcgtttaaagcacttggtgtagtaggtggtctttttaaaagtgtgaataaatactagttcttattatttctgtggatatccaacagccacataattgggccccaaagccatgaagaaggaagaggaaatgtcttaaaggttgtcgatggacagtgtttgctgaacatcaaaatcactttccaggtattacctctgatttgctctaccaactccacaccccacctgcagccacataaccttccatgatcacggccatgcacaacacaccatgtcccccaggcaaggggaccttagaaacataaccaggcttgagacagcactctgcaccggtgtcttggaaatgctcttaagagtgtatggctgagttagggaaccaggatttcaaagtagaaagggagaatctacccaagcccatagaaatcctgaatccactcctttctcagcaacaagcactggcctgggagtcagccacttatgcaccaaccccactctgcccctaattaaatgcatgactttgaaaattcccctcattcttctgagccccaattcagtgattggtgcaatcacaggcttggctacagtgacccattcattgcaggcatggtgagtctctcaatccctctcatttccactagaatctaactgttgggatctatgacccagtcagcatagcaggcctgtggggagctctcaggttcaagcatatgccccccctaatctacaagaaattagctgcagaaaaccaaggaatagaacctggaaaaagagagggtttgctagagctgtccctttccctgtctctggaatgccaacaatagggaggctctttggtcttgtctctcaggagtgcccatgccattccaggaaaatgatggcccagctggtggtgtaaggcttggggggcagcgagtgggcatcgtggtgaaagcctcgggatcagggagctgcgtctgcaggcaggcctgctggccggaaacctgccaggaaaggaaggggctgtcccggggcggggccagggaggggtggagacagggccggctgtggtcagtgacaaatgctggctgcaatccagccagccctctgccctttctgagcccgagggactgccacctccactgtgtgcacactcagctacgggacacagtaagtaccgatgccgcaaagggaggtccccagggcttgagggcatgtgaggcgaggagaggatggactctagagttttggggtttggggtctgcaaagctctgaaggagtctcatctctgcagtttcaggtatccaaggcagcagaggtgagtgggtcccccgagctctgtgaccttatgctccacactaactctggcagagcctccgtttcctcataggtaagatggaaataattacaccctctggatggtgtgactgaagattaaatacagcgggtgctctcactcagcacatctggccatgtctgcagacacatttggttgccacaactggaaggggggtgggggttagtgacatctagaggccagcgatgctgctgatgatcccacaatgcccaggacaagatcacaaagcatcatcctgttcaaaaggtcaacaggatcaaggttgagagaccctgaaataaggccatggggacaaaatgtcggctggataggaggtgctcagtaagtggcagcttctgttgttttctgtgcctggagtcttgggcctttagaaatcaggaacaatgatccaatattatcggcttccgtgagataagggcatcttgcctggaggctgccacccaggccggtcatggcagctgctcatgaaggacagtaacaatttggcagtttgttaaatgaacaaaatgtagaaataaagtaagcagaatttttagtttttctgaaggtagggcttttggccagatatgcagcaataaaagagcaaactgcttccttgggccagtgtccttgctcatagatcaggaaaccgaagcatgaagaatacaggcggcagatgcctgaaggtaacggacgtgttcatggtgctgacggtgatgataagtgacagatgtagactcatctccaaacttgtcaggttatagacattaaatatgtgcaactttatgaatagcagtcatgtctcaatcaagtggttttaataaagaaataataggaagccagagctgagagacagggagggagttgttcaaggtcacctggcaagtgagctccggggcggggagagctcagctctgggtggccagcctggctttttccactgctcagtgtccagcttgcagtctaatgtctctgaattacagagaaggagactggtcagttcattcattcattcattctacaaaggtttatggagcatctctcctgactgcaagctcttgaaggtgagagcagcacaaatgagggtcccatggagagagaggccggaatgaaaaatgtcaatgacaaatgcatatataaaggcacatgtgtaattgaaagagctttgagagaaagagtcaagggactgttccagagaatagccatggaaggggaaaaggtccagtgtgataaggtattgcaaagaagtgacatttaagcaaaagcctgcagcctatgcagaagttggcctcagtgagaaaggttgggggagggttccagtagagagggaaggtatgcaaaggcccagagttaggacagaacttgctgtgtttgagaaactgggaaaagaagagtgagcctgggggtatcacgtgatccagggcagagcaggtccaggccaggtgcagccaggtcacagcagccctagtgggttagagcacaaatcaaagtttagcatttatctgaaacacaggagttggccatgagtttcttaggcgaggaagcgctgtgaccatatttatgattgaaggagattcttttatatgctgtatatagaaagcctttcagggcaaagaaaggaagctactggggtagccctgggggagatgaagggagcttccactgggggcagtaagaaagccagggaaaggcggcagctttaagacctgttttggagatagaacggacaagctttgctgatgggctggagtggaacaggaagtcaagattacttcttctgggaagttctgttcctgggtctttaggatctagaggaagctgtgactttgtctctcatctctgcctgggctccaagcctcacatccctttttgtaattagaagatattggacagaccgtcctcactaacacaattcccacagctgagtccagggtagaactgggcaggacttcactgcccaacacgggaaatatcagtcagcagatttgggtttcggggatggtggtgggccagcgggaagactgaccagggcctacccatcacatccccaccacctcccacctcaattcaccttggcctgagatgacaggtgaacatgactgatcctctctcttccctctgcagaaacactaaagccagggaccaggagaggggcagcccaaccaagctttcaaagcactcagtagaggctggtctgggggatgggaggctcccagggcttcacctgtctctgtcaaagccatgtatttccaccagaggcccaagagtgcgatggcaaaccctggatttgaaactaagaaacgtaaaacaagcactgaggactccactgcctcttgagtgacctctctgaccctctgtttcttctgcactgttaggataatgatactaactccatgttgttgtagagaagtataaatgagctaatacaggtgaaccgcctggggataccaggaggtgaggtcgaggaggaacgaggtatcactcctcagagccactcagagacaggctgtgcacgagtcagaggaacctggattttaattccggttccatcactcagtagctgaaacaagctattccacttcacttagcctcagtctattcaatctgtaaaatagagtgagtttacttttggaaaactctgtaaaatagagagcttacttttggtgaaggttaaacatagtaatatttatggagtgtctagtatgtctttaataattagtggttttactgaaaagtagagagagttggcccagagggagcaagatttctgggtctcaaacatgtagcccaggagagcctaagtgaacctggggccctctccaaacagatcctgggggagactcagtgcacacccggagaagcagctcctccccatcggatctctagtgcttggcagggggcggggtcttgagggggtgtccacaacacatggcagactgcagatgaagaaactgaggcccagagggggtgaggcttgcccagggtgacctagtagctgaatagatgggagaatggaggccagggcctcactgagactctctggtcagctgcccctgggctgtatccaataaggaaactcccctgcttctgaagctgttctcgaaattatcagctcagtgtgaccctgtggggggttgagccacattgtttctttagaagcatctccatacatggctggttccaacccttggcaggagggaccatattgtgctgtaaaatagactcatttagagaagccggagattaaagcacccacctatgtccttcaaagctctccaggcaagtgccatggtgggaacaggtagggagtgtcagtggggggaagcccagactctgctcactcattatctgcagattagggctattgttggtggctactaagtcagggatttcaaaatcaggaagatgcagccaggaaaagaggaggcaggactctgcagaggaggcaggactctgcagagtcagagtgataaccgagtctgagtccaagctttgccagtgttagcaagcgactccatctctctgaacctcggattacccatctgtaaaatagagctagcagcaagatgtacctttttgggtggtgcagggctgaaggagttggcacagtgcctgaaagagggtgcgggcaatgcgcccaactgctgtggctgctgggtttggtgccaggttcgattctgcaggcagaaacttctacatgaggctccttctcggaaggagctcaggacacaatttggaggctgggctggcaagggtgacctgctggagctattcaacttcacttaaagacaggcctgcagtccaagcctgcccaattcctgagaccattctctctccactgctgagccccacggccactctgcaagggatttcccacccacctgtttggggccctttggagtttggttttaattgggtcacgggatgctgtgacaggctgcccctgcctggtggggatctggggtcactgatgacattgtgcccatggagagagcccagcagaaagggattccctccaaggcgacacacagggcaaagctcacatcagaagccaggcaggccctctgcacctggtaattagccagcctgggtgctgtcaggctcacacgtgtgtgtgtgtgtgtgtgtgtgtgtgtgtgtgtgtgtgtaaagcatgtaccctatggtacagttgagaatatggaggcctcagatggggcttttgccagaaactgccatgcctactgctcacacttccatagcacgtgcccccaagcaccccatggtgtaggtgctgttattatcactatcttacagttatggagcagtggctcaaggtgtaactgacttgcccaaaatcacactacaaggacacagcagggctgagatttgaacccaggcagtggcttcagagcctgagctgtttcctactgcagagggaggaggcaagacttctacccgtagccagatggggaggcatgggcacaggaacggctcttgggtgaagtggagggaggaagaggaggactgaaggccaaggccacgtcaggagtgatgggagaccccacaaaggcctccctgagaagagctagagacaaagatgagtgcctcctcatctggaagatgaaaagatgtctttgcctgcatgggctgctgtcacaaagtcccaggggctagggggcttcaacaacagaaatttctttctttacaactctggaagctggaagtctgagattaaggcaccagcaggatttgttccttccaaggcccctctccttggctcacaggtggctgccttctccctgtcttcacctggtcttccctctgtgcatgtctctatcctgatctcctctttttaatttttgtgtaaggacgtagtcatattgggttggggcccactctagtgacctcattctaactcagtcccctctttaaaagccctatctccagatatagtcacattctggggtattgaaggtaaggacttcagcatatgcattttgggggcacaattcagccagaacaggaggacggtggggatgtccacatgaagaggttcaggcagaattcctttaggaggggaagatgtctctctgtgggacaagggtggcatggagcagcccctgggggaaggagaaggggacagtttgcatactggtattctgcctaccccagggtggacactcactcagcgtttgctgaatgaacagggcaaggccagcagtgctgatggtcccaggcatgtagctggtctgagttcatagaaggaccacagcgccctgccatgtgccaaaccaggacaccagagtgaaggccagaagctcacatggaagcagcttagttccctggtaacctcgagatgctgatgagacagagcagagcagagggaaccctctccctccatatcccatcctccaaaatgtgtcccttgatgtggatgggtagacaggattcctgccctggcagccagacccctgccttgggtctgcacctcctctccctccttcctctccccgtcatccctaaatcttgtcctcgagccactgccaccctgtgtaaaccctcatgcccagtcttgcgggtgccatcccttctctttgaagctgaatggaccaaacatacccattgagtgttgggtggggacatctctggaaagtcagcacctggaccagctccacccctctctgaggacaccttctttccctttcagaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagagcatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccctaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaaggtaaggcccttgggcccaaacctgcactttctttggcttttctgctgcttttatctaaagaatacccaattccctcacatacataaaagacggggagtacgttaagttcttttgggtgcctgttgagaaaaattaagtaaacaagcagccagagaaggtaagatgaatgccttcttgctgtggatgggattagtgaggctgagatgctgtttcctccacggaggaagagctggttgctgtcttcgggcccctggggacatctgaagccccagctttctacaggctctgaagtatgaacccattgtggccaccatggcaaagacaccaacaccttagccactcagggcaggacacagaccccagaagggcttaaagggcatttcccagtcccccgtatccctcagatcttggcccctctgccctcatagaggccaagactccctcagacaaatgcttgttcctctgaaatgcctcctcctgactcctcagcaagagctgacctctgcttatctccccgacactccttgtaagcattcctgctcgcctctgcagctcctgccagttgctgaccctggggaaagcaagagtggatagagaggagaagagaggagaggagagggtgggaagggttgcgaaggaaggtaaattgttaacacctccccttcctatggtcacagatcatgagtatctttggccatttgggtggctataacaaaataccataaactgggtggcttagcaacaacaaacatatatttctcatagttctggaggctgagaagtccaggatcaaggcactggcagatgcagtgcccattccttggttcatagagagtgccttcttagtatatccttgctggaaggaggaaggcagctctctgtggtctcttttgtaaggacaccgatcctgttcatgacagctccacccccatgacctaatcaactcccaaaggccccctgtcctaataccaccaccttgggggttaggtttcaacatatgaacaatgtggggacacaaacattgagaccacagcagtgagtgtcgaacttggactctgagatttcctatcccctggtgcagggcagtccccattacaccagattgctgagggcagctgggaaataagctaaggacggtattgactggggtcttccttcgataacgattaagaagttggaaacaggccaggcatggtggctcacgcctataatcccaacattttaggaggccgagatgggcagatcacctgaggtcaggagttcgagatcagcctggccaacatagtgaaaccccgtctctactaaaaaatacagaaattagccaggcatggtggtgggcgcctgtaattccagctacttgggaggctgaggcaggagaatcacttgaacctgggaggtgggggctgtagtgagccaaaattgcgccactgcactccagcatgggtcacagagcgagactccatctcaaaaagaagaaaaaaagaaaaaaaagaaaaaaagaaataaaataaaataaaaagaagttggaaacaatcacttgtagcgttttgttcagaagttcccataggaaggtcagagaagggtcattgaagacttcccaatgggaaaaaccattcatttccaggatccatactaacttctttctaaaatttaaatcaaaatattggaatgaaagtgcaaacagagaagttcacccagatatcaggtagcattcacagccagccacatttttcaccctcttcacttggagatttggtcttgagtaaaacgttagagaatcagagaacatcaggggtccagggcctctgaagatgtgaaaaccaacctccttgttttgcaaatgtggaaggaaaagtcccacgaaaagtccaagaatgtgcccaatgttataaagagacttgccttcatattcaagaggttcaacagtcactgctctggggctgccataaagatggtctccgctggctatctttactgtcttcactccttttatttgcagctgagaatttctaattctgacacaaaattctttttcatttttcccttttttcatctttagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggtactttcagactaccccagggccagcctaaacccacacagccccagggagacacacacgccctaccagggccacacagcactggtgggaaggactcacccagccaaggagctgcctccaggcccagaggcatcctgtgacatccaagtcctgggggcctagcccagttggagggacaagagctggaaactgggttccttagggtggtgccagagtgggcagagacctctgggcagcccacgtccaagtccagagcaaggggaggctcatcctagaaaagaggccagaggagccataaccaccattgttccttgggttaaggagtccttttttaaaaccatcaaaactaagaatccagtgcattatgaatccaaggggtgaggctcagtgtgccaatgccccagaacagtctaagaaagctccttttccctttccaggcagctcgagctttaccttcccaaattctccattgagggctcctatcagctggagaaagtcctccccagtctggggatcagtaacgtcttcacctcccatgctgatctgtccggcatcagcaaccactcaaatatccaggtgtctgaggtgggttcagaagctcctatgcatctgcttcccaaggtctattctgttctattctttctattctactctaccccatttcattccattccattccactcaactccactccactccactccactccagttcactctattcaattccactccactccactccagttcactttattcaattccactccactccactccagttcactctattcagttccactccactccactccactccagttcactctattccattccactccattccactcctccactcctctcatccactccactctactcctccactccacatctccactccactcctccactccactcctccactccactcatccactccactcctccactccactcctccactccactcctccactccactccactcatccactccactcttccattccactccattccactcctccactccactcttccactccactccattccactcctccactccactccactctattctattctattccattccattctactctattctattccattccattgcagtcaactccactccactctctactattctattccactcctctcccctccactccattccattgcagtccactccactgcactccactcctttattctgttctgttctattctattctattctattctattctattctattctattctattctattctattctattctctccctctccctctcttttcccacaagtagtgaaagtttcactttgtgtcttatccttcatgtaatgggaagccatatccaccactgttccttgagttaaggagtcctgttttaaacaatcaaaactaagaaggcacttcctagctatgtgatctccaaaaaatacttgactctctgagcttcctttctctcttctataaaattgaagaattacaccttgctcaaagatgccatgagaattcaatgacagacacatgcgaagtcaccccccagcacagtgcctggggcagagtagctgctccattgttccatttcctacttgctccatggctcagttgaacagatacttagaggttgatgcccataggcagaagctttgccatttgctatgatgacttcacctgcccctagtggcctggtgatgcctggtgtctcccctgcagatggtgcacaaagctgtggtggaggtggacgagtcgggaaccagagcagcggcagccacggggacaatattcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctaagctatggcccatctgtatgctggtagctagtgatttacacaggtttagttgactaatgaggcattacaaataatattactctatgatgattgcttccacccacacgactgcaacatacaggtgccttggggaaatgtggagaacattcaatcttgccgtcactattcatcaatgaagattaacactgagatccagagaggctggatgacttgctcaagttcaccagcatggtagtggcaaagagaggtccagagtcctggcccttgatgcccagctcagtgccacaaagctcaataggagggatgttccagtggatgagggccaccaggaagcacaggtccaaggctggtcccacacttatcagcagcaacaactgtcagttcatcctgcatgggaaaaatgttggaatgggagtctgaaatggggctactgtttcagtcctaatgtgctgtgtgacattgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtatcagttgcaggtgccaatgactaactttttgaattctatgttggcattaacaataaagcattttgcaaacactggttataactgtctttatggaggcagctctgggaatggtgacattgatagcttaccatgctccaggccgggtgcctggcccttcacctggatggtcgcatttgcccctcataagactcccatgaagaaaggcaccactgttatcccatctgttattcacagatgggaaaggcaaggcttgaagtggttaggtggcttacccagtcacatatcttctaagtggtgcagccagaatttggcggggggagtgcgaccaagaaccctacactcagtcctgtgctctgtgctgtggaggagagatgaccaggagcagaaacttcattcagggacatctcaggcaccagctcccccatgagccagctaagttccctccctcccttcaccaagcaccatgtgtttcctcatgtgccgaatgaagaggattagatactcaagaatggaatgagtgggtgagtgagtccttcgctgcacccaagtctgattttctgtgcgcctgctcaccccaccctgcatgttctaagcatgcttccataaggctgtgccccaccctctgattctagagtctggactgtatcagaggtgagtgcctactagaggtaacaaggtcaggaccccaaaccttgtccatcccccaaagtactgagcccccaccatgcaccagcccatgccagatgctttgcacttgtgatatcacccatcccttgacaacccagcaagttctattattgttcccattttacaggcaataacataagtgctttcccagggtcccacgctggtgacagtgagggcccagggtctgagagcccagatcgcacatgtgcgggctggtggcaggggagatggcagcaaccagactcagacatttctctgcagttgtgctgtgggctcagggtggctctttatgaaggggccccttcatggggtcatgcactcctgtgtgttttcccttgcatcatgccttgcctgtcttggcaaatatttctctggagtttacccagccagtccaaggtcacagggaagccctgtctgtgtctcacacagaaggtcaacgtccagcactgtccaaactttactcagcaaacagtcacaaagcagctcctgtgtggggggtcaggggtgggctcactgtggtctctgctgcatgtcacacattgaagcactgtgctgggggtcatcacaggctgtttaactcaattgtcacatgagcctgggtgcacaaaatggtagagcagctcagagagagatggacagacagcatgaacctctgaggagtcaggttttcttggatgaagggacactaagatggctttggagcgtgagaaggacttcacctagcaaatgtgggaaaggagtgagacctccaggcagagggactggctggagacgagcgtgatgtggtgagccatggagtgtatgggtccccacagaacttcagtctgggcctgcacagggcatgtggaggagacaaggaggagggaggtggccgtgccggcggttcagtgacagagatcctaaatgggaggccaatcctaaatgggatgatctctttcatcccaatttcagggtagtttggtcatccacgccacattccaagtgtcccctgggccctttctctccctcacccccctgtctgcacatgagtagatgcctccatgcagccctcccaggacgctcacctctatccacagatgcttctccaaaacccaccaggccctcccatggaacgagctcacctacagggtaaaatcaggtcacggtcacatatagcctgactactcccctcaggaccctcattcacagccactgtattaatttgctggggctgccaaaacaaagtgtcctcatctgggaggctgcagtagatttgctgaaattgatttgctagcgttgctgaaattgattcaagcttgattctggagcttgaatcgaagatcaaggcaagtgcagggctggtttccctgaggcctctccccttggtttgcaggtggctctcctctccctatgtcttcacatggtcctcctctgcatgtgcctgagttctaacttcctctcctctcctcatctccaccagtcttatagaattagggccccccaatgacctcattctaacttaataacctctttaaagtctctatctccaaatacagtcacattttgaaatattgagggttaggacttcagtgtatgaattttgggaggatgcaactcagccaggctcactcttatcattacagctgcactagtgccatgcctggttcccagtggacaccccaggaacagccatccatccagagtgatattctgtgacatcccctacactccacagctcatcacatcacactcgtctccagtcggtctgtctgcctggaagtcccacacctgttcccacatccactgtctgggaggtccttttcatgcttcaaagccagctcagtgtcctcctttgtacaaaaaaatgtcctgacctctcagaacttcattctttctctctttctgtcgatctttgtctgaactcctctatcattttgtgcacccaggaacgtgtgacaattgagttgaacaggctgcaaaaacgaaaaagaagaaagaaatgctgagttaaacaggctgcaatgacccccagcacggtgcttcaatgcatgaaacgcatcaatgacttgcagcagaggccacactcagcccccctctgccctttgagtttttgcagctcttgccaagatcattcttgttcttagaaagcccaccattattttcctttctagccatatggattctaaaagttcctcttgtgagctgtaatcagaatgcagagaagtaatacaaggttagggcccaggactctttctcccacctctccctgcagagactcagatttttttaaaaaatgaccttggtcttcgggggaagaacttcccaccacagtgaacagccatgcccagcctacacttgactgtgcggcttacttagctcatccatccaaaggctattcctgggttgcctagtggaaatccaggcatggagctagtgcaagcacaatgataagagtgagcctggcagacactgaccccagcaataatcaggtaaacaaataaacagaactacaaactatgatgacaagaattcatccatccacagatattcactgaatggccactgtgtgcctggcactgttccaagtgctgaagaaaaatgaagaaaacaaaaatccctgcccttatagaggagacattataatgtgacaagataacataatgaaaaagaatgaagaataaaatagaaaagtaaaatggattgcatgtcacttgatgacaagtactgtggaatgaggccgtcatctaaatggagcacagaaagtggaacatggcgacatctcagccaaaagacccggcagacaccatcttggccaagggatcgaggttggcatcgccagctgtgagcagtgctgacatcttattatcttcgatatggcgtcatgagcaggctgcctcctcttggtgggatcttcccccaaacccagaacctcagtctaatcacaagaaaatgacagccaatcccaagttcagggacatttggcaaaatagcccaccactcctacttaaaagtgtcgaggtcttgaaaggcaaggaaaccctgggaaatcgtctttggccggaggaaactcagcagacatgacgactaaatgcaatgtagaatcctcggacagaaaaggacattagtaggacagctggtgaaacccaagtaagtccaggctgtaccaatgtccacttcccagttctgaggaacatgctgtggtctgtccacatttacattaggagaagcagggagagcgtatatgggacctctctgtattgtttttataacttttctgtaaatccaaaactgtcttaaaatagtttttttaaattatactttaagttctggggtacaggtgcagaatatgcaggtttgttacataggtatacatgtaccatggtggtttgctgcaccccctttttttaagaaaatgtttcaaaaagaaaaacagccaagtaggggagggcacacgagtggggttgggaattgcaaaggcagaagcaggagaccagttaaggaagaaaacggggcactaagagagacaatcaggaggacctgctgcagccagggccctgaggggctccctgaggtggtgccattgaagcggagttctgagggacaatcaggtgtagacactgtgagtctcagaagtgggaaaaggggagtgctgtgcacaaaattgagagacggtgcctgtggcagcagctgaggagggaaagagaaggtggggtgggaggcccatcccttccttggccacaaggacactgagtagggtgctgagatgggagtaacagtaataataacaggcagcacttggaggctgcgtcccgtgtgtctggcactcgcctaagccctttgtgcacattggctgagttaatgcagaggtgaactgagaggcacctggggtaggggctgggggacaggaagcaggtgacatctccagtcctctccagcgtccttagagcaggtctacagtactgatccttctctgccacccttctccaagaccaccttggtgggagtaaggggctctaaggtgacaacacacacaggagccacagacacaagacacaagacacttttgactcccaggagaacctagtatgggcatccacacacccttcctgatggtgactttttatgtagacatgcagagtgcagttaaccagctgttcctgcacacatctggattgctactcacacatctgtgcacacacacacacagcctcctggagcactgtggcttctgggtggctaacacagctaccacctctggttgtgctgagctgagcacccattgcctgctggggtggggagagggcaggcactttccctgcgcgaccccgtttaaccctctctgccccactgatgtggtccctgttgtccccgatgcacagaggaagaacctgtgtcaggacccccagagcggtgtctccactaagcagaagtctctgtttctctcctggcctctcccagaggggctgctctgaagcatgtggatttgatcaggataatcaaggtaaatgatccttatcttgatccatcacaaatgttaaggtacaaggctgtggagatggagagtgggtggagtctctgctgcccggtatcctaagctgggtgatcgcaagcagacacacacatgaccacctcttgggccatgcagggggaatgaatgtaatgaggccgatgttacagggttattgaaggctcaggggagaccaggccaaaaaaaaaaaaaaaaaaaaagctatgacctgagacctccctatagcagtgtttctcaaactctgattaacgttacttgaggagcttgttaaaaatacatactcctggccctgatcagataaatcagaatatttgacacagagtctttaagctccccctcgggattcaaatgcacacagatttttggtgctttgccgcctacagtacaagagagggcaggactgtcctgttcagtgcactgtgacccggacgctcaggcccacggaactcccctactccccctgctccctgcggtgccacccacctagctttcgtgcctgagggtggtcctcagactcctcctagaacaggcccagaggctcttagctatgtaagtattcattcctccaatcactgcagagcactcaccaggtaacaagcacgcacacccaggcgagttccccatgctcgtccccacgttgatatctcagactctacaagtcttcagctgctgcctaggactctgtaagtccttgagcttgggacccctaccacacacaagcgctgggcgtgccccacaggcggggaagtgctggccatatacacccagtgaagtgggaattccagataatgagtaactttttagcaaagtacccatgccctttgaattgtgaggtgtttttgtttgctaaatctgacaattctacctgtagggaacagggatgattgagaagcagctgctccgatggccagaagccaacagccttccctgcagagatgcgggaagtcccagggacagcaggaaagtccaggcactgcactggcagtgggattggggcttgggtcagaagagggtcagggccacaaggaaggaccctgggaggcttcctgctacataatatgagggccgggagcataacaaaggattgccttatccatgattgcatcatcaaactgaagcctgagacagaacattctgtgaggtggccttgttcactgcagaggagctgactcacacagttttgtctgggaagttgcaacctgtgccaggagtagccagcctgggagtaacaaagaggcttttctactgcaggttttcctagagctcctctccctccctcccctggccaaaggtgagctctgcagggagggtccggctctaggggactttgctcctgggcatcctagctgcagagattggtggggcttgtccagaaaggggggtcttctggacctggggatgatgcagttgggcctcagggtactgggaggccagtaggggtgcttcaaactggccagtaacctgaaggactcatattcttaaggatatcctggtggccacgtagaaaacagtcaggtggggtgagggtggaagtaaggaccagctcagaggtcactgagggtgcagccagacaggctgggacccacgtgggcagcagaggtggagagtagggatgtggagggggagacccagccccacgctgggggccctgaggggaggtggaggctgagccaggagaagaggcaccacccactcacttcctgcttgctgaatgactgtgaggagcaggagaaggagcaaaagagcaagtgaggaagtcaagggggttatttgggggcaatgctccatgtgagggtagctaaggacaggtgccaaggaggcccctgtgtcaaaatcccaggtcaaaatgttagttaccagagacctctgataaagacagagccacaggtaaaacgcagcggcacaacccctcgaccctaaaatcagaagcctatctgtgtcctggcaaggagagaagcacgagtgatcatccacaccgccaggacgcaagcccgttatttctgatgcaaaacccaggctccctccagggctggcacagaggactgccagaggagtcagggggcctccaccttccccagctgcgcaacctcagagggtgtctccttatctctggggtcactgtgtcttcatggccaggctgggcacaggtcagctgggagtggagctgtgtttgcagggaaggaacgagggtggacgtcgaagccaacctgcctggttcagaatcctggctcagcttggcacttaccagcagtggtggtgaggccttgggaatgagctccgcctccctgtacttccgtttcctcatatctaaaattgagggagtaatgggacccgcctcagtgggtgttcatgtggattccatgtgctcttaagcataaagaacagagcagctatgatgaccatcatctatgtcactgggcctccggaagtgagggaaggagaggcagatttgcttaagtagaaggaaggcggaggaaggtagtaaggcgtcagccatgtggcacagattgtattatgagatttactggttttcttacttcgtcctcaaatttccctccttacccacttcccatgattcctgagagtcaagaggacgggagctgtggaatgtgttagtcatctactgctgcagagtaaatagcccatgattatctcacggagttcctgagggtcaggaatccaggattgctgttggccagggcaatcccagaaggctcacttgtggggctgttggtagaaggtctcagttcctccctatgtgggctactcacagggctgctcaaatgtgacttagagagagagagagagagagagagagagagagagagagagaggcttgtttgtttagtgtccaggaccgagagaggatatagagagaaagcacaaaagagagagagaaaaaaagagaaaggcagagagagagatagagacagagacacagacagttgttgaatgtccaggaccaagagagagacaaaagacagaaagcacaaaatagaggggaaaagagaaagacagagagagtaagggacagagagagggggacacagagagagaacccatggcagaagcagcagtctttttttttttttttttttttttgagacagagtctcactctgtcgcccaggctggagtgcagtggcgtgatctcggctcactgcaagctctgcctcccaggttcacaccattctcctgcctcagcctcccaagtagctgggactacaggcgcccgccaacacgcccagctaattttttgtatttttagtagagacggggtttcactgtgttagccaggatggtctcgatctcctgacctcgtgatctgcccgcctcggcctcccaaagtgctgagattacaggtctgagccaccacgcctggccagaagcatcagtctttttataacccaatctcggaaatgacaccccaccccttctgccttagaaagaagtcactaagtccagtccaatgtgagagaaagtaattaagctctatctcttcaaggaagtggtatcagacatttgtggacacatttgtaaaatgaccagagcgttagaacctcagaatccagcagactaattgccctcatagtagattattaatgttttaaaaaatggatggactagctgaaggaataaatgaacgagtgagtgagcaggatatttctgtctcatttcacatgcagaaaaggcactgaggctcagaggaattaggacatgtgtgaggttctctaggcagtaaggggtgggggctggcctggtttgccagaactcggagatgcagcatgcagcgtgcagcagttctgaaatggaagccagggatggcaagctacagcagccactccctcccggagggagaacggacccaacaccaaggaggaagggatgactcagcagccctcaaaacagagtcaggagttctccctgcttttgccaaaccctctgcaggcacctcttatccatacagggacgcagccaaaggcctagctgtgctgaaggaaatttgcaaatcctgcctcaaatctgcagccagtatctcccccagcagcctccaaaccaggccagcacgaacccagccagagagcagcataggtgttgggcaaaaacaggctattgactccatccttttctaacagagaccagagtcctctggccttccacagagaaggtggggccttctcagggttctctggatctgctggtgtcagtcagtatctatttcttcttcctaagaattcttttttttttttttgagatggagtttttgctctgttgcccaggctggaatgcaatggcacaatctcagctcactgaaacctctgcctgccgggttcaagggattctcctgcctcaacctcccgagtaactgggattacaggcacccaccaccacacagggctaatttttgtatttttagtagagacaaggtttcaccatgttggccaggctggtctcaaactcttgatctcaggtgatccacctgcctcagcctcccaaagtgctagaattacaggcatgagccactgagcccagcctcctaagaattcttaaaggagctacggttgacaaaagagtttcagagaggtaaagttatggccctaaagtcacccagcaagtagatgtggcaaagccatgttgcaaaagaagccctggtgggtgacactctttggatggcccctgcctctccggaaggcaccagcgttggtttctctccgcctcaccttcccatgcaggtgggcacgtttgtgcttgggctcctgctggttatgccccagaagcacactcttccctatctgcagtcccagcccatgtgtggacacaacccatttcctagggtgttccttagcccactgcaccaagtcagcatttaggaatcaa

SEQ ID NO: 1317 - DNA, 52096 bp, Homo sapiens
ttaatttcaatccctttcattttctggtagagacaaaggagacacgttttatccctggacccaaagctccggtgctggtcacggactagggaaggcagccttcccttggtgtttaatcattgtgggacacctctctgattattcacccaggtttcagaggtgtcagaccatgcaaggatgcttgcctttgtccttcaccctttgtggcaagtcctgcttttctggaggaggggcaagaacctctcaaccccttctccttcacccttagcggcaagtaccgcttttctgggggagaggcaggaaccccaacctcttatctctgtgccccgatcccttatttctgtgccccaacctcttatctctgcaacctaatcccttatttctgtgtcccaacctcttatctctgcaccccaaccccttatttccatgccccaaccccttctcttcttttctggagggcaataaccccccatcccttctctgtgtctctactctcttttctctgggcttgcctccttcactatggacaagcttccaccttccattcctccttcttctcccttagcctgtgttcttaagaacttaatacctcttcaactctcacctgacctaaaatctaagcatcttattttcttctgcaatgccgcttgaccccaatacaaactcgacagtagttccaaatagccagaaaatggcactttcaatttttccatcctacaagatctaaataatccttgtcataaaataggcaaatggtctgaggtggctgatgtccaggcattcttttacacatcagtccctctctagtctctgttcccaatgcaactcaccccaaatcttccttcttcccctcccacctgtcccctctgtcccaacgccaagtgtcgctgagtctttctaatcttccttttctatagacccatctgacctctcccctcctcaccaggctgagctaggtcctaattcttcctcagcctccactccttcaccctataatccttttatcacctcccctcctcacaccccgtctggcttacagtctcgttccctgactagccctcccccacctgcccagcaatttactcttaaaaaggtggctggagctaaaggcatagtcaaggttaatactcctttttctttatcccaaatcagatagcgtttaggctgtttttcatcaaatataaaaatccagcccagttcatggctcgtttggcagcaaccctgagacgctttacagccctagaccctaaaaggtcaaaaggccgtcttattctcaatatacatcttattacccaatctgctcccgacattaaataaaactccaaaaattaaattccagccctcaaaccccacaacaggacttaattaaccttgccttcaaggtgtacaataacagagtagaggcagccaagtagcaacatatttctgagttgcaattccttgcctccactgtgagacaaaccccagccacatctccagcacacaagaacttccaaacgcctaaaccgcagtggccaggtgttcctccagaactgcctcccccaggagcttgctacaagtgccagaaatctggccaccaggccaaggaatgcccgcagcccaggattcctcctaagccgtgtcccatctgtgcaggaccccactggaaattggactgttcaactcacctggcagccactcccagagcccctggaactctggcccaaggctctctgcctgactccttcccagatcttcttggcttagcggctgaagactgacgccgcccgatcgcctcagaagccccgtagaccatcacggacgccgagctttaggtaactctcacagaggaaggtaagtccatcctcttcttaatcaatatggaggctactcactccacaataccctcttttcaagggcctgtttcccttacctccataactgttgtgggtattgacagccaggcttctaaacctcttaaacctccccgactctggtgccaacttagacaatactcttttaagcactcctttttaattatccccacctgcccagttcccttattaggctgagacactttaactaaattatctgcttccctgactattcctggagtacagctacatctcattgctgcccttcttcccaatccaaagcctcctttgtgtcctcctcttgtatccccctaccttaacccacaagtataagatacctctactccctccttggtgaccaatcatgcaccccttaccatctcattaaaacctaatcccccttaccccgcttaatgccaatatcccatcccacaccatgctttgaaaggattaaagcctgttatcacttgcctgcaacagcatggccttttaaagcctataaactctccttgcaattcccccattttacctgtcctaaaaccagacaagccttacaagctagttcaggatctatgccttatcaaccaaattgttttgcctatccaccccatggtgccaaacccatatactctcctatcctcaatacctctctccacaatccattattctgttctggatctcaaatatgctttctttactattcctttgcacccttcactccagcctctctttgctttcacctggactgaccctgacacccatcaagctcagcaaattacctaggctgtagtgctgcaaagcttcacagacagcccccattactttagtcaagcccaaatttcttcctcatctgttacctatctcggcataatcctcagaaaaacacatgtgctctccctgctgatcatgtctggctaaactcccaaaccccaatcccttctacaaaacaacaactcctttccttcctaggcatgtggatacttttgcctttggatacctggttttgccatcctaacaaaaccattatataaactcacaaaaggaaacctagctgaccccatagatcctaaatcctttccccactcctctttccattccttgaagacagctttagagactgcccccaccctagctctccctgactcatcccaaccgttttcattacacacagccgaagtgaagggctatgcagtcggaattcttacacaaggaccaggattgcgtcctgtagcctttttgtccaaacaacttgaccttactattttaggctggccgtcatgtctctgtgcagtggctgctgctgccctaatacttttagaggcccttaaaatcacaaactatactcatctcactctctacagctctcataatttccaaaatctatgttcttcctcacacctgatgcatatactttctgcttcctggctccttcagctgtattcactctttgttgagtctcccacaattaccattgttcctggcctggacttcaatccgacctcccacattattcctgataccacacctgaccctcatgactgcatctctctgatccacctgacgttcagcccatttccccacatttccttcttccctgtttctcagcctgatcacacttggtttactgatggcagttccaccaggcctaatcgccacacaccagcaaaggcaggctatgctatagtacaagccactagcccgcctcttagaacctctcatttcctttccatcatggaaatctatcctcaaggaaataacttctcagtgttccatttgctattctactacttctcagggattattcaggccccctcccttccctacacatcaagctcagggatttgcccccacccaggactggcaaattagctttactcaacatgccccgagtcaggaaactgaaatacctcttggtctaggtagacactttcactggataggtagaggcctttcccacagggtctaagaaggccaccacggtcatttcttcccttctgtcagacacagttactcagtttggccttcctacctctatgcagtccgatagtagaccagtctttattagtcaaatcagccaagcagtttttcaggctcttggtattcagtgaaacctttatatcccttacagtcctcagtcttcaggaaaggtagaacggactaatggtcttttaaaaacacacctcaccaagctcagccaccaatttaaaaaggactggacaatacttttacctctttcttttctcataattcaggcctgtccttggaatgctacagggtacagcccatttgagctcctgtatggacgctcctttttattaagccccagtctcattccagacaccagaccaacttagactgtgccccaaaaaacttgtcatccctactatcttccatctagtcatactcctattcaccattctcaactactcataaatgccctgctcttgtttacactgccagtttacactgtttctccaagccatcacagctgatatctcctgctgctatccccaaaccgccactcttaactcttgaaataaataaataatttttgctggcaggactatgctgaatctccttaggcactctctaattagatgtcctgggtcctcccaattcttagacctttaataccagtttttctccttctcttattccatttagtttttcaattcttacaaaaccgtatccaggccatcaccaataattctaaatgacaaatgtttcttctaacagtcccacaatgtcaccccttaccacagaatcttccttcagcttaatctctcccactctaggttcccacaccacccctaatcccactcaaagcagccctgagaaacatcgcccattatctctccataccatcccccaaaatttttgccgccccaaccttttaccactatttcattttatttttcttattaatataagaagacaggaatgtcaggcctctgaggccaagctaagccatcatatcccctgtgacctgcacgtccacatacagatggccggttcctgccttaactgatgacattccaccacaaaagaaatgaaaatggcctgtttctgccttaactgatagcattaccttgtgaaattccttctcctggctcatcctggctcaaaagctcccctactgagcaccttgtgacccctactcctgcctgccagagaacaaccccctcttttcctttacctacccaaatcctataaaacggccccacccctatctaccttcactgactctcttttcggactcagcccacctgcacccaggtgaaataaacagctttattgctcacacaaatcctgtttagtggtctcttcacacagacacgagtgaaagaatgtacttttgttttttgtaaaataactgcttatagacaataaaaactcaaaagacattatttcaaagatgtgtctttgaggagaagcccaaggtttgccaagatagaactttggaataaagacttgaaataggattagtccaaccaatccttcattttataggtgagggcattgaagctccagagaattgatgtgacaagccaaaaattataatgttggacagtgaaaaatatgtcatcttttaattcctttacatcatcagggtggtcacttgaggaatcaaaaggagaaagaaactagattattgacatttagaattttaggcttcagatttagagattatcatatgaggaaccatgacaataaggggaggaaggaatcacaaaattaagtgctcttgcaagcaaacaaattaagtaggtccacacttctaccatatgcttgtaatcagactcaggccaatccatggctcagggggttggtccttcatagagtatgcttcaatggtataaggctacaaaatgaggaagtatcttatttccagaggtccaaggcacagacttttaatgaaacctgcctaaagttttctctgtacctttgaaggtttccatgtcatcattacccaattcaggagattttataagcctctccaaagaaagaaattattccttttctcaggtctttggcttttcagttgtactgcgtgatgtggcagactctgagatgaagcagggatccctcctacgggcctgccacccccaaggcatggaaataaaggaaaattttgagttccttccagggaaattccaggcaccaacctagccctgagaagtaaatgagcaacctgataagcaagaatgctgtaatagctgaaaacaatagccaaggaagctagagccacagagtttgcttctctatagaaattaaaggtaaagtcttcacatatgtccctgagttgtttttcagagacctggacccctcaccacatggaaaagccatctgctggcacatagatctcagatagggtggaacagaggactaaattctgtcattctttgttctaaatttcttcctgagggtcctgaaggaaattatgctcacaggccagagctcaactctcctttcagctgacccacacttttagacaaagccaaaccaatcacaaatcagaaaatatttgcatccacctgtgatctgtgggccatgccaccctccccactcacctgatttgagatgtcccacctttttaggccaaaccaacgtatagcctccatgtactgatttatagctttgcctgtaacctctgcctccctgcctttaaaaactcttacagttaagccactgggtatttcagatcttaagcatgagctgcctgattttccttgcttgccaccctgcgataaatgcctcactttttcttcttgcaaatcccaatgtcattgtttggccttgctgtgccaggcaggcagacccaagttcagtctggtaacaactcctctagaatacgccatgaattatagctatgtgaagtcaataaaacccaaagtttccaaaagaaatactactattttaataattattttgcctccatgaggaatacaaatatttcctatatatgatgtactggacttttacaaggggtattgacagtaattttatcccatattgattatggactgttgtgaatcctacagatttcatacagtttagcaaagaaaattatttcatacttattttccttcataaatagatgtatgttttgtaaatgtattccatatacttgtaacctttatgatgcaaacttgtaataactactgagttacttacaactgaaggaaaaaattaaatgttttaattttggaagtagttcggcaaatgtatttccagaacatggtagaaaatggggtttttatcttgaatccacacaatgagcttatggaagacactcccatttttaagccaaatggaagaagaacatgaaatcagaaaaataaattacccaacttctgtataatgctttcaggatcctcagtcgggaactcgtggcagacttttagcaaatcttattaaggaaaacaaatacattaggaacacactgtaagaatatgtacttaaagtgaaacttgggtagtgatcttattacatcatctcaattattgaacccctcttattttcttcttctgctttattaatgtcatcagttattaccatttgaaattaccttgtttttgtatttgttcactggtttactgctaccagtaaaatgtcagctccaggaagacaaggaccttgtcagatttgctcactaatacatcccttgtgcttagaaaactacctggaacatagtggaagctcaattaaaatttgtagaatgaatgaatgaatccccagagcatgacatttaatgcatgaaagaggatcagaagaattcagccaacccaagagaaacaggaatctggaccacagctgaataaaactactatcctcttaactcattattctctccttcctgaaacaaagacttatatttttaaaacagatatgttgtgaggaatttatgccacaaatgcatattactaacatatagattagtatttactgtgttatatctaagtatgctcaaattgaaagtagagtaatgaacattgctttcaattatgttatgatttttaagcaatcacaattcattctaaagttggcttcataatgtcttgagtattgctgtaggttttgctgtagatggatacctagattttgaaaattaaaatagaaggtggagggcagcagaatatgccaccccaaaagatgccactttagcataagggttattttgagctaaaggcaactgagaagaagtagatacaggaaaagttatttgccttgcctaaacaatttgcctaaaaacagaatacaaattcacaaagttatccctcctcctctctctaccaagtaggacagaatttgatcactgaagatgacttaagacccttatcatcctggagatatcaccacaggaatctacataacaaattttacaaaatagcctttatctaccatatatttgccttcctacaatttactgcccttataaatccaaggtccttttcctttgtcatttcttcaaccatgtattgttctttgtcgaagatgctatgtaagccagagttctaagccacttctttgagatttactcattttttcctgggtgtcttctatgtgtacatgtggtatacatgttaacaaatgtctgtttttctcttgtgaatcttttgttttttgagacgaggactcactctgttgtccagactacagtacagtagcataatcatagtttactgcagcctcaacctcctggactcacgtgatcctcatgccttatcctctcgagtagctgggaccacaggcatgcgccaccacacctggctattatttttaatttttatgtagaccggatatcactatgttgcccaggctggtcttgaacccctggcctcaagcgatcctcccacctaagcctctcaaagtgctgagattacagatgtgagccaccacacctggctatcctgtattttattacaagggatactagctcaaagctatgagaagtagagagaaaattactttttccttccctgcaaagggaatataactcagtaattaaggtcacagacttctagcttgagtagttctgagttcaaatctacccaccatatttatcagttgtgtgtctttgactaattttataacatttttcaatgtcactctccagtagttctgagttcaaatctacccaccatatttatcagttatgcatctttgactaattttataacatttttgaatgtcagtctcgagtagttctgagttcaaatctacccaccatatttatcagttatgtgtctttgactaattttataacatttttgaatctcagtttctttatcaggaagttaggtaatgctgtttcataaaaattttagtacatttaacataaggtaaaaagtgcttacttcagtgagcccaacacaaaattagggctcattgaggtgcagctattatcattaagctctctgccaaaattgccaagacaaacaaacaaaaaggaattttacatcattagcttgaaaatggaaaaactgtgaaacatgctatatgaagtaatattggaatgtagttttagcttttgatatttagatgtgatgtttcagagtattcaagggaagggatctgcatttaatctttatagtgcacaatcttgactctaacacttccttggctcagtattgtaaaattgtggaagttcagcttcctgagtcacgctaattatgctgccactttcacctataaaaagaggaatgctttacagaagcgctcagcatttctatgttgtgtacattttaaaaccataaatcagtagaaaaaaaactggtatgtttcaaaaggtactgaaacaacataaatattaaatgtaacatgtcaaataacaagttaagattagtgaaatacccaaagctcctctattgcaaggaatactggatctctgtgtcttgagtgacaccccagagaggcatgtaccatggccattgtctctttatcttatttccccatggctagaaaatggtactatgcctgaatctaatagtctagtattttagggaataataaatttgctatctaagacaagaatttggtatttaagatattatagacaggattgttctaacatatgaatggtaatattttacgtacgctcaaggttttagatgcatatagattttctaaaacatacagaaggaatggaaacaaatgcatacctaattttacttattcatcaagacagatatctattactacaggcacagtttaaaacagaaaagacataagatatagagcaaatattgtcaagatgacgatattttgccaatcagctatttttgagaaatcatcttttattctgaggctgtgcttttcattcacagtgaatctaaatctcttccttttatctcctgggtgtcaggatttgtcactcttcccataaacagaattgattctagggaaaaaaaaacaaaaaaatatactttaggaatttcaggagaaaacaactgacaataattagtttttcttaatatttaacatgtcatttggtcttttttctctgtaagataaataggcagtgtctaatagcaaagccttctcctttgtctcaaattcataattatatcattattaatcattttctggtaatttatgaggtaaattaacacccactacagcttgtcatggaaaaagcattaatcctgtttttcatagagggaaacaaaaataaagtgacagagaggtgttcttctaaatatagagacccagtccggagaacatagcataataaaacggtgatgagcgtggtagagttttaaatttaaggcattagcaatcatcattttatgcatgtaatgtaagtcttaagggctaaaagtgcaacttcccagttctcctttttcagctctgaatcaaagcttactttacctccaatgacaatatttttatatctctagtattttcaaatactgaccaaagtgatatagtatacagcataaatgcaaatacctgttttcaaccattctgtgtttgcaagtgaaaaggaactaagaactaaaggacaaaacagaaagaatgatgtaccaaaatctattcacctttcttttaaactgggttaagagaagtggcctaaatcaatcagtgtcaaatgttgccttaagttccttatgctcggatgtcataaaggttaatttcaaaggcgacaaattttgcataattttaaagctaataaaatgatatttaaatgcatttgaaataatagtgggacggcccttttttattaactctactattcagtccaaagacacactctttgaagaacaaataacatggaaatagacataaactccagcagattttattttatttttttgttttgttttgttttgttttctgagacggagtctcgctctgtcacccaggctggagtgcagtggcgggatctccgctcattgcaagctccgcctcccgggttcacgccattctcctgcctcagcctcccgagtagctgggactataggtgcccgccaccacgcctggctaattttttgtatttttagtagagacagggcttcaccgtattagctgggatggtctcgatctcctgacctcgtgatcctcccgcctcagcctcccaaagtgctgggattacaggcgtgagccaccgcgcctggcccagattttactttttattatgaataattatagtcaacaatgttttgtttcaaaatattaaaataattctggaaaaaagaaaacaaataccccaatatttcagatagataaagatacataaatacatctcctagaatagatattacatttagtcacaacaggaataagcagcgactcctatatcttcataatattaatgccataatgctatggcattaaaatgctcatcagagtagtttgtctggaaaaattttaaagtaacttctataaacactaagttataattgaggacaatatcttaaaattttaaatacctagaagggtagaatgttacataaaacccattagtcccagccttttcaatctgtctctttctccaggaagaatcacattttgaattgaatcttcatgccatcatcaatctacttactactaaattgggcagattaataaaatctcccttgacataatagtgaagaatttagaggcagactgaagcaaaaatgattattttttatcttcatgcttccttcctaaataggtacccccatatttaatcaatatatttatacaacatcttcatcagatggaagcaacttttacctcctaatattacaatacaatagcattaccaagctaatggcgagaaaaaaaattcttaatggatattctgcaatctgcttctcccctcaacacacaacccaaaagagttctaaacacaataactttcattatgtctggagtcctgtcaatttcaaaatcataattcactattttttcaggaatggtacctttcatgagtatccttcacaattttcttctcaaagcctataaagttggcctacatccccaaccttaaaaaggtgctttattgtcctagaaatttagcttagtaagggctttagaggaatatactgcaatataaaattcatctgataggaaaatccaaataatggctagattttgcacaaaaggactgtttggatcaaagaaaatttccaggctatgtaaaaattgattgtactaaacctaaaatcattcatcctcatacttcagaaatcatcaacagaatacactttatgtataccatgaagccatttaatagttcactatggtgatgctaaatcactatcttcattaatctcaatgatttcttgagttcatttgtgagagaaaaattgataaatcactaaatatgtattgtcttaagataacggccctttctacattttatatggcaacaacggacagtccctgataaatgagcggccatttattttaaacaatactttaaaggagtaaccctagtttagaaagtctcactacaataaagaacataaaacagttcaaactgtcattaagacctgctagttaagcattatcacaaataaacagataagtgggttattttgggttttgaacttttgctgctgttttactgatagctgttacttggcctttgcatataacaagtcatcaacctggaaaatagagtaaaacataattattctaaatgccattatttacttgtgcattgatgcccaatgtagctttttttctttctgtctccatactacataattatatattaattgtaaaaaattagaattatctaaaggttagacagacacatagatcaaatgacatacttagaatacatttgaacactgacacagccattactagaattgaagttgtgttaatgcaatctcatcaattctaaaactgtttcattgtttttaagatatgactttcagaagggtctctcagcattagtttcatggagccaaaaaagagtgaagtatcccttactgggccaataatatcagtatcgctagttcatctaatagattcagattctgcaattaactatgtctcttctccctgtaaatgactttaaactttttcacttgcctttcttcttttattcactccctcattcatatttattaatttattcataatgaacacttagtatgtgccaggcacagtgttacaggcttcaaaaattcttttatttaactctatgagatgagcactactattatgttcaaataagatatagggaaaatgtggcttagaaaggacaagcaacttgtttcacaactgttagtgaattcagctggaaattgagcccaacccaatttcacaccctctgtctatagggaaactgatactatgtgcaaggcattttgccaaatattggcctgaatacagagatgagtaaaatataatttctactatcctgtggtatgtaactctcacatgagcattatgactgctgaaggatcctaaacataaacttgacaattttcccactgtattcacatttctggcttctcttactcacaagagaaagtgctgaagcatccatccagacaatctgaatttccctgtgttgacactgtgcccagtgctaatccaatccactacttctacactccctttacctaactgcatcatctttcaccagttgcccaagttgaagatttgaaattacctttgactccttcctatccctcagaacctacattagtcacttactgttttggtatccacctctgaattctttcacaactccacacctctcaatttccatccccaatgtggcatcatacacagacagttgacctttattcccactctgacactttctagctacgtaacctgagacaaaccatacaatctttctctgagcttttgttctttactagtcaaatatctaatcttctggagtggttttagctttactgatggttatatgaaatggctaccgcatatagtagccatgatggcagccattattaccactgccctattttaggcctcggtcatctcttaaaatacaattcctggtatataaaatgcacttaacaaatatccactgaaagaacaaatgacttcagatatgtacattgcaattagaaactggaactagttctgcttaacataatcagttcccccaaataattctcaaaaaaggtacctgttggattatgcttcataataaacagaaatggatgatttgctataaattggctttgagccagactcatgatcacagggatgtgtatgcctataaaatagagacaacagttatttagatacttgcattaaaagatcagtaaagaaagtatattcataatacattttgtagacaggaaaagtcattttgtgtaaggagttaacatgtggaaaaataaccattttctaaatacagaggaatttgcaataaatttaaaaaccaaagtactgaagaataaatattaggtcactcacagaataattctaactttatatgtatgctcaatgaagaagcaagccagataccagattcaatttagtgaaagcagttgaaaaaatttatcttttaaacagtaattttctgttcactttttatttgcattatatgatttatttctacaatgtttgtaattcctaattcctatttaggtatatttgcacttcgggtttgtggtaatcacatctgagctcaaattaatttttttttttacttactctttcaaaattattctgtgagctcagagcttttaggatttgtgcagtgaatgtgtgtgagatttttattatgagatttgaagcagaaatttgctgccttaaaaattactttctatgattatttatattatgttgctccattacagtatttgtcaatatttagaataggaaaatataaaaagttagatatttttcctatctagattaaatgttttatgcttaattcagatactgtatttcccaataattgaattattttgtactgttattttcagaccccaggaaaaataaaatcactatgtatcattagaattataaaacagtcaaatataatcttagtatgataacatgattggcactctcctatccagaatatcaagggtatacctaaataaccagtgaatataggctcatgtctgaattactacgataaatccaaaagcaagatcagttttactcccattcccatttacagtgaatacttggactttttttgcttttgagcagtccgtgagtggatttctgaaagtcaaaatacccagactgactattctgaggagttttactttgattcatctaccttctcttaatgattgttacagaatcctagaaaattttagacttaaaatgagagacagtgggcaataacataaagagctctgaacttaaagtcagggaacatgagttgcgttcaaattctgctgtcaatcaataatatggcctcaggtaagccactttacattgctgggcctgtttcttcaccaatataatgagatcaaacaataatctataaggactctctcagtactgtttgaaagcagctggaaaatttgtctacatgatccagcaatttcatccaaatataaccttttgacttcttcaaagattaatatagttcatcccctacaatccaagttccttgagcacagcaatgcaagatccttcaggagatgacaaaattgtaagggagtccagtgtgtttcatccagatgtcaaaatccattggcccaatgcagcattgcaaattaatcaagaaattaataaatgaatatcaatttttatatatttatcagtaagacattgaaatgataaatagcttttaaatattgattaaaatccaaatagtatggggaattaaaatagacttacaaggaattcattaaagttgcttgtccatttataattattttagggcttttttctaattatttttcaagcattatttatatgcagcacagatgctatttaaaatgtcatttgttcaaggaaatatggcctagaagagtggttctctaactagaatgtacatacaaatttcctagtgatcttgcaaaatacagattctgattcagtcggtctagggtttggatctgagattttgcatttctaacgagttcccaagtggtgctgttgttggtctatgcactacatttgtaataaaaaaggcaagctgcaaagcactatggagcactggttcttccatgcacattgatatcacttaggaaaacctatgaaaattttggagtctggatttcacttccagaaatactgatataattattttggggtgtggactgggcataggagttttgttttgttttgttttgctttgttttgagatggagtctcgctctgttgcccaggctggagtgcagttgcgcgatctaggctcactacaagctctgcctcctgggttcacgccattctcctgcctcagcctcccgagtagctgggactacaggcatccgccaccacgcccggctaattttttgtatttttagtagagacggggtttcaccgtgttatccaggatggtctcaatctcctgacctcgtgatccacccgcctcggcctcccaaagtgctgggattacaggcgtgagccaccgcgcccggttgactgggcataggagtttttaaagcttcccaggtgatttttatgtgcaggttaagtttgagagccactgccacagagataataacaagaatcaaattagcaaagtggtgactaacttggtgtaatgaaagaatgaaataaaatacaattacgtaagggtgagcattcctaaaaaataatgattttatatttgagccctaaagttttatccacaagtcctatctgctaattcacaggtaatccaattcgcaagtaagcaaatatcagtagataggtctcaactcctaatcaaaccccttcccttcctttttgtatcatgctgtgactgaagagaaatatgaacagcgtatacaaccatttcctttttttcctcctgaagtgtattagacagcagaagagaaaaagaagagtacaatacttcaaaagggtcagcaccataatgttcatcctctccccatgtttccttctagcttggccagaaatcattcaccctaccagttgatgttgcagcttcactaccatcttcatttatctcaaagaaaactttttgcgtcacttgggaaacatacacttcagatgaatctggttaaaaaaaaatacacaaaagtgtatttaagagttaaaatcaaaagccgttacctattagatctcaattaattacatttatttatttatttatttatttattttttgagatggagtcttgctctgtcacccaggctgaagtacactggcacgatctcagctcactgcaacctctgcctcccagattcaaacgattctaccattcagcctcccaagtagttgggattataggctcctgccaccacacctggctaatttttgtatttttagtagaggtggggtttcggcatgttggccaggtggtcccgaactcctgacctcaggtgatccacccgccttggcctcccaaagttctgggattacaggtgtgagccaccacgcccagcatcattagattttcaaatgatcaaagacaaggaaacaaataaatgaactttttcctatttagtcaatttgcaacagataaaggtgatttataggtttagctcttccagagatgacatatatacagagagagatcaagtttttctgtgatataaaaggtaaatgatgtaagcctcaaatcaggtatccaactaagtgaaatatttgaagggacagagagcttttcctcccttagccattgtctatagacagaatgaaagaggctttccagatctgaattaatcccaccctgtatatttaacctcaaagccaaagtgccttttatattctgtatttggttttgatcgtagtttaaaataaaatgtacttgccttcaaatctggggaagctatgaaattctaaggaacttctgtgtcacctgttacaaaatcacttcagagatacactttaaaacctgttaaaattttcagcataagatcgtgctttacaacgttttgttctggtgtggatatgagctgagagtgaatgctcctttttctccccttggtggaactgatgtatatgtgaagcgtttctggtagagtgaattgcaagtatagtctcctcaagaaggaagaagtgaaacccggagcccagaagccatgtcaagctggccttgcaagacaagatagatctgacaatgttcctcagaggacaaaggaagcatgctctagaaaactgcctggctcataattggctcgcaataaatatttgtaatatataagtcaataataaataggtcaatgcatctgagtatgtctagtgatagaaacctgtaaagtggagagagatgggcatccacactattagtgtgaattaactgaaatgcgagagaatttctctcaaggtccggcaaataagcaccttcttctcccaggactgcctggaagaagacaaataaacacagagggaatgacctagtggcccacaccaagaggaaagaccaaaaagcaggttaggaaggagtgaagaatttcacccagtttagcaatggcaccagcccaaatgactccctggctattagactaatccacttagtctcctttgttccatctcactgcagagaaagcccagtcttaggaaaagaacaggccctgaaatatgataggttagaagtaagaatgtggactctacaaactcattcattataccttcatagtcattatttctcttaatttttaaatgaaaattctaagtacattgttattaaattaagagaacaagaaaacaatacgtttgctagatgtgcaagtaatattaatgtgatacttttcccacttgctgttttatatttaactatgtgccaaatgttaaactagatgatttacatacattcttttatttatttccccagtcactatattatctcacttaacagattagaatgcttacactcagaaaggttaaatattttactacaggttacacaaggagtagtaactgagtgagaagtcaaatatttttctaacagtttccaaaataactctataaaaacatttcattcaaaacttgtgaactatataaatataaggtagtgtccctttcacacagatgtcccataagactagtgttgggctgcttcatagtagcctttagtgaatgtttattgtacaaatgataagtagagatagcagagaatttactgtgctcctagctaccagcaggggtatcagcattggctatgactattctattctaggcaataagacggaaccaaaatggttaaaacagctcaaataggtaactcaagagggaaagaacagaagatgctggacatttattcttttctgcactgggtcattttcttgaataaagtcttttatgaaacattttggaagtattttctttaaaaatctgcctgtaacaggagattttttagaagtcacaaattgctgggaatttgcagaacaagtggctgtttgaagtgtctgaggcatattgagtgatctccctatggccagaaagaagtttaagaaaaggaagtgcatgaaaaatagtttggattattgaaggttgaagaggtggttgtgtctcagggcacacttacagagcatcctgttgcagtatttaatgttgaccatctcatacctagtgcggacaaaattgtcagagaagtcagatctatctgtcagtgtgagaacgagtagctacaccgtgtgtgaaggtgataatgaacattttgatatttgtgacctcattcacctcctccaccaggaaagtttttcattctgttcatttgcccatataattgatgggtgatgactaaattaacaacacgtttccaaagcccagatacctatatagaaataaatacataaaacatttctgcactatttcatgttatgatttacaaccccatcagacagacaagcttaggcccatttttatagaacagaagactgaatttaaaagagggtaagtaacttgggacaaactggctctcttcatccatttttttagcgagttatttttgaactagtgtgtaccactgagactcgaagaattcaaagactatcttggctttgttgtacaagtgaacgtgttaaccatgcaggattcccctgatgcgagttagcataagagctccatcttatcttctcagatatgttgtcagcccaaaagactctgttgctaaatctgcaagctgtagcgttacaatttcttgattgtgttcatcatccagcagcttatggatgactatttcatgtgttctcatattagtgaattaacatttgcaaattggtttataagagttgtattagctctgcttagatgagagactcaaagttgtaattcccattattcagatgaggagatccaaacagggcagaaataaaaacccatataatacttttacttatgtagttttattagaagtatagccagagtgcttatctaacattctaaaatgctttttgactttcattaagaaaaactacttaaacataaagtgcttgtttacagacagctcaacatgactatgacatttattcactgtgcgtatatttatcagagctgaatgctctttcagttttaagctcagctagttaatgtagtcctaacaaaacaaattaacatcataatataagaattatttatcatactacctgttattccagaaaggtcgcagccaccactaaatatctcggttatgttcaaagaatacaaaacgtctttgaagtctactttttgttctactttaaatctgttattaaaaaaaaaagaaaaagaaaagtcttgaaacactgcacatttttgctaccaattttttaatggatgacttagaggataatatattgtaaaatcttttgtttttattatctcaattacattttctcacatttcacaccattttccccggctccaacaatcagctctgggttgccaataacttgcttcccagataaatggttggaggaaagagggaacagaaattgcatttttttttgaagtaacaattacccaacaaaactcggtgagaattctaagttctatctaaggtctcaattgcttggcttctttctaacaagtctaaaatttccctcttatgtattcaagatttttacaccatcaaagatggttcctggcagatgcccatgacatgatgagcagggaacaggagtccacagtccttggagaagattgttagctattaaggaagagagaaatatttataacccatcattcatctcgcccattgtcacagtcaatgagatgttctttagtgtatggacaggcctaatatcttttaaataggccctataaaaggataaaggaaggggaaccagatttctttcaaaggaaataaaagacaaaaattacaggagtgggggggggtgggcaaaaaaaaaaggaggtagccactgcttccaacactgagccgtaagttaggagactagtgtctggctcacctgtctgtgccttaatttgcctcacctgtgaaaagggaacttaaccagataatcccaaaagattttctcagccactgatcttccacgattccaagtcaaaagcaatcactgaacctcactttcccatttaaataaaagtgggggtggggggaagctagtacttattgacttcatagatgcttaaagcattaatttgcattttaaatacagatcagaaactttgtttatgaaagaaaagacacatgtaataatcttaaacagggagctatatatatttcctacatcagcaaaattccaggcaattcccaatgaggggctttgtctatgccctctgggcattgacccctgtgctccccagttagaatgcatacgctagtgctcaaggatccttgttcattcagcaggtaggcccacatctggagctagaaattaggtggggcaatcagtctaattagatcattgttttaattggaaatactgaatgagcttcttaattataattctccaaagcaatgaacatgctgtggcagaactctactgggactaaattatttcttggtaaaacaatatgtttttttggaagatggtaactcattcagaaccctatctacctgggaatggacacaacatgcacattaaaatcagctgataaagaaaatagctcattctatgccaactgctttcaccctcttccttgtaacttcctactaagaaagataatatgcagcatgatggtttgggaggttggcttttttcctgtttttattaccacagtctttaaactgaatggagtatgggcttttaaagggtggagaatatatgttctaatctacctataaatgggctataatagtccaataattttaggataatgacaaaaatactgcaagacttattacaacttctaataatgcctaattatcactggagagtcatttaagtaacagtcctgctcataatatagtccaatgaaacctacagcaataaaaacacattcagccatctaatgaatgtataatctacagccaattcctaattatccataattattggagccatgaatagccaggtgtgaagaagcactgccatgtgttaggtacttaagataaattatagtttttaatctttagaaaaatctaaggaagtcggcattatttccattaacgtataagaaaatagaagcctgaggaggttaattttcaggcttaaggttaaggtaggttccagaggtatgatttaaactcaggtctatttgaagtcaaagctaatgtgctaactgccactactttctaatcaaaatgtaattcaacaccaccatattggtcaatatatataatgtccctcttccaaagtttatgagtcttcatatttctcccagttgtggttcattttcccttttccttaatcctcctctaaaattgtcaaaagaacagcaggcaaaagtagaagaatgagcagcaaaatgctagataaacaattagcaactaaatcatgaatggaatttttagcatatgcaaataatatctatttgtttaaaagagagtaattcactcccaaatgtaaccattgtgctgaaacagatctcacaaagggaaaagctgcagaaaaatgaaaaacaatcccaatttttgttttaagaatgacctacttctggcctccaggccctgttggggaatggtattggcccttcctttccccttatccccagagttcttgtttaatgaaaaaaagtcttggatcaatttccctctgggtttgtgttatcatctgaaatcccagctttggtacagtgggcttgaatcattcttggtgtattaggctattctcacactgctataaagaaatacgagtctcaaaaaaaaaaaaagaaaagaaaagaaaagaaaagaaaaaagaaatacctgagactgggtaatttataaagaaaagaagtttaattggttcacagttccaaaggctgtacagggagcatgatgctggcatttgttggttaccagggaggtatcaggaaacttacaatcatggctgaaggcaaagaggaatgggcacatcttacatggctggaataggaggaagagaaacagggggcaggggctacacacttttgaacaaccaaatctcgtgagaactctacgatgagcacagcactgaagggggaaatttgcccccatgatcccatcactttccaccaggccccatctccaacactggggattgcaatttgacatgagatttgggtggggacataaatccaaaccatatcacttgtactgttcagagctggaaccaaccaaaccaaatcttagggttgctcatgaggagaaaaatacaacacaatctttgacaatggtggccctagatggttatgtgagtacacagtaaattctggtcactttccaatcaattacctctgtgtgtgtgtgtgtgtgtgtgtgtgtgtgtgtgtgtgtaaaataattaaaatactctattaacgtcacaggctgaatttaaaatactttcacatatgaaacatctggataatgtttaatgtatgcctagtattcccatttttatccatgtccaataggtcaaagtaaacgaacattttgtaatcactactgcagctggtcacaacgtatctattctcatatccagtctcattttccttgccttcctgccacccacacacaatttacattcacccacttatagatccaaggctggccaagcctagaattaatttctagccagcaaaaagatgatcatttatgtcctgtggtaagtgttacatcttttgaaaagtctccttggtacggctactccagatctctcatcctactgctcaccctatcactgactgtttgttctgttctgtgctccctctcttgcttgccctacagtcacctgttttcagacgtctggctgacctcttctagtattggctcagccattaattagctgtgtgaccataggcaaggtatttacctgtctccatcttgtctgtaaccttaatgtaaaactagaccttcatcaaattgattgaggaatttaatgcgatatgatggggggccacctattacaatgttggcattataatatatggccactgttagaattaaatgagtaataatacaaataatatttagctaatattgagcactaaaaattgtatacacattatctcatggaatcctcacaacactaagaggcatgtgttatcattactgcatttaacagtataagaaaaatcttagaaaagtaatttgcttaaagttatatagtaagaaagtggcagggctctgggtcttcaatattattttcagtaatctggtttcaacaattgacaaaaggtactgtgaggtgccacatcagtcaatatttttaaagaatgatatctctcacaaagactatggctattattaagataatactatacttttgaatagaactgtagtgcttaacaagtttaaaggccgagatttccaaaaattcagtgagaactataaagcctctcccaaggaaaatacatgcataaccttacatgcataaacttgcaaataatttcagggcttcaaggacccttggaagtatatcctagacctctctagaagtccatggtgcccaggtaaggactactacaaaacagcaagaattcacagccctcttgttttctagtaagttgagcctggaacccccaaacaacctatttcttcttaacccatatctagttagtcacacatttcaataatttcaccagttccttactattcccagtgaggctgctccctttaaacactctttacttaatgtccgagttgttgcagtggttttttaactgatcttttaggctttagtctttccctctttaacaaatccaggttattaccactactcagtttaaagcaacaaatcctcattgaatagctactattttttatatacatgctttttgctgcagtcacagagaggaaacatgcctagctcttcacctcaagtagcttatgggtcagaggggaagataaacaattcattttaatataactgctatgcagaaataaacacaaggtactagaactttcccaatggggagaagggaagatgcttgtatgatattgcatggagagatcagaaaggctttctaaaacccaaacttaattttaaggacaaatagaagttttatagaaaaataggaaccgttggcaggggtgggggataaatgaggaagagggaaatttttcagacaagttatccagggtgaacaattctgactactacatagatctttctaaaacactgacttaatcatttcattgtcttacttggacatattcaacaattcttcattgcatataggatttattcttcaactcttttaaaacccaactcaagtccttctttcatgaagcctttgtttacaattcatttcctgtgcactctccgtttttgtgaaccttctaatgcttacttatacgattcttttagtacttactgtacattgctgtgtagtcttagtgaatttctttctttttttttttttttttttttttgagacggagtctcactctgtcgcccaggctggagtgcagtggcatgatctgggctctctgcaagctccgcctcccaggttcacgccattttcctgcctcagcctcccgagtagctgggactacaggcgcctgccaccacgcctggctaattgtttgtatttttttttttttttttagtagagacggggtttaacggtgtgagccaggatggtctcgatctcctgacctcgtgatctgcccacctcggcctcctaaagtgccgggtctacaggcgtgagccaccgctcccggctgtcttagtgaatttcttgcacaaatcttgtactattccattttatcaataggtggtaaccatcttatcaataaggaacctattgctttacatctgtcccagcctcttgcccacagtagaatcccaatcaatgtttttgaacaggaaatacactttctaataagtatcaaactaataaggctgtgacccaatagacacgagagctgatccttctctgtcaatactcattgaatggcaatcaatttatcttctcagtgcctcagttttcttatctgtgaaatgggagaataactaagtcagatgataaaatcacaacatttgctattaaaatataaatgctaacacttcacaaagttaaaagttacttgtttatttaccttatgtgtattaaattatcatttttgcccatacacacagtttttatactatattttcagaatgattcttctacagagaagaatctggcggcgtatagcaattatgttttagattcttcaaccaaaggaagtttttttttgttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccactatgcccggctaattttttgtatttttagtagagacggggtttcaccgttttagccgggatggtctcgatctcctgacctcgtgatccgcccgcctcagcctcccaaagtgctgggactacaggcgtgagccaccgcgcccggccccaaaggaagttttattactaaaatatttaaaggatctcatactacatttagacaaagtaatatgattattttagctaacattcaactgcaggatgatgtccaaaattatatatctagtatattacagataataaataatgggaagcactcgagtattttgagatgatatcttattggcctcaattctaaactagatatacacaaaagagggaaaggagaagtatttcttaagcagtaactataatctaaatagtcactcacatgctcctttctactgtagcttaaatataaacattcttatgggtggtttttttttttttttggcatatactaactttgctaccaaagagatattttacaacaatatagaatttattacagttggtgttatgggttgaattgtgcataccccctttcccaaattcatgtgttgaagccctaacccccagtatcttttaatgtcaccttacttggaaataggaatgggccttaatccaatatgatcggtgtccttataagatatgagaacaccacacgaagacagatggctacatgacaacagaagaaataattggagtgatttatctataaggagaggaagaccaaggacttccagccactatcggaaggtaggaagaggcaaggaaggattctcctaacggtctcagtgagagcatgttgtgctgacaccttgattttgacatttagcctccagactgtgagagaatcaatttctgttgttctaagtcacctactctgttgtgttgtgctgttatagcagctctaggaaattaatgaagttgattaagctgttccaattttatcaaaatacttagttatcagtttgaaaaccatttcacatttattcagatgtaaaagaaccaccgcattcagtaataaaatataaatctgccagtctaccccaaacatttattgagcctacgttgttttctctcttctctaccaaacacatattttaaacgggtatttttctgttgtgaagaaattgttccttttgggagaaatgtatttcagaacttttaatccatgattttggtgctcaggaaacttaattcataaacaggttctgataagttaaaattgttaatgaactaaatacataagcaaattgttcctttaacaaatcagaagacattaatttagtaaaaaagtgaatgcattttacatgtaatgctgtattagtgtgattaaacaataacaaatttctgtcctctgaatttagaaagaaaaaaatctcacttttccttctctagagagaagttttgaagtaaatggctaatgtcctatttttcatgatgctatatgtatggaaaggtgggaaagcttcatcagggtcctcaaagagaataaattagagtgaccggaaagttgaattctggtttttaagatatttaaaattaaataaagagaaataatatagaatttctttccttgaaaatatttgtgtaatttaattcaataatactcatttagcacatactatataccatgaagcatgctaggaacaacagaaactaaaatgagcaagacctaacccgctgtcccagaaatcacattttaataggacagacaggaatgtgagcaagaaataaaagtgcaatgtaataagtgctatgatgtgaattttcctgaagtgttctagaaatatagataaggattggttcactctaactaggtatgtttgagtgcaataacttcaagggaaaccatggaggattaatgggaacttattggtcagacaccacagagaagggcctgccacacagaagagaaaggagtggagtctgagaattcagagaagacaatgtttctagtttggtattgactgggcagtgatctttttaacaaaaaaaaataaaataaagccgtcatttatttagcaccttttagttgccagactttgtgctatgaatagaagtatgtaatgagatactgtaactgaaactgccaagtttttaaatatcattggtggctggaatttgtatggaaatggggaatacaactgccaactattgtttttgtttctataaaaacgaagattcaaattcagcttttaaggcaaattgttcttttgtttagggaaagcaatacaatgggctttttcattttgcaagtagaaccagtgggatggagatggggaagtttgagatgacgagggcgtaagctattttatatgatatgaaaacattgttttcactgaagtctcctgctatagatgctttttttttttttggagatagggtctcgctttgctgcccaggctggagtgcagtggcaggatcacagctcactgaagccttgaacacatgggctcaagtgatcctcctgccttatcctccacggtagctgggactacaggcacacaccaccgtgtccaactaatgtttttttattttttttattttctaaagacagggtctttctttgttgctcctgctggtcttgaactcctgggctcaggagatcctcctgccttggccccccaaagtgctgggattacaggcataagccacatctggcaactatagattcttgtcacaactgggaagctggccttagagagcatggaagaaaatctgggtcaccttctctttatactgggaaatgttggaggactctgaatgctgaataggagggaggtgtaaagataactcttttaggtgaaggtgggtgctagcactgttgcaatggtaggctaagtataacaacggacagaaggagactatttggtacaagaaatagtctacactcaaggaactatcataattggtacctggttttaaattacttgctatgttgtaagtccctttcactatcaccaagatttcagtaaaatttgcttaaacattgaagttgttcttgtattagtttgctagggctgccataacaaagtactacaaactgggtatcttaaataacaaatagattgtctcacagttgcagaggctagaggtcttaaatcaagatgtcagcagtgctggattcttcagaaggccgtgagggaaaaatttgttctatgcctctcttgttgatttgtagatggccatttttttccctgtgtctcttcacatcatcttccctccatgcatatctctgtctaaattttcctttttagatgacaacagtcatgttggattagagcccggcctaatgacctaactttcattactctgtaaaaatcttgtctccaaataaggcaacattctgagttactggttagaacttcaccatatgaatttgggtggggggatgcaattcaacccataacagttgtgcttggaagaattaagagagaagtctgtgtctacactgtgggggtagtatgggaagtgtggagtgtggccctggagtggagatgctgataacaaggccaaacgttcaaagttgtctacactgtgggaatagttgtatgggaagtgtggccctagagtggagatgctgagaataaggccaaacagttcaaagttgtctacactgtgacagcttggacagatttttggactgtgaaacattcctctaaggattcctaaaaatgctgtcaaaggaaattctggtgaaagcctgtatttcttcctgtcaattgaggttggggcttatgcattattatttagactgaaaaatctagcaataagtatcattatccacattttatattgataaaaccacaactcaaaatggtcaagtgactctcctgagaccccactggtggtacatgtcacagacagttttcaaactcagtaattttttttttttgtctccaagaaagtgatcatttcaaagctaggagaagtaaatttgaaaataaacaatttaatttcaaaaaatattatttcattattagaaggtaaaccatctgtcatacacaccattataccccagtgtttggcatagtaggtgctaaaaaaaatattctttgaaaaaaagaataatatcaagtagagatattcaaatggctgggaaatgaaagagaagttggggttagagactcagattttaaaaaccagaataacagggatatttctgagagagagtaagaggaggaaaattctgaagatgaaactctgataaacatttttgcttgggaacagaaacaaaatagaagtaagtcaaggagcaggaaaaatttccagaaagagagaaagaaataagtcagtagtgtcctggggactaaaggaagaaagcttttccagaaaaaaagggatggttaataatactttgatcaagatcccagagttaggatgagagaagtagaggatacttctttctccacaatatcaaagaaggtaaagaaagagaagattaataaagatttacataaattttgaggtgatttctataaatagagaggagaaagtttacctgatgataggttttctttacgatatagaagactggcacacttgttggaagtaagagaaatcaacctagagtagtaagtgaaggagagaagtaatgtcctggtatggtgtgggtaggagtaaagaaggttctctagagtaaggaaggagtgctgagctctagtctcggtaaagccagaggtgactcctttccaggtttttgctccaacaaaatcaacagttgcagtagttgcagtagttgaagaacaggagtggctttttttttttttttttttttggatactgggtctcaccctgttgccaggctggagtgcagtggcgcagtctcagctcactgcaaacctctacctcccaggttcaactgattctcttgcctcagcctcccaagtagctgggattacaggcacctgccaccatgcccagctaattttggtgtttttagtaaagacagaatttcaccacattagccagtctggactcgaactcctgacctcagatgatctgcccgcctcagcctcccaaagtgctgtgattacagtcatgagccaccatgcctggccaggagtggcttgttgagtggactcagaattgaggatagttgagaagagaattaggaaagggataaaggagacaaaaacattaaaaatgttaatgagactatgactgaaataactaatgactagatcctggctgagtggaaaaggaagtaaaaaccaagaggtttaagagaccaatggccagaaacaggggagcacaaaacagttggggcttgatgagtttgaaaggaaatttagaaataaaacgacagtatataatctattacacataaatctctttttataagtttgggtagagtgtgaattgagtcatttgggcacacctttctttttgaagtttcttctgtcccttaggagcatgatgttaaaaatttagttcataattattgcttcctgagataaccctttcaatttccattttgtactaactacctaaaattgactataggattctgtttataattcaatgattgttagagcactgtccgtcaaagtgatataacatatctttcaattgtgtaaaacataccattataattatttttttcttaataagagataaatattaaaaattccagtcaggaaaaaagtggagaaaattagcataataaaaagacaataattccttctaatcccaacattctaattttaagacatatacttatcttttacagagaaaactaagcacttaaattcagttcttctcatggtaaagcaatgctagcacaggtaagccctgctttagtatccaaaagtagagtaaaatttccaaatacatttgtattttcatttgtgtcaatagacttttcaagtatttgttacctttcagctgactgctcaaattcctatgtgagtggaaacgtaagaactcgtataataaaataacatcaccaacctagggaggcttatttctacttcctcttcttgcatctcagagagccattttaggatttgttgagcagtaattagtttttccacttcttctatatccataccttctgcaggaagtatgataattaagctaaattcatcacctttgtaagacaattctaaaacttggtagttcagggaagattcagaaaaataacctggaatagacaaaataaaatatcaaatatacttggcaattctcaagactatgcttaggaactgtggtttctcacattaccatattttgttctcagaagagccttcatcattggaattttgacagttgaaccatttttcttagtaaaatttatcagctgtgtgtcctcttttctgaatttctgtttccaatctcctttgaaataaatagcattcaccaggacaagccgagtcagagggccaaattcttcccctgaaaacatgtctttaatttttcctaggaagtgggtggaggaggaggtaagaagaaatgtgcaatagtgattcagtggaattgctttgaatagaattaaagcaaaagtgtcttttgcagatcagttttggatagggcatgttatcatctaaatatggtaattttgagaatagacgggattgctgttaaatatttcatgaagaaacaggtgcaaatggaatttcactacgaaattagaaatatgagactgttttaggcaaactcagatatacctagactctccaataagatcatttgtaaccattgtatgtcagacataaagaataaaaatattacttcttccatatttactggtattattccatctatttcaaggtcttctaaaatgtcagtcatcataagtaagttaatggtacacccaaacttgccattctgacagctgtgtccactgaccattggaaagggaaaagaatggaggatactagtatgatccttttcctccaaataactggtctcctatttctatgtccagtgagtttttccaagttatgagaaataggcatgactgggtgccatggagctgtctagtgatgtcctcatttcctacagctgtgaacatggctcaccacgcttatctcacactttcaacttatgcttccccatataaggcttcctataaggcatatgtcttataacatcacatttttcatagctgattaaataaagaaacaaagtactattaattgagggcttggtatatgcttgtcacttcacatacattattattaaaactccaaagaattctgaaatgttttaataatatcctcattttaaatggagcatagcttataactttctaagatttcaactcagatttatatgaatttgaatttactatatccctctgtagtcaactatgaaattttttgctagcttgcatttaaagtgtagactaccatgtttatgatagaaatattaacatttattattaaatattaacacattcaactaaaatatgataatcattttcagcatctgtgggaaagaaggcatttgggattgacagatttaacttctacctggccaaagagattatttctgcttttatgcctgaaaaatctatgttttaacaaaaattattattaaaattatttcattaaaaattctataagcaggtatctctcaaaagaaaataaaagaatcagtattcttttcaaagcagcttataatttctttccagttttacaatttaatattaatttaaataactatgaaatgaaataggatatttgattcctctgatccatactgcagtaggaaaatattcagccattctttactttaggatattaaaaaccatgaatacaatggcaaataataattttatgaaaatgggaaactttaccatctgtttttctttctacccaggtacttatcatctctgcacaagcctttgcatcttgaaaatccaccagttttatagcactctgaaaaaattccttgttgccatggagatactgttctttcacagtgaatccttcttgaaggtagagggcattggcaagattaaatgtaaattcttgttttttctctgagatggcagagaaaaatgacttcagtacaaaaaattcttcccctagaaaataattttaatgtatattggcatattgaacaacataaaaacaacagcttttcagctttgctatctaagtactctgattcatatcaccgttttttgcacccttaggtataactaacaatcccttcaaagttagtataaatattttaaggatgtatctcctgtagaatatgcattttgtagagaaatcatcttttatatagaaaaaagaatgtccatgcaaatttgaaatttgtcaaaaaaaagaatatgcatttatagaagctgaaggaaagtccctcttgatagtcacatttagcgcatttttagttattgaaatttatgtttagaatcttatttgcataacgtgagcatgtgatacctatgaaaagggaatgctaatgaatgctgatgggggcatgacagtgatgagcaatccttttcaatattacttttatttcagctgaagaaaaaattgttctcttataagcaactgcacctgtacaggttttaaattttacaaggcaacctctgtaatcatctctagagatgcgtaagaatcagaattgcctatttctacaagttcatgaatttatatactttggctgtcgacatcaacaataaaaatctttaaccattttaactctaaccactagccaaaataagtcagtcagggtcaactaaaagaatcactttcggcctattatttatttttggactgttctgactgtagtgttgtctggaagctatatatgcgtatgagagaactctaccctgatattaggttcaatagcttcctgttcattgcaaaagtgtaccaacagttttcatttccttctggcttaatcttagaactcaatcattaagtcttgtaactctatttcaaataggttctttctgggccttcattatattttcagttaaatactgcaaatgccactttcataacctaaaattgatatattcaattaatctttattcaagaaaaccgggtattactaagagggacttactactagatttctactggaaataaggaggatgtgtgtgtgtgtgtacctaagcttgtgtaaatacatttttttttttaaatcagaaagctagcagcccataggtcatctttgtgcaaataaaaatagttccctctctgggggctgggcagctccatggcctctcatcttgtccagctgggttacagaggctacatttcagtccctacttgcctttttggcctggcgttctcacagcctcacaggaggctctatgaagtatactgcattatatttcaaactccaggattctctgttcactggtatatagatacaggtataaacaatttcagatataaaaaaaacttacttccatatgattagatctgaagaatttcagtaattctttataaccctgaaattccttacataaggaagggaagaaagttaagccattttacttatttgtacaatgatttcagatgtaaccatttattgctatctgaagcctgaaacaaatatctcaatagctgggaggctacagaaaaggctttctgagtaaagacacgagagcttttccaaaagaattaattaaggtcagaaatgaagtgacagaatctgaaactaattttcagaaatctgaaatacatgaacatctttaaaggaataaaaaaagagagaaagggagaaaaagtagttccaaatcatttgtcaaagcaaatagatttatgtcatgtacttaaggtctaagtctatgtgacaaacagctgccctttgataaactgttgaactcagaagtcaatgaaaaaaatgtcactaagtagtacaagtttggagaagaatataacattatctgccctataaattttatttcgtttctagattaatgacatttttagcacagatcaaaaattatatatctcctaataagtaatgacaacaagtttatttcattttctaaaatagagccatggataacccacaggtcatgggtgaatgtggctcttgatttgattgtaccagacctccagaaaatgttctaaaattcagtgcatgttctcttctgctagtaaaagtctaaaagccaattttgtgtgcatatgggagatccaaagatgaaaacaaacgtagtcgtagaattatagattatttcagccaaaaggtccaaataaattacctaacctcaacttttctttttacagtgaggaatctgaggcccagagagattaagaagcttcacaagtgacatgacttgtgccaaatcacaaggtcatttagttgcagaactgggacaggaattcatgcccagttctcttttcaaaaccctgtggaaaaaagaagcacattgaatttagcctttgattcgtcatcagcattatcagaggtaaagcaaaagggagtattaacagatgttcagcaaaatggaggaggtaaattcagagcagatgttttgacaatgaagtaaagaaggagaactgaggacactgagagccttacataatatatgagaattaatattcttattaatatattagtgagaatatattgctcttatattcttaatcctcactgaattattttaggaattagcactgagcaaattatttaacctttctttgcctcagttttctcaggtttattacaaggttgtttacttaacaaagtaattataaatattaaatgagagaatatatattaagcacatgaaacagtggctgatatcctttctatatttttgatagtgcgttattactattactttatcatgttcacaattcacacctgttaaaacttctgtgtttctctatatcatgtatccatttaaagtaatttaagttttcagagactctaatttatgtatcttcacaaatattgtattactttttcaaagctatagcatgtggtttaaacgtttctgggagtggtatattgggatttgctgaaattaatcaagactaaatctggaatacattggcttcagtgtgcactatttgcaaagaaaaattcttacaattaacttcacttcactattaccaacgtcttttctgtataaaattgtctttatttaaaatgaagcaaataaaatcttgtaaatagtattttcaggaaagcaaatttctaaatactgctactctgtgataagaaaaatacactgaaattatagttgtagcaactaaattcccaaatcaaaaatctgtatttagaacacagtatctcagagtaatccaaaagctgaaaattaaaacaactatagaaactgagagcatgagatagctgaggagatgagcaacaactttttttttttttttttttttttttttttggagaaggagtctgttcttttgccctggctggagtgcagtggcacgatctcagctcactgcaacctctgcctcttgggttcaagcacttctcctgccttagcctctcaagtagctgagactataggcacatgccaccatgccttgcaaatttttgtatttttccagcctggtctcgaactcctgacctcaagtgatccacctgcctcagcctcccaaagtgctgagattacatgtgtgagccaccacaccagccaagcaacaattctttcaaatgggatgccagcacaaaagcacagtatcccagtaagagggatagacactatcccagacagtccatgaggagactccaacaaaacaatcatcattcacaagcacaaaggcctctgattatttaaatccttttttttccattttccttttaaaactagtaacaaataagcttttaaaatgaacaaattaatgttttttcttggtctcgttacagatgaggtgcattttttttaagagaaatgttggaaacaacctactgaagaaaggctaagtaagtaatggtacttctataagaggcaataagatacagtaattaaaaatcatattttgaatcagttccatgacatgggaaaatgatcacaacatagtgatagtggaagaatatgtatgtgtatagatgtatattttatgagtatgtacatacacacacacacatgcacgcccagtataatctcaagtaattaaaactggctaaaacaaactaaaagaaaatgtacaaatatttacttaattttacatttatatagatgtcaatttcttaataatttttgtaaccttttaaaggaattaattataaatgaatgaaaattacatttacaattctccattttattacaattttgtacttttcattacattttcacttattaaaatttctttatcctgaacttctaatattaaaaaatgaatgcgtccatatcttatccagtataagtaaggagatgtaagagtctcaccagctgaggtttcctgttgttttaaagtttgtcttatctgctgctgtgcttttcctttggctcccagttgtaccatctcaagaaccaaagttattccaaggggtgaaaatataatgttgtccttatgagataaggaaacctcttgataaagatccactgcaaattcggtatttttttgagctgagcatcttgaggcttgacttccaaaaaacagcaatagaagactccacaagaagattgtgtccattttgacttctctgtattgtttaaatcaaaatatattcattttcaaaatagagttttccacagagagctcaacagaaaactttctacctgttgtagctttctatcttaatagaacttactaccacaagtgaactctatccaattagatttctaagtatcatctattcagaaaaatagttcatgtgttaatggtatttcttacatatcttcaagaaccagtagaaaatatacttgtagttttgtagcaaaaatcaaaaaagacactacaatgttggaatgttatcaatggcaatggtatctccaaatagttatacaatagtttttttctatcttttctcatggttaagtgggataactgtaactctgacatcaggtaaaccttctgtgctgtctactctacagtaatttatagatcaagaggaagaaatggaataaaaacagacttactccagtgtggttttagacctataatattagaaaattaatgtattctaaagcaactgagtaatctggctaactttttacaattttcctcacgctttatttcttaggacaaaataacccaaagccctcttcctgcttttccaaaagaagacaaatacaatgcagaaaacctgcaaagtttgaaacaaaatggcaatcaaatataaatgatacaataaagtactatgctcactacctgggtgatgagatcatttataccccaaaccttagtgtcaggccatatacccatgtagcaaacctgcacatgtacattaatctgtaataaaacttgaaattataaaagaaaaaatataaataaaatgaaatataatatcaaagaattgacagaaatactaacaaatgtaagagtagcagcaattaaaaaccataaacaattcacaagactaataataccctattaaagtgctctccactaaaattgcaggaaattcaaccatttgattatatctcaagcagaattagttttgcaatattaccacatatttggtagaatgttgactccaaggcctcataaattttagtaacaataattttaccttataaataatacatgttagtaatccttaaaaacttatccatcagtaagttactaggaagtaacccttaattaggggtaaagatgaaagcctttagaatagtctgttgtcagccttaagtagagacttacatttctagagtgttttgcagatcattaagggtaccataaatggtaggagtccctaagaacaactatatttatatataaagattactaatagtcaaatattgttccaaattaaactatggagtcattatttatccttcaatgtattttgttaaactgtatttgtttagatatatatttgcaaaagacaaaagcctcaaaaaacaatccaaagcaattgttagaaaatgtgttggtaaactttagatatagacctatatgctattaatatcaagcaaatgtttcattagggattaatttagcatatgagcttataaatgagagtgcaacaatagttaaaaaccagtgagtaagagaagttttacatgcaaaataaatgtctgtgtatcattatcttctaatatattcaatttctcagaagacttctgaccaaaatatgtgtttgtagatacgtagtcaaaatgttattagtacctttaagttatcaactggaaatacattagatatagctttatgtatttggtttatattggaataatgaacagtattattaaaaatgtaatttttttctttgtggtagaatctcagtattagagtttccttctcattattattaataatcttaataattaaatttatattatttgagcatccacatccattttttctagaaaatttctaagcacttaataaattataacctcagacaaatattggttttaaaaactcacttacctcatcaggttttggatcatatcttatcagaaagcacaaagtaatgctgaactaaacaacctgatgaatagtcctataagaactggatcttctgatttgtggtgaaatcatttaaggagaataaaagcgatatgttaattaaataaattcaaatgatttttacaccaaagtaaattgaaatgccattccatactctactaaacattcataggcaatgttattgcatacatacttattcaaaagctatttatttctaaggtacttaccccaaactgacttctgattattcactggaatgttacaactaaaatacgcttgctggaaaactcttgtacataaacacctgagcgatcaaggccaactccatttatcttgaccattgcttgattaattcctctagaacaaaagcaggtgttcactacatttgtattaagaactaacacaatcgggttaatgatcaactgatgaaatgtgcaagaattgagaaaaaaacaattatagaattttttaaaagtattaaatttatattattattttatccattattttgcttcttttaaaagttgcacagaatttgaaaggatgcgctactggttgtaaatttgctagtaattagttctttttgtttctcacaggactcctacatcagattaccaatgcactttgtcataaatatttcagaatgcctatgagaaaaagaataaagctaaatcaagtccagaatacagagacaaatcactgctgcattgacagagttctcaacattcatcaaattatacaatagtcagaggagtttcctgtggatataaggtccatttgaatccttaagaaaaagagtggatattgaagaaatatgttctttattctgagcagaaaggccagcaaaaaagataatggatttgccaaaatatatcaggacaatactattagccataggtaattggatgataaaaattgctgttacctttatgtgcttttgaaactctacatgattttctttgcaaaaaggtcattaataaaaaattgcataatttaatgggtttcatctcatttttgtagttcaaatcaatcacctcaatggcaatcagatattaagcacattgtattatttatctatagcctttgagaagagaaaaaaaatttagttcacttttaattaaatatctgttgatccccaaatttaatactatttctgataaactcatgtaaaagaaataaagtgaatatagatagctttaaatggaattcatttttaaaaacttgtcagaggaccctgttaacatctttccatgtcctaacatggctataacttaaaaataggcctgagaatagatcattataggccataatctactaattaactaaaattttttgatttcccatataggcatctccaaatgttttctagatcttgagttttattctaatattacctactctatcataagcacactctagtgtagctttaacttaacacagagataattttccaaaaagagttgtgcaatacaagaatactatcattctacttgcttcacactgcaatacataaatattaagtctgaatgtcaagactatcattcaatcaatgcttttctacccatttactgacaccagcaaacatatatcaccagtacccttggctaccacatcattatgtctgtacactgctcagatcacaatgtgatttatccagaaatagtccattacttttcctaccaatggcagagaccgtcactctgtcctactaagaccatttaatgaaattgttctgtaaggaccttatattagagcagttcaggcagaatgttcattttcctgtctcttgaggagtaaaaagcaatagccataaatttattctccctggtttaacctcttttaatagacaatgacgacaatacaattgtccataaaatattaccacaaatttttaaaatattttcccaaaccgcttttttctacaattctattttgctcctagaaaatcggggtggggggagaattattcattaatgagagccaacgtgtcttggtagaaggttgatcgccattactgtccgactgtaaagtataagcctaggaatatatataaaaaccacagcaaagggttacagttatcatctcatcaattttcttatccttttatagttttttcaagtaaaagtgcacttaattccaaactttaaaaatgtataagcaaatgccctcatcagtaaagaacttaaaagttaattcttccatttaagcatggactcatttcaggcaattttttttggtaagattgttcctaaattttgagtgataataggaaaatgttctgacaaaagaaaatgttaaattatatttagtgtaaatataagtaatacaaacaaggtagcctattgaaaattatgacatatcctattttaatgtgaccaattccttttaccacagaaaaatggatcataagtaattgaatctgaatgttaatttcagaaacagtttataatgccttcagttctgttaagagttgacaggtgagatcctgctacctgcctagaaaattagatgctgtgagttacaaaagaagagtaagacacagaaaaaaagacattgtcttttttcttctttttgtgttttttctccaaattattagaaacagttaccttgaaagtctcatacctttaaaagttctcttctcattgaatatatttatgagacagctcttcttaattccttttacagaagaagccctgatgttaattaaggatggaattagagttacagcataataccatgcacatgtagtaggctatagagagaaggtctgtctgtatgaaccagactatctcaggctatcacatcaaacaaagttatcttcaagggtaaacagtaaagtatatctagcaaaagaattcccaaattagactggaaaaaatatgccagattatgaatttccaacttatgccagtgggctcatttagtattggcttaataaaccactacattttatatagcttcacttcagaacgctgagggtagaaaaggtgcattctatttatatgtgaatacccggaacctaaaataatctcttatacatgccttcaatacttacatgagggatggacggatcagtggggaaaagagcctttgcaaattatttggtacccgcattctacttttataacatcttaacattccattaaatttctgggcatgtggctcagatttcactccattgtactatcaccaacctatgattcataaatcatgtgctctgagtttgaaatgatggattacccagtcaaacctcctacccagtgcaagaagtctttgcaatatccccgtgagacagttacccagtgtctgcttgaacatctcaaataatctttttgttcaaaagcaactttttatattttaaaaaaatttaccttgaaatactttcaaatttacataaaagttgcagatatagttcaaagaactgctatctccacctcctcctctttccccaattgttagcatctaccgcatgtgtgtgtttcatctatgtatctatcctcccaataagcaaacagatgtaaatatagatatgtatatgtgttacctgtgtgtgcatatatatacattttatatatacatataattagtattttctgaatcattttatagcaagctaaaaacataatttctatcatacttaaacattctattattatatttttctaaaacaaggacacttcttgtacatcatcacaccacccaacagacaaacacacacgcacacacacacagagacaaatatacttttctcctacaatctttcctgcatgtaattttcattccatgaggaggaaaggcgatatgaatagaagtcataatgcctaactcagaatacacttaaatgtagttagaataggcagctgtcttctgaaagtccttccatcaccgccttctccaccaaaccaaaatatttgctccactggtgctggaaagtctagtgttagaattcattccattggctttatactaataagaagcaagtgtacagaatgatgaatggcaaataccatggtttgggagtaaaacagacctgggttccaatctcaactctgccattgataattgagcactctcctaatagattcgcatctcatattttagctctaagctaatatattcatatgattattgtgtggtttaaacacaatggacatttgcagttgctataccaagtggtcccctacctattgcaaattattttcctttactacatgtgttattgaaaaattcttcttaaactttagctggttttgaaagcactctttaaaatataaatatacagtaagtcattatagttatgtaaatgaatttaccaattctttctataggacacaataaataaagcagaataataatattgcctggaagatgattatatttgtaaataaaaatgggtcaacaaacagaggcagtaagttaaagaaccaaatatttcccacttgactttccacatagagtgggtcctttatatagccccaggccctttgattttttttcaagactattacatcttcaatgtgctatggcattcaattttaaagtacagtataacaaactattgaagtagatcatatgcagtaattttccaataagtttatagaatgaataaaagccaataagaattaacaggaagtggtgctattgacaaagtctaatcaccattatgagaatcatttaaaaactactagaaagtgtaaaaaagtggaaacagttttcttattcacatttgtagatatttactccgtcagtacttttcatatatttcaatgcaggttttacaatgaaaactgatcaaaagtgtttgtctataggaacaaccagaagggcaactggttagaactttgttctggaatcataaagtttttatataaaaatccttgagaataaataccaagatgttgctcccactttagttcaatatttattttattaagaatacagagaaattgacagatgatagataaaagcagtactaaattatcccatgaagagaaaacttcctgaagtttaaatataaaataaaataaaaggcagaattcttgatgctttttctgcattttatatctgtaccttatgtaacagtgaaggtttttctgttgtaattacttcttatttttcttcacttcacaacttttttcttggcataattgcttggcttttcgttcatgatgcagaatttccttgggaaacaggtttttctcatcaaatacagctttcaaagctacaaaatgatgaggaaaatcacaagtgaattatatttgttaagagacctatttaaatgaaatagtggggagaaaattctcaaattttgctttttctaaaaatctttgtttctaaaacacagagtgtatttggaaaaattttctctaagcttctgctattctgtttactgcaatttacatctaaaagttaaattttggtagagtttgttcttttaatgcatatatcttaatagaaatccaccattctaagggtagaggattatagaagttcctgttttccatttttgttttttaatctacttaacagctatcaagacataaagagccaagaaaaaattattctgtattgaaataaggcaattaaaatagtcaaaacacagtttgactgtctgcatgaataaacaagcgcatctataatcacgtccataggggtttgcagttttaggaaaaaaaagaaccaaattatttccatgagtggttatattgcgcatcagtgagaagtaggaggaaattgtgccatacattctagaaaataattttggcattttgcataattttattatttaaacaaatgcttattgaatgtctattatacacaatgttctgtgttgaggcataaatgaggcacaaatatgactaagtcacaacctttcttccaattggtggaaactagaagcagtacccaaataaccaaaacatcatatacaataagatatcattccaagagaatataagcaatgcaaactgtgtataaacatgtaaaagatattataacaatatataaagattttttaaaaagctttaagaattaggtacttatttgaggtaggtcttgaattccagataggactttaattgagaataagaaacatggaggtggggaagaattggcaagggttggataggaagtgtcaactggaggaaacaaggtgaataaagcatggaaaaaaaggccgggcacggtggctcacgcctataatcccagcaatttgggaggccgaggcaggtgaattgcctgaggtcaggagttcgagactagcctggccaatttagtgaaaccccgtctctaccaaaaatacaaaaaaataagccaggcatggtggcaggcgcctgtaatctcagctactcgggaggccagctactcgggaggctgaggtaggagaattgcttgaacccaggaggcagagtttgcagtgagccgagatcaagccatcgcactccagcccaagcaacagagagagactctgtctaaaaaaaaaaaaaaaaaaaaaaaaggaaaaataataactactattagaataactctgaataattcagtacaatttaaaagaagcataaaatatgtgaaagaaagtaaagtggaataaatttggagctggacctaggaacactttaaacaccaaccaaagcatatgaaattaaaaagtaaacattgaatgactttacagtatagtggcatctttatatatttggattaaacacaaaacgaaacaaaaactttccacttccagtgtaaactatactgtagagaggaagttatatagaccttggctacaaaagtcaagatctttcctcttcttctcatggaaattatatgaaagcaaccaggaaaattacagataataactttgcaaataaattctactttaagcaaaactcaaagagagatgtaatctgcagcttacaaaatataaagaagcaaaacagctgagataggacaaaagttgcccaagaaaaagtgaaaagtatagagagtatacgaaggccagcagcagcatcttagaatgtgctgggaaaaaaatagtcactgtgagttacaggctcaccatgaagtacaaatgctttatcccttatatacatggatgctaaaaagaggtgaacatggttggaagcagaagctctctgggacctggtttggatcggtgaaatagatgagtcagggctacctgtatcacacacatgagtcattttttgctaaagcagtctgtccccatgggttgtaaaacttgaaggataccctgatctcacatcccagcctcttactcaaggatttaccacatatttcaagcaaaaaaaaaaaaaatcacctcattaaagctaattaattaaaagaggaaagttttaaaatgaacacagcatgaacacaaacttatataagcaaaaactaaaaccaatcaaattgaagaaagagcagcaaaactaatcaatacatgagccaccaccaaaaaatattgccattgcacaaacattgttaccaagcattttgacaaaaattaaattttaaaaattaaaacagcagttgcctctatgaaggaagatcacagagcagaagtgaaaaaactaagggaggagatgaagacacaagaggaagtgatgaaatatgaggtagcaaaactcagaaaaagagggaaaaaatcacaagggagaacagagttcctggaacatagtaggaaacctagaatatagaaatgagaaaaaatatataataaaatgaaaattataaacagaatgaattagaaaaataataaatgttgaagacagacaaaaaatagatcaacaaacatataattagagtaggtacttgtattaattcgctttcacactgctgataaagacacacccgaaactggggataaaaaagctttaattggacttaatagtttcacatggccggggaggtctcagaatcatggcagaaggcaaaaagcacttcttacatggcagcagcaagagagaaatgaggaagaaacaaatgtggaaacccttgataaacccatcagatctcatgaaagttattcactatcacgagaatagcacgagaaagactggcccgcatgattcaattacctccccctaggtccctcccacagcacatgggaattctgggagatacaattcaaattgagatttgaatgggaatacagccaaaccatatcagtacttaagaaagaaaaccaaagtataacaaatatttaaaggcatcatttaataaaggtcctcaaataaaagtcaacctgacatatgttgaaaggacacattgtgtactaggaataattgacttagaatactcaaaaccaagtgatatcccagtaatgttattagactttagagataaagaggaaatcttctggcaaccacacaaaataatcaagtcacctaaaaaggagaaaagtatcttgcattagatattttatagaaatgaccaacaccagaaaagagtagagcaatgcctacaagataatcagggaaagaatatgtaagctaagaatattacatacattcaagttgtccttcaaatccaaaaactataaatggtgtcaatatgcaagaaatttagggattattgttcccaagagtcctctttgaggaaatttcaaaaagctaaactgaggccaggagtggtgactcacgcctgtaatcccaacactttgggaggccgaggcgggcggatcatgaggtcaggagatccagaccatcctggctaacatggtgaaaccccgtctctactaaaaaaaaaaaaaaatacaaaaaattagtcgggcctggtggtgggcgcctgtggtcccagctactcgggaggctgaggcaggagaatggcgtgaacccgggaggcagagcttgcagtgagttgagatcgtgccattgcactccagcctgggcgacagaacgagactctgtctcaaaaaaaaaaaaaaagctaaactgagaaatgacagagaaaattttgaaaaaaataacttgctggtgatcactgaatgtatttaagtgcagaagtaaaatggaaacaatgtggagttaaggctgacaaaaatagaaggtaaagtccatgtgcctgacaatgtataaatgatacaattgacaaaaattgtgagcataaaggagaaagaaaccttgtttatgataaatcagagacaaagaataacactgaaaactgacaaatcaactaatagcagtataagcaaatttaacaaaataaaagtaagcataaagaaaatcatgttatggaataaaattgtgtggtagaaggggggtaggagaaggagaaaacaagttcattctatcattactgagcatacatctaatagtgtcttagagaaatgaagaactagagcaataagatgaaaatgaataaatctgcaactggcattaagcagagataaaatgaaagatagtattttccatttgcctaataccagcagtatgagataatgtggataactgtacatcagcagctgatcctgtcccatatgactgcagattagcactttagaatcacaagcaattcagaatgcctttgagcccttctgaaatatattgtaaaagccagaatgttacttccgaaattctgttttattgagatttgtctctcaactagacgacaaattttcattgtaattgactgggtttcaaggccattaacccaatagctaactgataagtctgtaagatattaagagagacgaactcacttggatgactcatttttaattttttttctttttagttaacaaacagattataaaaagtacatatgcaggggtggatccctgtttcttgggcctgaaagttacaattttggtagctctctttagaaaaacagaatataaaattacaaatataaatttatttataaaagtggctatttaagataaaataaatttcaacaaattactagtaatttttagagttaggtccttttctcctgagatctctttttaaaaagatacctgaaatgcttacctggaaatgattgttgcttgtaaccttgcttctgctcttcacctagaacactctcaaactcctagcaatttctaatactcaaagggtctttatagatgaggcccagaaaacctaaccttcattagcttcatttgtaaatctatatgtggcaaaaatgatgtcattaacttaacatcttttaaatgcgtaatggtaatcaattcttctcactattcatagtaacatctgctaagttaatggcataatgattttttatgatactcaacagagtatgcagtagatcataatacatg

SEQ ID NO: 1318 - DNA, 62170 bp, Homo sapiens
cccaatagtcccccaaagtcttaactcattgcagcattaactcaaaagtccacagtccaaagtctcatctgagacaagtcaagtcccttcctcctatgagcctgtaaaatcaaaagcaagttagttacttcctagatacaaggggaattgggtaattcctagatacaggcattgggtaagtatacccattccaaatgagagaaattggccaaaacaaaggggatacaggtcccatgcaagtccaaaatccaatggagcagtcaagtcttgaagctctgaaataatttcctttgactccatgtctcactttcaggtcatgctgatacaaggggtgggctcccacggccttgagcagctccacccctgtggctttgcaggttacagccccccaactccctcctgctttcactggtgttgagtgtctgcagcttttccaggcacacagtgcaagctgttggtggatctactattctggggtctggaagatgatggccctcttctcacagctccactaggcagtgccccagtgggtactctgtgtggtggctgcaactccacattccccttcctcactgacctagcagagattctccatgagggcccacccctgtagcaacttctacctggacatcaaggcatttccatacaccctctgaaatcgaggtggaggttcccaaacctcaattcttgacttctgggcacctgcaggctcaacaccaaatggaagctgccaaggattgggacttgcaccctctgaagccacacgctgagctgtatcttggcctcttttagacacagctggagtggctggcacacaggccacaaagtccctaagctgcacagagcaggggggccctaggtctgacccaagaaaccattttttcctcctactgctccaagcctttgatgggaggggctgctacaaaggtctctgacatgccctagagacagtgtccccattgtcttggggagtaacatttggctcctagctacttatgcaaatttccacagtggcttggatttctcctcagaaaggaagtttttcttttctattgcatcatcagaccgcaaattttcctaacttttatgctctccttcccttttaaacagaagttccaattccaagccatgtatttgtgaataaataaaactgaatgcttttagcagcacccaagtcacctcttgaacgctttgctgcttagaaatttcttccacccgatgccctgaatcttctctctcaagctcaaagttccacaaatctctatggcaggggcaaaatgccaccagtctctttgctaaagcataacaaaagtcacctctgctccagttctcaacaagttcctcatctccatctgagaccacttaagcctggacttcattgttcatgtcactatcagtcattcaacaagtatctaggaagttccaaactgtcccacatcttcctatcttcttctgagctctccaaactgttccaacctctgcctgttacctagttacaaagtcacttctacattttcaggtatctctacagcagcaccccattacctggtaaggactgaattctgattttttttttaaatcttgaacaaattcctatctaaggggccaggggagtcatgccctacatatcataaactcatcagataaattttgtttaaccctatatattgtgacttactttccaacctgactttggcataacattacaagacaaggaataaaatacaaatattttaccccaaaacatgtttctttgcatattttgaaatggtcctgcaaagctgttctttgtgggggaaaatttgcatctgtaaagaatctctgttaacatagctagatctttgtcttccagaccctcccaatcctaaagagattaactaagatctgaataggaaatatttgtcatctattttctctaagggcagccactataaaacttcaaaagaactttggtctccacaatctttatcctttttttttttaaattacactttaagttctagagtacatgtgcacaacgtgcaggtttgatacataggtatacatgtgccatgttggtttgctgtacccattaattcatcatttatactgggtatttctcctaatgctatccctccctcagccccccaccccacaacaggccctggtgtgtgatgtttcctccctgtgttcaagtgttctcattgttcaattcccacctatgggtgagaacatgtggtatttggttttctgtccttgtgaagtttgctcagaatgatggtttccagcttcatccatgtccctgcaaaggatatgaactcatccttttttatggctgcatagtttccatggtgtatatgtgccacattttcttattccagtctatcattgttggacatttgggttggttccaagtctttgctattgtgaatagtgctgcaataaacatacatgtgcatgtgtctttatagtaacaagatttataatcctttgggtatatacccagtaatgggatcactgggtcaaatggtatttctagttctagatcattgaggaattgccacactgtcttccacaatggttgaactaatttacactcccaccaacagtgtaaaagcattcctatttctccacatcctcttcagcatctgttgtttcctgactttttaatgattgccattctaacttgtgtgagatggtatctcattgtggttttgatttgcatttctctgatgaccagtgttgatgagcattttttcatttgtctgttggctgcataaatgtcctcttttgagaagcgtctgtccatatcctttgcccactttttgatggggttgtttttttcttgtaaatttgtttgagatctttgtagattttggatattagccctttgtcagatgggtagattgcaaaagttttctcccattctgtaggttgcctgttcactctgatggtagtttttttttgctgtgcagaagccctttaattagatcccatttgtctattttggcttttgttgctactgcttttgctgttttagtcatgaagtccttgcccatgcctatgtcctgaatggtattgtttaggttttcttctagggtttttatggtttcaggtgtaacatttaagtttttaatccatctggaattaatttttgtataaggtgtaaggaaggtatccagtttcagctttctacatatggctaggcagttttcccagcaccatttattaagtagggaatcctttccccatttcttgtttttgttaggtttgtcaaagatcagatggttgtagatgtgtggtgttatttctgaggcctctgttctgttccatttgtctatatatctgttttggtaccagtaccatgctgttttggttactgtagccttgtagtatagtttgaagtcaggtagcgtgatgtctccagctttgttcttttggcttaggattgtctcagcaatgtgggttcttttttggttccatattaactttaaagtagttttttccaattctctgaataaagtcattggtagcttgatagggatggcattgaatctacaaattaccattggcagtatggccattttcacgatattgattcttcctatccatgagcatggaatgttcttccattgtttgtgtcctcttttatttccttgagccgtggtttgtatctctccttgaagaggtccttcgcatcccttgtaagttgtatttctaagtattttattctgtttgtagcaattgtgaatgggatttcactcatgatttggctctctgtttgtctgttaatggtgtataggaatgcttgtgatttttgcatgttgactttgtatcctgagactttgctgaagttgcttatcagcttaaggagattttgggctgagatgatggggttttctaaatatacaatcacgtcacctgcaaacagggaaaatttgacttcgtcttttcctaattgaatagcctttatttctttctcttgcctgattgccctggccagaactttcaacattatactgaataggagtggtgagagagggcatccctgtcttgtgccagttttcaaagggaatgcttccagtttttgcccattcaatatgatattggctgtgggtttgtgataaatagctcttactattttgagatacgtcccatcaacacctagtttattgagagtttttagcatgaagcgctgttgaattttgccaaaagccttttctgcatctattgagataatcatgtggtttttgtctttggttctgcttatgtaatggattacatttattgatttgggtatgttgaaccagccttgcatcccagggatgaagccaacttgatcgtgctgggtaagctttttgatgtgctgctggattcggttttccagtattttattgaggatttttgcattgatgttcatcagggatattggtctaaaattcttttttttgttgtgtctctgccaggctttggtatcaggacgatgcggtactcataaaatgagttagggaggattccctctttttctattgattggaatagtttcagaaggaatggtactagcactcctctttgtacctctggtagaattcggctgtgaatctgtctggtcctggactttttttggttggtaggctattaattattgcctcaatttcagagcctgttattgttctattcagagattccacttctttctggtttagtcttgtgagggtgtatgtgtccaggaattcatcaacttcttctagattttctagtttatttgcacagaggagtttatactattctctgatggtagtttgtatttctgtgggatcagtggtgatatcccctttatcattttttattgcatctatttgattcttctctcttttcttcttcattagtcttgatagcagtctatcaattttgttgatcttttcaaaaaaccagctcctggattcattgattttttgaagggttttttttgtgtctctatctccttcagttctgctctgattttagttatttcttgccttctgctagcttttgaatttgtttgctcttgcttctctagttcttttaattgtgacgttagggtctcaattttagatctttcctgctttcttttgtggcatttagtgctataaatttccctctacacactgctttaaatgtgtcccagagattctggtatgttgtgtctttgttctcattggtttcaaagaacatctttgtttctgccttcatttcattgtttacccagtagtcattcagaagcaggttgttcagtttccatgtagttgtgtggttttgagtgagtttcttaatcctgagttttaatttgattgcattgtggtctgagagacagtttgttgtgatttctattcttttacatttgctgaggagtgctttacttccagctatgtggtcaattttggaataagtgcaatgtggggctgagaagaatgtgtattctgttgatttggggtggagagttctgtagatgtctattaggtctgcttggtgcagagctgagttcaagtcctggatatccttgttaaccttctgtctcgtttatctgtctaatattgacagtggggtgttaaagtctcccattattattgtgtgggagtctaagtctctaagtagttctccaaggacttgctttatgaatctggttgctcctgtattgggtgcatatatatttaggatagttagctcttctttttgaatggatccctttaccattatgtaatggccttctttgtctcttttgatctttgttggtttaaagcctgttttatcagagactaggattgcaactcgttttttttttgttttgttttccatttgcttggtagatcttcctccatccctttatttcaagcctacgtgcgtctttgcacatgagatgggtctcctgaatacagcacactgatgggtcttgactctttatccaatttgccagtctgtgtcttttaattggcacatttagcccatttacatttaaggttaatattgttatgtgtgaatttgatcctgtcattatgatgtttgctgattattttgcctgttaattgatgcagtttcttcctaggattgatggtctttacaatttggcatgtttttgcagtggctggtgctggttttttctttctatgtttagtgcttccttcaggagctcttgtaaggcaggcctggtggtgacaaaatctctcagcatttgcttgtctgtaaaggattttatttctctttcacttatgaagcttagtttgtctgcacatgaaattctgcgttgaaaattcttttctttaagaatgtttaatattggcccccactctcttctggcttgtagagtttgggctgagagattcactgttagtctgatgggcttccctttgtgggtaacctgacctttctcactggctgcccttaacattttttccttcatttcaaccttggtgaatctgacaattatctgtcttggggttgctcttctcgaggagtatctttgtggtgttctctgtatttcctgaatttgaatgttggcctgtcttgctaggtttgggaagttctcctggataatatcctgaaaagtgttttccaacttggttttattctccctgtcactttcaggtacaccaatccatcatagatttggtcttttcacatagtcccatatttgttggtggctttgttcatttctttttactgttttttctctaaacttctcttcttgctttatttcattcatttgatcttcaatcactgaccctttcttccacttgatcaaatcagctactgaagcttttgcatgcgtcatgtagttctcatgctatggttttcatctccattaggtcatttaaggtcttctctacactgtttattctagttagtcattcgtcttttttcaagatttttagcttccttgcgttgggttcaaacaccttcctttagctcagagaagtttgttattaccgaccttctgaagcctacttctgtcaactcgttaaagtcattctccgtcctcctttgttccgctgctggtgaggagctgcgatcctttggaggagaagagttgctctggcttttaaaatttttggcttttctgctctggtttctccccatctttgtggttttatctacctttggtctttgatgttggtgacctacagatggggtttcggtgtggatgtcctttttgttgatgttgatgctattgctttatgtttgttagtttttcttctaacagtcatgtccctcagctgcaggtctgttggagtttgctggaggtccactccagaccctgtttgcctgggtatcaccagtagaggctgtagaacagcaaatattgaagaacagcaaatattgctgcctgatccttcctctggaagctttgtcccagaggggcacccgcctatatgaggtgtcagtcagcttctacggggaggtgtctcccagttaggctacatgggggtcatggacccacttgagaaggcagtctgtccattctcagagctcaaaaactgtgctgggagaaccactgctctattcagagctgtcagacagggacatctaagtctgcagaagtttttgctgccttttattcagctatgccctgcccccagaggtggagtctatagaggcagcaagcctcgcagcactgcagtaggctctgccccatttgagctttctggcagctttgtttacctactcaagcttcagcaatggcagatgctcctgccactgccaggctgctgccttgtaggttgatctcagactgttgcactagcagtgagcaaggctctgagggcatgggacccaccgagccaggcatgggatataatctcctgttgtgctgtttgctaagactgttggaaaagtgcagtatttaagcgggagtgtcccgtttttccaggtacagtctgtcatggcttcccttggctaggaaagggaaatcccctgacctcttgcgcttcccaggtgaggtgacaccccaccctgcttcagccctccatgggctgcacccactgtcccaccagtcccaatgaggtgaaccaggtacctcagttggaaatgcagaaatcacccatcttctgcattgatcacgctgggagctgcagactagagccgtttctatttgatcgtcttagaacagacctccacaatctttatcttaacctgaacattccctttctatcaattccagatctttagacaaacccaaccaattgtcaaccagaaaatgtttaacttcacctatagcctggaagcccccgccatgccctcctcactttgagttgtcctgcctttctggaccaaaccaatgtatttcttaaatgcatttgattgatgcctcatgcctctctaaaatgtataaaaccaagctgtgccccgaccaccttgggcacatgttctcaggacctcctgagagctgtgtcacgagccatggtcactcatatttggctcagaataaatctctttaaatattttatagagttcaacacttttctttgacactggtaccaatttattgtattattctgttctcatgatactaataaagacataccacactgggtaatttacaaaggaaaaagttttggcttacagttccacatggctggggaggcctcacaattgtggtggaaagcaaaggaggagcaaaagcacgtattacatgacagaaagcaagaggagtcctggcatgtaaaggggaattccctattatgaaaccatcagatatcatgagacttattcactaccacaagaacagcacaggaaaaacctgcccccatgattcaattacgttgcatttggtacctcccatgacacgtggggattattacaattcaaggtgagatttgagtggggacacagagcctaactatatcatgggggttcaagatcttcagattcatttgggttcagtcagtgtctccattccagttctgagattccctccttcctacccattttgtaacttttgtttaagagacctgatgagggtatgaattcagcctatggtgcaattctacagcctataatatcaatgtttctcttctctcttgctccttccttcccatctctggccagtgtgacccactgtataggaagccaggtggtgacgggtctgagaaatgtcattttcaggtttcaacagttgatgccacagaagagagtgcaggaggacaggcatacctgctttctcaggaagctattggaaattatgcttctttaaaatgtgacaaaaatcaagaaggagatggcatctaggagacaggagacaaaaggaacactcaggaaggtggggaaagagagcccagggcaacagctctgctgcagacctagagatccaccaggcgaaagtggagcaggagggctgggggctccatgtgggaggtctctcagaacaaaagaaaagaagagaaaccaatgcgtgacgtatttgaatacattgaggggagagctattattctgtcagatagtttggaggaaaattaatgatgaatatgtagaaaacaaaacaataaaaaccagtgttcaggaaaagcaagatactgtaaaagaaaggaagcataatcatagtacacaaaatgactcagtgttaatagccataatgacatgaaagttcagtatttgatttaataaaaatgtgacaaagtttaaagggaacagaaaagctgtgtgttgggatgaagggagagatgaagagagttacatttttatctgttatattaaaaagtaaatagataatatttaagctgaaaaatcaagaaatgtcaatataaagaagttatttatatatatggagatgaatctcagggggaaaattcacctaaaatagttgaaaattttctctgagaaattagtagaggtgaaatagggcaaggaaattttgttttcattataagtcttatgatatttagcttttaaaaatgtattcataatattacttttataaaatattaacatgtattttaaaatccacaaatgttaagacatttttaccagactaaaaaatgatcatcaatggttttataatgctaacattttttattgaactcttctcaaggtcttttgtagaaaatacacattcatgcttacccaatctaaatatggaaggacctcatgatcacttaagttgtattcctgattcttttatttgagattcactttaagtctaacctagataataatcaatgtatttttaaaaatttcttcacctgtgttactgaaaggcctatctaaaattcttgacatacattctggacaactttatattgttttgggtgttttatttctttaagaaaatagatgctcctctcccaactttactgtttttcacacttttttctattttgtttgcctagcccacagttcccctatgtattctggttagatagcattgcaaagaaaagaatcaaatttaaaaaaatacaaagatggaaaaaaaaccctccagaaaaccaatgtccaatgtcctaggaatgctgagaataaagtgagctggaagaatttggcaggatctggtcccatgggtatttttccacagtgtacaatagactccactggctgtagacctaggttgatagggctcaggggtaagtttggttgagttgtatgggctttgtgatgagtgcagggatttctacttttggtcttgctgccatcaaagctaggtcatgacagcagcaacggtctctcttcttagttcaatggaatgtctagtttctgaacttggaggtaaatcatcttttctttattttttcttggtctgcaataagaaataaaaatggagaggggagaaagaaattatgaggaggctgaaaaccaaaataaagtgggtaataaatgagaggaacaacaaatgattataaactttgttcaggattagtcttgcaatgtgttctgagtggtggttctcacaaagaaaatggacagaacttgttgataactcatgtcgacagagttattcctaaaattatcttgttgaattggtactggcctaaataagttccttttttagggtgttcacctttctctgtaatagagaatgtgggtaaagtctaaacttaatcttatatcagttaaagatgaagattgcaaaatcttgttatcattagttatgcaaatagaatttgaaaaattattttttcaaagtgtatttacttttcaacagcttgataaatgaagactgcaattaaaacatttgttcaaattgcaagttttctcaatcatcttgtcttcgtgaatgccaggacattgctgatattcatcgtagaaatgctgctttcttcattttgttgttcccagccatgccctttggacctgttcctgtttatagcaatattgaatcagctgtgggctgctcccagccacccagcatctcacagaatttcccccacctggagttggttagtattgtctcgttttctggaccaatccaatctgagacgagggatggcagaagcttacccaaatcaccctatggttttggaattctctaaagctccagatggggaggtaaaatcaagtcagttgagctcctctggtctctctgccaacaacaataacaacaactacagcagcagaaacaacaacagtagaaatagcagcaatagaagcagcagcaggaacaacaaaagcaagaacagcagcaacagtagcagcaatagtagcaacagcagcaacaacagtaattacagcagcaactgcaatagcaacagtagaagcatcagtgacaacagcagcagtaacaacaacaaaagcaacagcagcaacaatagtaatagcaacagcaacagtaacagtagcagcaacagatatggcaacagtaataccatcagcagcaacagcaatagcaacaataggatcctcagtagtaacagcaatagcaacagtagcaacacgagcaacagcagcagcaacaatagtatcagtaatagcaatagtaacagtaacagcatcagcagcagcagcaacagcaacagcagcagcaacaataacaaaagcaacagaaacagtaacaacaaaaccaacaatagcaacaacagcagcaacaattttagcaatagcagcaacaatagcaacagaatcaacaccatcacaattaagagcaacaacagcagcaacaatagccacagaaatagcaaaatcagcagtagcaacaacagaagtcgcagcaataacagcagcagcagcaacagaagtagcagtagtaatagcagcaacagcagcagcagcagcagcagcaatcattaccatagtagcaacaacagtagcagcaacaccagcagcagtagcagcagcaatagcaacagtaatagtagcagcaacagcaatagcaacagtagcagcatcagcaacaataacagcaacagaagcaataacagcagcagcaacaacagcagtacgaacaccagcagtaacaacagcagcagcaacatcagcaacaacagcagcaacaacagtagcagcagtaggaacagcagcaataattataacagcagcagcaacaacagtaacaacagtagaaataagtacaatagcaataacaacagtaatagcaacagcaaaaacaatagcagcagtaacaataacaacagcaatagcagcaacaacagcaacaagaaaaatgacaatagcagcagcaacaacagcagcagcagcaacaacatcagccaccggtgagtgactactaactaaataccaagcactgcgacgggtgcttcgtcgcactgtcccattcatgagcccaaccctctgatggtgagacaaattcatgggccacaaaatctagctgccaggattgaaactttggctttgtcactgattggctgtgtggttttgagcaagtcctttactttctctggcctgttttttttttttttccagttgtcagtggggttaataataataacgcctatttcatagggttgctgcaaggattcaatgaggtaatacaggcatacctcagagatattggggattcacttccagactaccacaataaagtaagttttaccataaagtgaatcatacatttttgttggtttcccagttcatataaaagttacggttacactatactgtagtctattaaatgtgcaatattatgtctgagagaacaatgtaatttaaaaatactttattttttaaaaatgctaacaatcatctgaaccttcaatttgtggtaatcttgctggtggaggctcttgcctctatgttgatggctgctgactgagcaagacagtggttgctgaaggttgaagtggctgttgaaacttcttaaaacaagaatatgaagttttcaatgttgattgactcttctcttcatgaaagatttctctatagcatgcaatgctatttcatagcattttacccacagtagagcttctttaaaaattggagtcaatcctctcaaaccctgatgctgttttgttaactaagtttatgtaatattctaaatcctttgttgtcatttcaacaatgttcacaggatctccaccaggagtagattccatctcaagaaaccactttctaagctcatctgtaagaagcaactcctcatctgttcaagttttatcacgaggttgaagcaattcagtcacatcttcgggctctacttctaattctagttcttttgctatttctattgtatctgcagacactttttatgctgaagtcttgagctcttcaaagttatccatgagggctgtaatcaacttcttcaaaactcccattaacgttcatattttgacctcctctaatgatccacaaatgttcttagtggcatctacaatggtgaaagatttccagaaggtttttcaatgtactttgcctagaacaatcagaggaattaccatctacggtagctatagccttataaagtatatttcttaaataataatacttgaatgtcaaaactactccttgatccatgggctgcagaatggatgttgtgttagcaggcattaaaacaacattaatctttaggtacatctccatcagagctcttgggtgaccaggtgtatgtattgtcaatgagcagtaatcttttgaaagcaatcttcttttctaagcagtaggtctaaacggcgggcttaaaatagtcaataaaccatgctgtaaacagatgtactgttatctgtacacaggctttgctattccatgagcacaagcagagtagatttagcataattcttagggaccctagggttttcatggtaaatgaacactggcttcaccttctagtcaccagctgcattcacccttcacaagagagtcaacctgtccttcgagctttgaaaccagacattgattttttcctcgctcttcatgaaagtcctaaatggcatcttcttccaatagaaggctgttgtgtctatattgaaaatctgttgtttagtgtgatcacctttatcagtgatctttgttagatctggataacttgctgcagcttctacatcagcacttgctgcttcattttgcactttcaagttatggagatggcttctttccttaagccttatgaaccaaacttactaacttcgaatttttcttctgctacttcttcacctgtctcagccttcatataatggaaaagagttagggctttgttctgggttaggctttggcttaagggaatgttgtgaccggtttgatcttctatccagaccactcaagctttctccatatcagcaataaggctgtttcatttctcatttgtagcatttttatacttccttcaagaacttttcctgtgcattctcgacttggctacctggtacaagagtcctcactttcagcttatgctggctttcaacatgacttcctcattgagcttaatcatttctgccttttgctttacagttgagacttgcaacgcttcctttcatttaacacctagagggcattgtagagctattaattgacctaatttcaatatggttgtgtcttgggccataggaaggcccaaggagagggagagagatgggggaatgctcagtgtgtggaacagttagatcacacgcatttatcaattaagtttgctgttttacacagccatggtttgtggtgccctaaaacaattacaatagcagtatcaaagatcactgattgcagatcaccatcacagatatgataataatggaaaagtttaaaatattgtgagaattaccaaaacatgccacagtgacatgaagtgagcacctgctgttggaaaaatgctgcaaataaacttgcttaatgtagggttgctgtataccttcaatctgttaaaaaacacaatatctgcaaagcacaataaaatgaagtgcaataaaagaaggtgcatgggaagggcatggaaagcactgggtagagctcttagtaaatgttagctattgttatcctcattttacagaaaggaaaacaggcttaagaagtgagataaggtattaggtataagttcacaggttatatttgtaactaggacaggtttagtgcccttaggaaccataacaatttaatcaggaaccaatcgacacttaattagtgtcaggcatattttcttctttaatccagtgagtaggtactgttgtccccatttacagatgaggaaactgaggctttgaggcattaaggcaataaagccacacacatgggaaatgtgacggcagggctcaggctctacaggacttgctcttcaccacacatattactgcctgcctggcactggcgctggctagagaaagaaacttcaattaggcatgctgtagaaggaacttcagcatttattccacaaataattggtaagctcctgctctgtgtatgccacgcactgtgctgagttccagtgatacagcagtaaacaggatttagactgtctttgacgggaggtgcccatgtgtgtgggaagctgcatggggagaggggtacggggtgggaggtggttggtttagatgaaaggtctccaactcaaatgtctgcatgcaccaagcagatcatacaatgtaccaaagacaataggaaacagtggggactgtggcctcctgcagagggcatgcccttgagaaagccaagcgatcattcagctcctacaaattgccaacaagaggaaatatcttctcagtgttaccaaatcttctgctttttaaaaacagatcctggaaatccagtttatgtggaatttcccactttaaaaaaatactttgtaggccaaagaaagcactggagaacttggtggcctgcaggctgcgagtgtgtgacctccgctcggattcaaaggcctcttccaactctaagactcaagttctaggaaaagcctcagaccactgtgatttaccagcattttgcccaagtactgaaaatgttaaacatgaaggtttggtaaaatgaataaaaatcagttgtttgtggtatcagcaggccaaaagtggagtaagaagaaaataaataaaaatatctaaacatactgtataaacaaacttgtggggagagtgtcagataggtttgtctttatctagaattttttaatgtactgtttgaatgggttcatatggtccaaaattcaaaattacaaaaaggtaagcattgaagtctcccttctacctgtatctcacagtcactcaattccatagacaaccagtgttacggttcttgtatatttttccagagctacaagtatttatatatatgtctttcactatttttacacaaatgatagaatatatacatttctatgttttgctttttcccccattagcaatatatcttggagaactttccttgtcagcgtatgtgaaatggcctcattctttttaatggctgtataattttacagaatggcatatcatttatttaactggtgttctaattcatggtcatttaggttgtttccaacacttgttataaaaaattgccttaatgactagtcctgtacatatatcactttgtacacgtaaacttctagaggtgtagagttactaggttaaaggatatacatgtttataatttttatttaatttatttttatttttttgagacaagagtattgctttgtcgcccaggctggagtgcagtggcacgatctcagctcactgcaacctctgcctcccagtttcaagcaattctcctgcctcagcctccccagtggctgggattacaggcgcataccaccacacccagataatttttttgtacttttttagtagagacggggtttcaccatgttacccaggctgatctcgatctcctgaccttgtgatccacccgcctcagcatcccaaagtgctgggattagaagcatgagccactgcacccagcccatgtttgtaatttttatactactattgcattgtccattatagaggcatctaattcctaccagcaacacgggagactacatttctccccattcttccccaacatagtgtgttaccaagtaattttagttttgacaatccaagtagttattagtgcagtgttaatttgaacttctcttactatgaaggaagttgagcatattttcatatatttaagagctgtttttatttccttttcattgaattatttgctcaaatctgttatttttttttttctattaggtggtcgcttttatggaattgttaggaaaattagcccaatgtagagtagtaaatattttcttcaagtttataattttatttttagcttatagtagttgtttaacgcagaatattttatttttatgaaagcaaacatattgacctttcttctatggattctggattttttgggtcatatttagaaagaccttctccacgtgaaagtttaaagaaattctcgtataatgtctttgtaattttactaatttttttgatgctttcaagtctttgatttagtttgaatttatctcagtgtatggtgtgaagtataaagtcaatttaattctttccaaatggctatagggttgtcttaaaacctttatagaacaattcatttagaactttcaactgcctacctttgcatattttcggcttcctcgatggtctcaggcaaagctttccctttagtttctggaagcaacagcaccagacctccagcaaccaagccaagcacgcctgaaagccaaacagatgaatatcacattaagaactgaaaaactcaaggtctataattagagtttcccttatttttgtttaaaacttttttttagcatttttctatacttatttacagattcctttgccatctctgactgctgtattttccattataaatattataccagttccaaactccattgaattactattcctaatagggaaatgaaatacttaacattttgagtcaaggttattctagggtagaggacattgccaccatattaagatactttggagttagaaaataactctgcaaaaaattaactgtatgaaaaggaggactgtaacccttccagtttaaatcacttagtaaggaaaataagtcagaaacttggatcatttctagcaaataaaagtaatgaattatgtatctattactatgtaagagcactaaaaagtatagccaggattttagttaaaattcaggtgttcattaaattcccgttattcctttttttctttgtctctagctataatctttaataataaacacttacatgtttttgtttctttagattctgataaaagttttgatcttttaaagttgtatttatatgtgtttcacaataatagaatacagaaaataggatgtgggttctttactagttttgaggtctcaaaacactgcatgccagtctctatttttacaccctcagaaaatggctgaattagaagctgcagggcacagatcccaagctctgagggcctgggctccaactctggccccttacatactggtctcaaggccttgggaagttctgtaatctttctgatgctccagacattcctatataaattgggataacatactgtcaagtcaagtttagcctacagctgcctccttacatattttaagtttggcctaaaggtttctctatacattgtgaactataatctagatggaatggtaaacacactatagcctactcttgtgccaattaaaaccacctttgcaaaattatgactgagacagtgaaagagatctaacttaatcgacttcatcttgcttctaacctccaagctgtccttgtcattcttgggtataggctgaactaactttgggagaaacttagtttatagattaaaacaaagatgaccacagcgaaaggagacctctttgttgcctggggactaggttgcctttgtaggactaacattagccacaacataagaaattatggtttaggagtcatgcagttggagtctacaagattctgaccctttctaaactgctgctaaaatcagtgcttgaggcattttgcagaccctgcactcagtggatcagctgacaccacccaaattgataaactggcttatctggtcttgtggcccccagcaaggactgactcagcgcaagacagctttgactccctatgatttcacccctgaccaatcagcactgccggctcactggcttcccccacccacaaagttatgcttaaaaactttgctccccaaatgctcaggagactgatttgagtaataataaaactccagtctcccacacagccggctctgtgtgaattactcattctctattgcaattcccctgtctggagaaattgactgtctaggcagcaggcaaggtgaaccccttgggtggttacaaaatcaccaagttttagccagtcaaatgcggccaactgttcaaaccatgttcaaataaggcaaacgctaagctgtaaccaatcccattatttgtgtacctcacttccgatttgtgtacgtgattttctttttctgtccataaatcttctttcaccctgtggttgtgttggaatctcggagcctactctggctcaggaggctgcctgattctcgaatcattctttgcttaattaaactcttaaaaaaatttaattcagcagaagtttttctttaacaataccacctcacaaatgtaaactaaaaataaaattcggagatccccaactgattgaattgaactgaaaaacttcaaggtttttcacccccaccccttcccattcaagccctgatggaaaggggtgggggtcagacatatctcattataccctctcccttttggagttcaagcacaactcaccagtgttaacattaaaacatatcttaagactgacacaacagactctttgtagcaataagatagcaaattccagcctgaccatagaataatatcacatgacagacaaaaaaaattaaaatattttaccccaaaatatatttctttgccctattttgaaatggcctggcaaagccatcttttgtggagagaatttgcatctgtaaagaatctctattaacataactagatctttccctttccagaccctcccaatcctgaagagattaactgagagtctagcaccttttaaagatctgtataggaaacatttgccattgattttctcaaagggtaccacctatgagacttcatctacataataagagccttggtttccataaccacttatcttaactcaggcactcttttctattgattccggaccttcagataataacttaactctttcaagcaattgccaatcagaaaatctttgaatccacctatgacctggaagcccctgctttgtgttgtcttgcttttctggaccaaactaatggatacctcgcatgtattgatggatggcttttgtctgcttaatacgtataaaaccaagctgtaatccaactaccttggacacatgttctcaggacctcttgagactgtgcctcaggcaagtcactcatatttggtcagaatgtggtcactcatatttggctcagaataaactctttaaatattttacagaatttagcttttttcctcgacatgtcagaggcatttgaaacacaacaactttctcttgaatagggactgggtaaaataaggctgagacttacaggattgcattcccagacagttagcactctaagtcacaggatgagataggaggtcagcacaagatacagctcataaagaccttgctggtcaaacaggctgcagtaaagccagctataacccaccaaaaccaagatggcaatgagagggacctctggtcgtcttcattgctacactcccaccagtactgtgacagtttacaaatgccatggcaacatcaggaagttaccctatatggtcaaaaaacaggaaactcattaataacccaccttttgtttagcatataatcaagaaataactataaaaatgggcaactagcagccctcagggctgctctgcctgtggagtagccattctttattccttgacttccttaataaagttgctttcacattattctatggatttgccctgaattctttcatgtgtgagatccaagaaccctctcttggggtctggatcggacacctttccaataacatctttctggtgaaccctgaagggaggatactgaggagacctcccctccgccagcgcaaaggaaacagactgcagcactgattaattaactttgggtaagtgctggcgtacccaggtaaaggacgtgattgggttagaggcccaatttaggggagttagagtctcttctaagacagagagggttaaaagtccctcttaataaaaggcaaagacacttgactgaacttgggtttgaggactaacttagaaaggctagagtctttcctaagactgaggggattagaggtccctctcagtaaagtccccctcagctaagaactagtttggcactatgggatgttaactgctattttctttgaattaatttcccttgcactctgctgatgtctatgggtgacaggattaggcatatacaggatcatagaaacatggatagtaattgtcaggcctctgagcccaagctaagccatcatatcccctgtggcctgcacgtatatatccagatggcctgaagtaactgaagaatcacaaaagaagtgaaaatggcctgttcctgacttaactgatgacattaccttgtgaaattccttctcctggctcgtcctggctcaaaagctcccccactgagcaccttgtgtcccccacccctgcccaccagagaacaaccccctttgactgtaattttccattacctacccaaatcctataaaacggccccacccctatctcccttcgatgactgtctttttggactcagacctcctgcacccaggtgaaataaacagcctcgttgctcacacaaagcctgtttggtggtctcttcacatggacaccagtgaaatttggttccgtgactcggatcaggggacctctcttgggagatcaatcccctgtcctcctgctctttgctctgtgagaaagatccacctatgacctctggtcctcagactaaccagcccaaggaacatctcaccaattttaaatctggtaagtggcctctcttcactctcttctccaacctctctcactatccctcaacctctttcttctttcaatcttggcaccacacttcaatctctcccttctcttaatttcagttcctttccttttctcgtagagacagagatgatgcattttatctgtggacctgaagctccagcaccagtcacggacttgggtttaatcatgtggggatgcctgcctgattatttacccacatttcattggtgtctgatcaccacggggatgcttgccttggtcattcacccacattccttggtggcaagtgaattgcgggggcgcctgctttggctgctcacccacattgcagcccagggctgctcacccaaccccttctctccatgtacccaccccttctccactttcctggggggcaagcacctcccaccccttttacacttttctggggggcaagcaccccccactccttctctctgtgtctctactctctcttttctctgggcttgcctccttcattatggacaaccttccaccttccattcctccttcttctcccttagcctgcattctcaaaaacttaaaacctcttcaactctcagctgacctaaaatctaagcatcttattttcttctgcaacactgcttgaccccaatacaaactcgacagtggttccaaatagccagaaaatggcacttttgatttttccatcctacaaaatctagataattcttgtcgtaaaatgggcaaacggtctgaggtccctgatatccaggcattcttttacacattggtccctccctagtctctgttcccaatgcaactcatcccaaatcttgcttctttccctcctgcctgttctctcagtcccaaccctaatcatcactgggtctttccaatcttccttttctacagactcatctgacctgtcccctcctcaccaggctgctccttgccaggccgagctaggtcccaattcttcctcagcctctattccctgaccctataattcttttttcacctcccctcctcacacccggtctggtttacagtttcgttccacaactagccctcccccacctgcccagcaatttcctcttaaaaaggtggctggagctaaaggcgtagtcaaggttaatgttcctttttctttatctgacctctcccaaatcagttagcatttaggctctttttcatcaaatataaaaacccagcccggtccatggcccttttggcagcaaccctgagactgtttacagccctagaccctgaagggtcagaaggccatctcattctaaatatgcattttattacccagtcagctcctgacattagaataaagctccaaaaattaaattccagccctcaaaccccacaacaggacttaattaaccttgccttcaaggtgtacaataatagagtagaggcagccaagtagcaatgtatttctgaattgcaattccttgcctccactgtgagacaaaccccagacacatctccagcacacaagaactccaaatgcctgaaccgcagctgccaggggttcctccagaacctcctcccccaggagcttgctacaagtgccagcaatctggcctctgggccaaggaatgcctgcagcctgggcttcctcctagccatgtcccatctgtgcaggaccccactggaaattggactgtccaacttgccccgcagccagtcctagggcccctaaagctctagcccaaggctctctgactgactcctccccagatctgctcagcttagcagctgaagactgatgctgaccaatcacctcggaagccccctggaccatgatggacactgagctttgggtaactcttatggtggagggtaagtccgtccccttcttaatcaatacggaggctacccactccacattaccttctttccaagggcctatttcccttgcctccataactgttgtgggtattgatggcccagcttcaaaaccccttaaaattcccccactctggtgccaacttggacaacattcttttatgcactcttttttcagttatccccacctgcccagttcccttattaggccaagatattttaaccaaattatctgcttccctgactattcctggactacagccacatctcattgccgtccttcttcccaacccaaagcctcctttgcgtcttcctcttgtatcccccaaccttaacccacaaatatggaatacctctactccctccctggcaaccgatcacatgcccattactatcccattaaaatctaatcacccttaccctactcagcgccaatatctcatcctgcagcatgctttaaaaggattaaagcctgttatcactcacctgctacagcatgggcttctaaaacctataaattctgcttacaatacccccatcttacctgtcctaaaaccagacaagccttacaggttagttcaggatctgcgccttatcaaccaaattgttttgcctatccaccccgaggtgccaaacccatatactctcctatccttaatacctccctccacaacccattattctgttctagataaacctagctgaccccataaatcctaaatcctttccccactcccctttccattccttaaaaaacagccctaaaagctgctcctatgctggctctccgtaactcttcactcccttttcattacatacagctgaagtgcagggctgtgtggtcggaattcttatacaaggaccaggactgcgccctgtagcccttttatccaaacaacttgaccttactgttttagcctagccctcatgtctgtgtgtggtggctaccactgtgttaatgcttttagaggccctcaaaatcccaaactatgctcagctcactctctacagttctcataatttccaaaatctattttcttcctctcacctggctccttcagctatactcactcttagttgagtctcccacaattaccattgttcctggcctggacttcaatctggcctcccacattattcctgataccacacctgacccccatgactgtatctctctgatccacctgacattcaccccatttccccatatttccttctttcctgttcctcaccctgatcacacttggtttatcaatggcagttccaccaggcttaatcgccacacaccagcaaaggcaggctatgctatagtatcttccacatctatcattgaggctaccgctctgccccccactatctctcagcaagctgaactcattgcctgaacttgggccctcactcttgcaaagggactacaaatcaatattaatactgactctaaatatgccttccatatcctgcaccaccatatgggcagaaagaaatttctcactatgcaagggtcctccatcattaatgcctctttaaaaaaaaaacatttctcaaagctgctttacttccaaaggaagctggagtcattcactgcaaaggccatcaaaaggcaccagatcccatcgctcaggacaatgcttatgctcataaggtagctaaaaaagcagccatcaaaaggcatcagatcccatcactcaggacaatgcttatgctgataaggtagctaaaaaagcagctagcattccaacttctatccctcacggcagtttttctccttctcatctgaccactcccacctactccccactgaaacttccacatattaatcttttcccacgtaaggcaaatggttctttgaccaaggatctccttccagcctcacaggcccattctattctgtcatcatttcgtagtctcttccatgtaggttacaagccactagcccatctcttagaacctctcatttcctttccatcgtggaaatctatcctcaaggaaatcacttctcagtgttccatctgctattccactactccccaggaatttctcaggccccctcccttctctacacatcaagctcggggatttgccctgcccaggactggcaaattgactttactcacatgccccgagtcaggaaactaaaatacctcttggtctgggtagacactttcactggatgggtagaggccttttccacagggtctgagaaggccaccatggtcatttcttcccttctgtcagacataattcctcgttttggccttcccacctctatacagtctgataacggaccagcctttattagtcaaatcacccaagcagtttctcaggctcttggtattcagtggaaccttcataccccttatcatcctcaatcttcaggaaaggtaaaatggactaatggtcttttaaaaacacacctcacgaagctcagccaccaactttaaaaaaaggactctgtcaagaatagagcccaaaaactcaccaaccaaacaagtaattacactgaacccccttggacactctctaattggatgtcctgggtcctcccaattcttagtcctttaatacctatttttctccttcttttatttggaccttgtgtcttctgtttagtttctcaattcatacaaaaatgcatccaggccatcaccaatcattctatatgacaaatgcgccttctaacaaccttaccgcaaaatcttccttcagcttaatctctcccactctaggttcccacgctgcccctaattccactcgaaccagccctgagaaacatcactcatcatctctccataccaccccccaaaattttcaccaccccaaaactttaccaatattttgttttttgttatttttcttattaatataaggagacaggaatgtcaggcctctgagcccaagctaagccatcatatcccctgtgacctgcacgtatacatccagatggcctgaagtaactgaagaatcacaaaagaattgaaaatggcctgttcctgccttaactgatgatattaccttgtgaaattccttctcctggctcatcctggctgaaaagctcccccactgagcacattgtgacccccgcccctgcctgccgagaactacccactttgactgtaattttcctttacctacccacatcctataaaacggccccaccctatctcctttcactgactctcttttcggactcagcctgcctgcacccaggtgaaataaacagccttgttactcacacaaagcctgtttggtgggctcttcacacggacacgagtgaaagttatttcttcctaagagggacgcttgagagcggataggactgctggaaaagatcccttcgctaccgacaagtggtcacctgaacagtgttactgtaatgggtgggtctttctctggcctccctgagcacctctccttccccaccctgccacaggaggagctgcccctgccgccccaccagacaatgcttttctccctttctctcctttctcttttctattttttctgttactcagggtaactgtctgctctttcattgtgcccagagaccacatgttgaaaaatgtccttgggagcttgaacttgtaaccacatggcagttctttctcttggtttccaccatccaacagataggaatttgggggttcatgtcatatttatccctaaaaattatcttgaacagttaaaagactttgcaagctcagaattggctgctctaaaatccttctgggaagaacaacggaaaccagccaatgctgtagctcaatagctaaggcttcaccattttacaatggtggcccagggttcaatcctggcttagggaatgaatcctttctggtttaaaatctgtataacctttaccactggttaattctcttcctctccacaaaccatcttgaactttcctttctctgagcaaaaaatatcggctgtttggcatggctaaagtcaggtaataagatatttaaaaggatttgagtgctatggttaaaagtcagtttgttcaagctctaacagcctggaactccttgggaaaaacagaggagacatcacagacctccttttggtaaaacctctgttttcctcataaagcccaaggaattaaagtggatagatccatctcaaaatctaagggtctgttctatttttcattgcattatctgatgtttttgacttggagggtatcagaaattactatacattatgagagagctttgatgtgtgactaggtaggaaatatagtttcagggatagctaatggcagttatggggagatcctcagctctttgcaagtttacatcagaaaagcatgctcttggccacctagaagttatgaaaatgtccccattccccactgacagataagattcctataggaaatgggctgatttcctctttttgggttagaggatatggtataaaaatgagacccttaatttcagggaatctgaaattcagggttaaaggattgtttaaagttaaataagataaagctgaaggtttcaacaagttgtggaggatttgtgaaaaattaatcatgtaaaagaaattctgtgtgtgaatatattggctaaagttaaaggggtatcattcagtttttccataaattgaacattaggataaaagcacaataggtttttcttacagcactgatctgctctttaataaaaagtttgtaaagagttataaaaggtttatgagaatcctaccttatggtcaaacattaaaattgggtagatatgtctatgaaggtttaacattaatagtacactaatgtaaaagtgaaatttgacttatgtagtataaaagtcatacaggaagcattgttgaacataaaatggtgtttggctgtctttgggctctatttgtataaatacattaatggtatgtgttccaaaattatatgaaactcctataattctgataggacttagtgtacattatcagtaataattataattgctatgttaaattaatgtgtgctacagaagtaacatatttatttgtcaattgtgtttttgactgtggctgccctaagactttaccatccacagacaattgttgttttgtgttgatcctcttcaaaaggtggttttataatcaactataggactttaacaggtattcttgaatgcaggtttctgataactttggagattgtgacattagaatagaggaaaatactttcaggactctcagggagaggtgaaatgttcatgtatatcaaacaaagcaggagttaactgcatggactgaataaaagaccgaagtattcttttttaattttttgcttaaaacgttgctgatcctttgttttgtttttcagagtcaaggaaacttttcttttgagctattagtatttacagcttgtagcaattaagtcaagtatattcctgtgaaaaactttggagcacatttgtttctctctacctgatttctccagaatttgaaaattatttgtgagtactcttaacttatggcaatatagttatttgcataagtgcaataagaatctgttttcttttgcaacaggacacagttggagaaactggttatttttaccaaggctttgactggaatgttgtgctttcctttaagaaatcaaacttaactggtagagccaataaaagtcccctgggaaaactgacatcataccttgtctacatagtccctgtacagggttcctgacctgtggtaagtaaaaaatgtcactttctgacagacccaggagcctgagttacctagggacctcaagaggagaggcatttactcaacttattggtattagagggtacaaacccatggctgggcttggctttgaaaaaaaaagtcttatctgagattccttttatggaacaaagttttgtcaaagccaatttaaaaagcctatgtgaaaaataattatttttgctgcactttatacaaataatcaggccaagtacaataaagcaaatcagtcctaccaagatttgtctttagcaaaaatgggaaactggagagagaaaaattatgtttcaagaacaatggtatacctgttattatattctagtctcatcagttgttttaagcttttcttcctgcactttagactgaccctgctcattccaacgagtgattcctgcagttcagaagaaacaagagggatgggtaatataaaaatctggatcaatattctaattctgggctcattggaatcaggtagtgaccccatatcagcatggtttcaacaattgccaggttcatggaaagccttctaatttagtttgcttgggataattttgcttatttttctttactgttgtggaacatattgccgttttactctttgtgtaggaatacacaaagggttgtgcaggataagcttaccaaatgttttcttaaattaaactcttattaatctttcagatatcactttttgtcagaactcagagttatgaatggccctcaccatactgatgctttctgactgagctcctctctaccctgaatacaagagaccctaatacttaatcagaaatatcatcacccttaatcagaatgaaaaagttacagaagatggatctttgtctctctgcaaccattaagattaagagttctcttacaaaagggaatggggaaatctcagaggtgtttgaaccagagaaactttatcttgaagaggggctgggtaaaataaggctgagacttacagggctgcattcccagacagttaggcattctaagtcacaggatgagataggaagttggcacaagatacaggtcataaagaccttgctgatcaaacaggctgcaataaagaagctggctacaacccaccaaaaccaagatggcaatgagagtgacctctggttgtcctcactgctacactcccaccagtgccatgacagtttacaaatgccatggcaacatcaggaagttaccttatatggtctaaaaacggggaactcataaataatctacactttgtttagcatataattaagaaataaccataaaaatgggcaacaagcagccctcagggctgccctgcctatggagcagccattctttatttgtttactttcttaataaacttgctttcacatcactctgtgaactcgccctgaattccttcttgtgtgagatccaagaaccctctcttggggtctggattgggacccctttctggtaacagagacaggcttgttatgaggctgaaatgaattaatattgtcaaaggcttagaatagtgcctggcacatggtatatacagtggaagtgcctattaaataattaacctctcaaaatgtctccaagcctcccaagattcacttggttattgtattgtaagtaatgcaaacaagaaacacattcagctggcatctgaatctctgaagtgagtgaatcatgatgaatacaactgattaataaaattaccattcgtttggcattttatatttgcaaagacaggcctagttaaccagaataatccttgttgatttttccagtgctctttcagccaggattttccagtgtgttgactttcagtcttctttgattatcgttttatggctatttcaagaccacaattagcacaccattattgtgtggaaaagaaagagaaagaagttaaaatgaaaaactattaggttttctttccactagccactcatactaaaggttagtgagggaagaatatgaaattactttcaagaataaaattagaattgtctttgagtttactttaaatattgaaatgtagttataatcctttatctttcctgcaggaaggtgtcaggcaggaacaagggtcaataaagtactatttgttaaatagtacttagagaaacatgaagttgtcaaagttgtttgaaccagagtgactctgtcttggacaggggctgggtaaaatggggctgagacctactgggctgcattcccaggaggttaggcattcttagtcacaggatgataggaggtcagcaaaagacacagggtcacaaagaccttggtgataaaacaggaagtggtaaagaagctggcccaaacccaccaaaaccaagatggcgatggaagtgacctctggtcatcctcactactcattatacactaattataatgcattagcatgttaaaagacactcccaccagcaccatgacagtttacagatgccagatgccatggtgatgtccggaagtcaccctatatagtctgaaaaggggaggaaccctcagttccaggaactgcccatccctttcctggaaaactcacgaataatccactccttgtttagcatataatccagaagtaactataggttactcaactgagcagcccatgctgctgttctgcctatggagtagccattctttattcctttactttcttaataaacttgctttccttttactctatggattgacctcgaattctttcttgtgcaagatccaagaaccccctcttggggtctgggtcaggacctctttccagtaacgaagtaaccatctgctatccagaaatgtcctgctgacccattagtcacccactgtccacctaagggagtggccaagattgagtggtctctaacttcctccatggcaggaaggaggacagagggtttgatgggtacctcctcatgatgaaaagagggttctgaggacagtttccttagccagtgttgggggagaaagaaataggggtcacatatgtctcaggagtagcaccagctactctgtggccaagttatctcaggataaagagcttgtgctctgtcaactttggccatcttattgctattaaactggatcatggaggaattcattgcatctgttttgcaggtaagttccatcagtggtttggaacttttgctggcagatctagagtggtggaaaattttccccctcacaaattccgtgagaagaaggggaagaaaaggaatgagcagggtagctgtgtggggcattgggcagccttaggagtgaagtggtgggagcttcccctgataacggaaatgagtgactgaggaaaatgtcccagtcagtcgaggtttattaagtcagctttagggcatgtccctgaaaagcaatgagccacagacacatctgtggctgtttttacaaagaggctttcaggaggttggtatttatacatttccttaaagtagggaggcaggtagggagaggggcaggtaggccgtagaggaatgtttccatccttgtgagactttaactagtgcccagttaaatttacattttacatatgataaggtgaatgtttaaagagaaaatgggagtaaagaaaagaatcaattatgcaggcctctctgagtaggtggaggaatgactgatcttgtctttattctgtacattgggaaataagcttgcaatcaacattatcagtgtggaatcagcagactttagttttagaagctaagcttagattgtagacctaaaattcttgtctacaggaggccagcaaagaatttacttatgaatgacctgcaggggtggtcctttgtagataactgaggcatgatgtataatgcttgtaacagctattcatctggaagagggtgttgcatgactcaacctccaggcttagtcttcccttttgcataaggattctgggggtcctgagatttttaaatttcctttccctttacaccctcatgtacatctgagagtgaaatctcttcttcttctcttcccctaaattgagtgctatatgcccatgggaaaaagcatcacatattcaattaaaagcagctcagaatgggtgtcaaaggagcctgaaatgggtgcattgaggtgttccagttaaccagagaaggctcagtgctggtgtgttcctgctggcagtagcagaagggaagtgctatgtgacgctcctgaaatctaattgctccaggtgcatcaacacaggtgctccattatgctgatgcattttcttaatgtgggtctttatttcctctgggttttgaaattgccttttgcaaaattttaacccccttctttgaagtaagaagtaaaagggcttgtgttttaccacctctgggcatggaggagttaactctttgacagagacctcaggaagggtggaaatcagcagagagagagttaggggcctgctgctgggaaactttcttccttctcattcttctcttcaacattctgcctctatggcaggagtcccatacttgagtattagtagtgatgataatattatgaatactgaactagtattattgattagtattactaatactaataatattactaattactaggcacatccaggaagaacgcaagccacagacacatcattactactatgagtagtaattagtagttactaataggcatgacacctgttttgaatgaagtagaagagaagtgaaggtctctagaaaaataagttttcacttaaagacatctgtgaagatttcttaccgaaaaccatcagcgggagctcaagccagatgttagtgagccggtagaccaggaatggcgtgatgatgccaccaatgtcacacattgaggaacagatgtggacgccaagattcctagaatgcaggaaactgatttaacttgttaacttatcacagtgcagtagttatctcccatccacccctgaataaacacttcctcaaataattaaaatgttcaagagctatagtgtacactgctcaggtgacgggtgcaccaaaatctcagaaatcaccactgaagaacttattcatacaaccatataccacctgtttcccagaaacctattgaaataaaaaaaaaacaccaaaaataaaatgttcaagagtttaaaaaaacattcacgttattttcaatgcacaatattttatatatatatatatatacataattccattcatattctgtcattcttgttttgtataaaccttaaatttttttttaatgatgggaggagcaattgtttctttttacttccatcacctggcttccctaagctgtttctatggacctgtttgtgctgttccacaacaatctcccctgtagccattgggtaatccctgtcttgcaattcaattttctgttctcaccatggcctctgtattttaccccagcctgtaagtgtgagaggtgaactgctgggcctggctggacctttacgtgttctcaccttcccttacactgtgttttgaaggtaagatatcctttgtctgcacttgtggtggttccagccaatgaacaaatgtctcacccaccctcgtcattctaaggaaaatgcactcacctaatgaatgtggggtacagctcagcattgaccaggcagactatctcataggccattgtgatccccattcttcccaagcatgagataataatttttagccattgtagatctaagagggaaaagaacagtacttatccgtacacagatgattcctcatcttcagacagtgctccagagtgggactgtaaggacaaattccccatcccagaatgggacaagaaagaaaaatgacttcttctataggctcatgttaatgtcagcagattctcacgtttgttcatcttaacctcagacacaatgctaattctctcttttttaaaaaagatattttttttagagcagttttaagttcacagcaaaatggagaggaaggtacagagatttcccacataacctctgcccccacacatgcattccaccccccactgcccatcatcgacattctccacagagtggtatgtttgttacttgatgaaccttcagtggcaacgataatcaccccaaatctatagctggcattagggttcactcttggtggtacacctcctgtgggtttggacaaatgcataatgacctgtatccactattttagtatcatatggaataatttcactgccctaaaaatcctctgtgttctcttaactttagacctcagttgttaatgacaacggagttataccagtttccaaagctgggccaactttagtctatagaagtcaaagaaagagcaaaatatgggcacatttaaacaactgctaataacaaaaggattcaaacgaagctccatattgctaaaaggattctcttatccaggtatttgttccccttcgttgaggaagcattttaaaagggaaaaagggaactgaatagttatttatggatggcatttacttacatttttctcatttattctgcaggttgatgcagggaggtcaagagagtccccagttaacacccaggaagggctggagtaagaccttgacctgggcctgctttacccaaggcccatgctctctgctccaggtcatcttgatggcctgtagcatggggctgtaaagtctctcttgttacatcacatcaaggaaaaattgggtacaatttttcctaaagggaggctggccatatgaatttgctcagaagggtcccagatactgccctccaatttgtctttccaaattgatttggatgacaaattacatggttttcctatcaatgggccgtgacactccctttctccagggtcttggagataagactccaacttcacctgaaacttaccaccaggtataaaaactgaggccagacaggctgcccctgcaaccatatttgatgcagcccaagggtaacggcgtccgatgcggtcgatggtgaggatgatcatgaaggcagctgggaattcaaccagggcagagtagaagaaatccaggtagatattgtcacctgcaaggcccatgtgcatgatgaggccctggtagagcacagagctcgtgaacctgagcaaagaggagagttcaggtcaagtcaagcaccaaacacagggcaccaaaaaagagaggcttctggaaaaataatgtggattgtaggtcacctttccctgtgaccatctccttgctagtcccccatcccactgcttttataatctctgatctacttcagtggctggctgtggctgggtagtttccaaaaaccaggagaagggaagaaattggaatagttagaactaattagaaattacgataatgtttcctggacaaattgaaagccaagaagaatgtcttaatggaatgatttattttatttatttattttttgagacagagtcactctgttgcccaggctggaatgcagtggtgcaatcttggctcactgcaaactctacctttcagtttcaagttattcccctgcctcagcctccctagtagttgggattacagacgtgtaccacctgctaatttttgtgcttttagtagacatggggttttgccatgttaaccaggctggtcttgaactcctggcttcatgtgatctgcctgcctcagcctcccgaaatgctgggattccaggtgtgagccactgtgcctggccaatggaatgatttatttagtaaaactatatcaagttattagtggttgtgagttatttctctctttggggtattctagtgcaattgggatcgaaagaactgactacttaattcaaattttaggaaaccagaagaccaagtgagtacggcctcccttcttggtgacttctctcctggcctgttacgaacaacatttggacaatgtttctagtttattaactaaacatagtcattacatgtaatggaaaatatgaggataatcaacaaaagtcacgattactcagaaaaggaaagaaggataatgaggccaaatttcaaagctgcctctcctgtgcactattgtaaaggttgctaaagtaattcctcatgagctttgcttttgtcagtgattgtaaatctccatttgcctgggtggagatccaatgtgccctgaaaagatgcattccccactagagaaagcatggcttgaagctctgagagcagcctgtaggtagcaaacacaataaagatcaagtcactgggctgtgaagccactggaattattcttgttcagaaatttattttttctccaggtagaaaagaaaaaaaggaaagaaaaggcaatccccccacaaccctgttttttgtttgtttgttttttgccagttctgtactacaatagagatctacatgcatcatcaattaagttataccaatagttctctagttgggctatgcatttgaatcacctggagaattaaaaaactattggtttccaagccctaccctagaacaattaaatcagtatttctgggggttttggctttggtattttgtaagctcccaggtgattccaatgtgaagccgaggttgccattgccttgatctgtgcttaggggctacaccgatcttaatatttgcccaagaaaaacacgatcaggaaaacctaccagacacaacccacattgctgcccaccgtcagcgctaataccgggatgaggtcatgttttcttcccttccttactatggatgactgtgattaaaacaatttggaggcatttcaaagtgaaaaatattccttaccagttgtacatcaatatcatagtatgtttccttatctgaggagttctgaccaagtcaagaaatgaagggttcaatttcttgccagtttcctcttcaagtctcaggcgctaagaaaaggaatagaaaggacggctttgtatatttaatgctagtgtccctgggtcacatagggaataacaataatttcttaccgtcctgagcgcccatctcatgcccagcactagagcaagcactttccatactgtgtcccatttcattttttttttttttttttttttgagactgaatcttgctctgtcacccaggcttgagtgcagtggtgcaatctcggctcactgcaacctccacctcctgggttcaagcaatcctctgcctcagcctcctgagtagctgggattacaggcatgcaccacaatgcccagcttttttttttttttttttttccccgagacagggtcttgctctattgcccaggctggagtgcagtggcacgatcttggctcactgaaacatctgcctcccgggctcaaggaattcttctgcctcagcctcctgagtagctgggattacaggcatccgccaccatgcccagctaatttttgtatttttaacagagatggggtttcaccatgttggccaggctggtctcaaactcctgacctagtgatctgcccgcctcggcttcccaaagtgctgggattacaggcatgagccactgcgcccgaccaatttttgtatttttagtagaggtggggttttgccacgttggccaggctggtctcgagctcccaacctcagatgatctacctgcctctacctcccaaagtgatggcattacaggtgtgagccactgcacctggcctattttcgaataagcttaatcttctcttttctacccgctgtggaatgaaaatgtttgaggtcaacgtggtgagatctactaaaggcaaacaataaacacaggtaacgaacacctctgtaactggattctatttaagaaggcaggggattgcttaaaagcttttcagcctggtgcggtggctcatgcctgtaatcccagcactttgggaagccgaggctggtggatcacctgaggtcaggagttcgagatcagcctagccaacatggcgaaactctgtctctactaaaaacacaaaaattagcttggcgtggtggtgctcgtctgtaattctggctactagggaggctgaagcaggagaatcgcttgaacctgggaagtggagattgcagtgagccgagattgtgccactgcactccaacctgggtgacagagtaagactccatctcaaaaaaaaaagctttttggacaatttctatccaaagtgtttacaattctaagaaatcatgtgtgtttaaagaactgctttactgatctaagaatctgacctgaggatggtgaatatgcagatgatgggggtgctgggcacctgggcataggagactggtgaaggcttaagttgcacaagacagaagctcctcacgtgacctttaaatgatttctggttctcttttagtttgatggtttccacctgtttgaaatattctcccacggaaccacaaatcttagcatataaaattctctgttgcattccgctacaggtaagccaaaatgcaagggggtgggtgcttccatggttccctgctgagatcactggcatgcatgaatcttaccagagcctcccttttctccatcccctgatttgatacttaaggccctggctcacctgaagggaggcgggtagagattttccatttttctttgcgatgtgcttaatgattctcatggcttcagcattcttattctgggagatcagccacctgggagactcaggtatgcacctagggtacaaggtgagcggagggcaactcttactgaatcctccttaccccatcccccatttttttataatcagatttctctgaggatgttaatacagttggatctccaaagaaaataacactcgtgtagggggatatgtggttctttcctccctcaaatgctaaatccctcctcagggatttctaagcagaaacacaggaagcaagctgcaaagcagggtgcggctgaacatccagctcctcttgcaaggaggagaggcaggtccctcagggtggccctgggctttgcaaaggcctgagaactggcagaggggtcaaggactggatgctggagtatgcaaaccattgtgggggtggggagcaagtatgtatatgtgttatgctcaatttcccaaaggaatgagataagaatttgaggtcagagggtgaggtaactgaaaagcgagacttcatagtttgagtttgatgtagcagggctcggggagcccttgcaagtttttgagcaagactagaactattgactctgtgtctggagggaactctgagcagctgggttcagggtgaatgagttcagggtggaggttcagcgggaggagaaactggagaaaggagataatagggctgctgctgtggcagttatggtgtaaatgtaggaaggccccagttgggatcatcactctgggagcgaagttgctctgagaggcagggcttaaaaggaacttggaatggatgtttttgtggaagtgtaatagagacagcaggaagggtcactctcagggtataatggactgaatgtttctgtccccgctgaagcgcatgcactgatgccctcacccccagtgtgcaatttggagttggggcctgtggcaggtaattaagtttagctgaggtctggagagtggggcccccagatatccttacaagaagaggaagagagactagagtgttattttttcttcaccatgtgagggcccacaagtgggatgtctgcaagtcaggaagtgggctcccatcaggaacaaatctgccagcacctggatcttagacttcccagcctccagaactatgggaaatatgtttttaagtacccggtccatggcattttgtcactgcagtctgagctggtaaaacacagagttttattggcttttggataagaaacaggcttctgggaaagagttgagatgtttaattcttaggcaagacagccatgggaagaacaagtgggtaaatccaggagaaactaaataaatgggttgtagcatgggagagagatttggtctgataatccagtatcccctttgctttatttcagataatctcacattaggggtttctaagagtttctggtatttcccatgtgtttcccttaggcagggatgactaatatattttacttgccttggtaactctgattgattggtatggtctgtctggagtgtcatgttggccttatctgtgatgaagaatactgtgattcactggggatgtctgccttgggcatgagtattgggaaatggtgacacaagtgccatgctctgctttctccaccctaaagtttcctctgagtggggagagaatagtaatagtgatattttcagtctcttcaaagggtctaccgtccaaattgtaccacagctcctagaagctaatttaaacaccaaataaataatgtggaaatgtaagatccaagtcataaaaactttaagcccaaagagaaaggacatttgatttacagacggagaggtgaagcttgtggtttttattcctgaaacatggaattgggctctttgtgaaatgggtctggagagtgaaagcaatctcagaatcagaaagatagtgtgcattaaggaaggcagacttcttagcagaataaaatactttgatttatttcctttttattccaaatggacttaccagtaatagagcaagaagaagaagttgggcagagaaactgtgaactgcaaccacctccagtgaggaagtgcgtaagccaccccagctagcaccaggagcccaactgtataggcaacttggtaaaaaatccccactgttctccgatatctccgcccaacaaattctgtaactgcagagagaatttgaatggttaatgcaattcaatacaataatgagttggctgtccagctatcaggaaactagaacaccaacctcaaaaatatagacaaattctagaatattctacgcaactctctgaatatttttaagtgttttttggtttttattttgttataactattgctgttttactaattaataaatcttatagtcccattgtagatgggatgaaaggcctgccaacataagcaaacacatttgatttataattttcatgatgcaattgtatttcagatacatgcaagattttgacctagagtagtaactcaagacctgaacaaatgaatcaaacattaaatttagaccgtagatgatttttatgtaaatgaacacctgagtataacttgttctcttacatgggtttaacatttatcttgcaagtcctatttgtttatttgtataaatggcttggtaacttagcagagggctggaatcagctagtgctggctggcaggaactggttttacatgctggggaattttacaagctggtggttcaacccgttggtatcagccatagtgagaatattgctataaagatgctatgatgttagaagtcaaatattctcttatagtatatggaacttaactgtaactctggctactaaggaataggatgtaagttatattcctcgtcctaaaaatggctggctgagtaacctaggttgactacagtacttgtgttttcagtttccttatgtgtaagttgaggataattgtagttcactagaatagatttttgcaaagtattaaagtcctttataaatctactatatctctcatcactgattcttctttatgaataggtctggtaggatgaattttctttccacacaatactccagggtacagaaaacaaaaattccaaaaaagttacataagaatctgggtggcattatgtttacccttgtttctgccttcatttttttagtttataaggaggaatgctgaatgagttgatatgcttttaggaattcttttgatacagaaataaaaaaatctctcaatattgtcttgaagctgggtcccttttcttgcatgccgccccccacctgactctattttggcagcgaggttgctttgttctcacagttgcaagcacaaacattcttactcaggatgtagcctattaaccagcctgctttgctgaccagtccttggattaagcgaaaaattaacatccacgtataggttggggaaatggccatgagaactccagctgcagcatttatgaggactgtagttaggaggcagagcttacggccaaacctgcaggaagaaaaacaaagagagggaattgaattaattttgatttgtgaagattgtggaaaatgcatggaagttatggaaatctaaacaaagttagaggttaactttaaattttatgaatccaggaggcacagactgatagccacaaagggaatctgtgactccaggtccaggtagcacttttcatcagcacactatgtgtaagttttcagcatgataagccccattcaccccagggttcaagtactttctcagtcccacactgtggcaggtattcagggaaagagtaattcatccaggccatcctgtgctgaataccctatggtcctaactaggtcttacatcaccatgtgagctgcggcctttgcactaacaatttcaaccaattatccacccaagaatgttttcactttttcactttgaaaacaaaattcagtgttcagtatataccccctttctttttcaacagtgcttttaggctttgtgaaaattgtctttggtgccacacatgttactatcctatgggggcctctgtttggagcaccctgggaagacagcttccacacatcagatttgggagacttaggtttattcagtttagggatttggaaagttgtcccagtatatggaatagaggaaaacaattggcaacctgggtttcatcatgaccttcctacttactatgatgttgggcaacctattcaaccatattcagtgtcttcatctggaaaagacccatctgacccagctgaaaagaggattaagtgagatattagaggtaaggagcttggcacatagcctgcctccgaccccttccttccttttttccttctgtttgcaaacctggctcagctcagagagttgacctggggcccaatactgttattttcgccatgtcctggtttgcttgtaaaagacaccctaatccacttagtggatatttaaaaaaattcttcacagaaaacaatgtttatttaatctttgtctttccacttcaattggaaggatggctttttgttatcaggattgctccttttaatggtggataaacattgtttaattgatgcttttattattatgcaactatattctagtgaaggtgtcaaatactaaccatttcaaaataatccacattattaataattattttggaagagtaatattttaaatatgaaattttaaggttaagcagttacattggtaattagtattaactagtaaatttcttaagtcttaaaactctgttttgaccatgtaatttcatttttaaaaatttttatttttagttctggggtacatgtgcaggatgtgcaggtttgtcacatagggaaatgtgtgccattgtggtttgctgtacctatcaacccatcacctaggtaacgatgtaatttcttaattctcagtcaatggctccctgctgtaaatatacaacctcttggcctctaattcaaagccttccaaagtcatatctcaacttaattttttagcatttcttcccacattttcctacccaaaccccttcctttaccctcaaagagtatataatctataaacattgactcaaatggtacttcttcaactttcaaaactgcttcaggcacacagtagaacaccacagtagtgccccatgtagatggacaaaatcttttaggtgatgagagggaatattcatcatctgaaactcagagcaagaaaatcaaatccatgatgtggaaaaacttcactggagacatgttccacatagggaagcaatgctacttaaaagaataataaggcatggctagaataaatttggggaatctgggatagaggtctgagactcctcctacccctcagcagggctatttaaatggttaaatggaaaacaatcagaagaaacaggacaggaagggtggactccccatactgctggcttggtaagtcttttagctacttgtgactcagaatgtggctgaggactattagcatgggcttgggaacagcatcacctgggagctggttagaaatacagaattttgggcccacccagatctgctggatcagaatctgaattttagcaagatccccaggagatttatatgcaacttagcatttgggaagcagtgctttaatttcacagagcctcggtttcttcatccattgtaaattatggataatgaaatctactttaaaaggctctcgtgatcctaaatgaaatataacaaatgaggatgcccagtaaagtgactagcacacagtaatcagtggtgaacgtgttttggaagatcccatatagttgggtaagtatgactgcaacccactgggactttagttctgcttttgatgcaggacaggcaagcaccaaaattggggcttagcctgggagggttcttggctttgcccaggaaagaattcaagggcaagctggtgttgttaaatagccatttttattgaagctgcaatgtatagcagcagcacctctgttccttgtggagcagggatattccataggcagtgtgcctggaatagcagctcagaggagtctgttctgtactcatatttatttttaattatatgcaaattaatttaaattataaatttgattatatgcaacccacgtttaattatatgcaaattaaggggtggcttatgcagaaatttctaggaaaagggtggtaacttctgggttgtagagtcattgccattaaaaggggctggagattgccatgttgccatggcaatagtaaaccgacatggtgcactggtggtcatgtcttatggaaagctgctcctgcctgggacctgttttagctagtcctcagtttggtctggtgtccaagccccgcctccagagtcaagtccctcctcctagctcactttgatctagttccatcacaacacataaaagtagggtgctggctcttaagagctaatgatcagacttacagaaaatttgcaagctaattgttagcataaccattattaaaaattaaattatatacatttacaactaaattatattgaaagcaagtgtaatatgcaaaacatcactttccaatgattttactatatttggccatctgtgcttgtgaggttatttacatctactgtatctgcatggtggaaatgctgtgtaatggtgcacacttctagccaactctatgtcctgtgatgtcatttttgtaggctgaagtgaaccacagtgggtatatttacaccagagcaatcaataaacactacaaactggggctttccctcccagagaactagttgttaagcattcacaagcatgacacagtaaatatagcacttatggccacatgcagtggctcatgcctataatcccagcactttgggaggtcaaggagggcagatcacctaaggtcagtagttcgagatcaacctggccaacatggtgaaaccctgtctctactaaaaatacaaaaattagctgggcatggtggtaggcgcctgtaatcccagctactcaggaggctgaggcaggagaattgcttgaacccaggaggcagaggctgcagtgagccaagattgcaccactgcactctagcctgggcgatagagtgagactctgtctcaaaaaataaaaaaaataaaaaatatagtacttataattgctgcttgttaaaattaaaaaaaccctgggattggtgaggaattgcttttttgtctcaggtgacactcaaaatcattgatgaggaagttatgggttatacttgggtccactcttagtcttatttacaatcttttcataatgccttactgtttttttaaaaaattattcatggaagacaatgtgttttatttaaagttggcttaatctgtgaatacaatggggatccatgacattcttgtcctattgtataaaatctggaaattgtaggcattaactatacaaaaaacaaattgctttctcatttctttaggctaggcttctcactcctgcatgcaggcacagaacagaagaagggcaatgaccggccaagcttcagatggtgtaagaaaaagaagtcgaggcatggagacagcctttgggggaagaataatgagtacttaccttgacagaggggatttcaacaataggaacaaaataatgagatcatctaagaaggtggataattgaccagggcttataacacaggaatgcactgtcagtagggatttatgaccaatctcctacttgttgagtgggatgtgaataattaactaatttcttaacccactgagcaagggttaaagattgagtcacctgtttactcacagcctgtcagggagtgagtgttagcacctctacctggtggcggaggagggagtgcagagagagtgaatgcctgcagggccagagctgcccaggggtgcaaggtggactccggacctccccttgttaatgtgtctctcctgatttaatgcgtcatctttaaagaatcatcctcaattctgcagcaataaaaataaaaaccttccctttcaccttgcaagcctcccgcagaaagccccaggaagagccttgtcagggcagctgaggagacaattaataaccatgggtgatggatgaggtgcacgtggcctgtgcctccacttttatccctcttcccttctgctgccagttgggccccaggcccctgtgaagtgcatatgccttgggggtgtgatatattaagccatcattattcatccttaacacatttgcaagttttaattcagcctaaaataatataatcagagaaaatgttctacttgcatttaacattatactcacaggtttggattatatcatagatgtagttggggatggcatgggagggcaacaagcataaaatgcattgactttaccatgtatttcagttatatatttatattttacatgtaaattcataattatatatttatatctagataaaattatatgtttgtgtattatatataataatctatagttatgtatcactatctcactaggtgattgctgattaaggggaatactattacccacaatgttgaacacagtgcctggccatggaaaacactcaataaacggtgttatgaatattaaataattagccctgacggccaagttatctaaagtgcctatcaactatgaagcaaatttttggttccttttccttttgaggacttctaaaaatgtctcattggtcatcaagagagcaaagctgcatgttgtaggaaacttgcagcacagtgagtgtgggattccaaaatgctggataagtaagagacatagcaatagcttgatccatacaaacactgactactagcttgctgaagacaagactcatcagagaggcctctcgtcatctctccagggacaatgatattgcagaggtggacatttacccctcgtgttgtaggcagaccctgtttccctttctttaagttatggcttccacatatatggtcatatatggccccaggaacccaattcaggactcttgcaatcccacgggtattagggagattctacattgggcctggtgctgggggctcccagcatatgcgagacaagcagaggataggattgagctcagaggccctgaaggctgatggccaggtggatggtgatgaggccaaaaaatgaattgggaattacaaaagggatgagatcatctgttactctcccttccgacttgaagcttctgcatagcccccatggaagatttgctgtgtaatgttgaaatatctgtctatgaccccagagaatttgaaaataaagacattggtcatggttatccaagcagcagaagaaatttaagattgtaaaaacaccagcatgaaggccaggagattgtggtctgtgtgcttgggaaaggatgggattcaagcaggggcaggtgcatccaagtgttctccaaacctttgggattgtttaaattccaccacaggtgattcaacctacctgtctgctatgtagccgatactcatagagccaataaagaatcctacattcactgatgactggaataggtccaacatccaggagttggcacataccaggttaaactgccagcaggggagaagtgttccaagttgggagagaaaggaaatgaaatcctgttagaatcctgttggacataactcagctagggtactcattaaatattccttgaattgaactgtatagttaagtggcaataagccattgtttcttgatcatgccaattttcttcttcttctctctctctctcttttttttttttttttgtgagacagggtcttgctctgtcacccaggctggagtacagtggtgatcatggctcactgcagcctcgacctcctgggctcatgtgatcctcacacctcagcctcccaaaatgctggcattataggcgtgagccactgtgcccagcctcagttttctttacataaccaaaaggcttgcccttccatctggcaatttgtcatgaagctaaaactacagcattggctaaatcagctgaaactgggtaattacttatagacaaatttattttttcctttctaatttcaatgcacatgcagataggtgtgtggacgtgatacaatgcaggcaccaggaggttgggccatttagcatctccctgctgtctgtttaataaaaggggattaggagtgactgctgaaggctgctgcatttgctcttatttggaataagaggaggtggtcgggtggagcaggtgctggaccaggtcaggagacccatcttttagggctaaccctgctaagttattcactgtgtggcctggggaaaaaccttctctgcttggggcctcagtttcctcatctctgtaggaagcaatgagattggccatgtgagagagcctcggagagtttgtggtgtgaagcccatgagctgccacatttcctgtaaatatctgaccactttagacccttcaaattagactctacctacccatctgttcacacagaatatcttcccattgtccaagcagtcattttaaattaaactaggcaactggctctctcagtattttcaggtaacttaattcccctattttgctttgctttcaataaaagcaagctccattttttgtctttttttctattatatttattggaatcaggcttcacaaatagcttttgatgtcatctgtagtttttaacaaaataatagtgccatagcatgatctccagccccaaatgattttatatgaacactttgaggaaattaaagagaaaaaataggtatcgagagaaaagcacatcctatcacacagtcaggcacagttcagttgagttccacgggctttcaggtgtgtgtgggcatctgcgggatggaggaatagagggggaggtaaggcttccagaaaaagaggaggatccacaatatccctatcttggcaacatttccaggagtcctaatatgctttggcctgttccttattgctgggacatgcacaaactagaatcattattgtcagcatctgaggacgttttaactaatccagttattctccagacaaattagaagctgcatgttctcatttggaaactaggattttgtaagatacatgcaggccaaagagatgtccaggcagggtttataagagccgggccttccctgcttgcttccttgagaaaatctccaccatttgcttctccatctgagccctgagctcactctcttacctcggtgacgatggacgagccaggcgtctcgtacacccagccgtcccggcaggggcccagtggcaggcggctcctgttggtgtccaggctggccagggggtccacgcagtcgaaggtgctctggttccagtccacctcgtagcgcctacactgtcttggggaggcttcgcccgcaggtcctgggcccggcaccgtgtagttcagttcctctgcaggactccagccgcagcgcagactcagctcggccactccggggctccggcagcggtggtcaggggtgaagcccaggaagacgatgcccacgtagatgggcgcgaaggtagccgagagcagagccaagaggaaaaacatttgcttctggaaaaagtgaaactcccctccatgctccaggacatcgtccacggtggtgggcatgatcctgcaggcaggagggcccgaggctgcccgacgtgcccggagcgaggctgagagcggctgcagccagctcagcacaaaccctggccagaagtcaaagaggggagtttacctctgcaagtgaccagccttcagggcagggcctttccttggtccagctgacttcaaaggtgcacccctccagcgggggtgcatgtccttctgcacttcccaaatgccctgagctcactcccaggatgcctgtcgtgtttattataactggttctccacaggcttgtcggtgctccacgccagcagcacaaacaacccgccctctgtgtcccaccgcagggaatctgagtgctggcccatatcacagcccagtaatcttcccgtagtgccccgagcagccaggaacttaatatactcctatctcatgcgcaccgccagcttttcttcaaggccctatggagaaaacacacgtgtttggccacaaggcccagcgtgatgtgaaccaggatccgtgtcagaaccctggtccagattcgaagtgggttgcaagcctgactgctgggctcattctccaaccaacaacaagagccgtcgggatgcatgctggggctgcttgttttgatgttgtccagattttataactctgcttttaaaaagtgtttgctccaatctggtattcctgcgtttcaaccctgaagtgtccttccccttaacccatctggagggaaagaggaaagtgtttacgtcgcagacaggtcaagtgtaaatgcaggcaggtgtgtccaagccactatctttgtgtcctagatttttctgtcaaggtctgttggggctcagaaatccatgccccaaggtggaggcctcagaagcaaagtctctctctctgaccttctcctgccctcctgtctcttctctcacccatcattctcccccggggcaagccatagaactgagaatccttcttcctcaaagcagctcgtggaaaccagactcttttctccccaaagccagccagaaagcctagaaataccactgtaacttccccgctgcctttctgtgtaacagtgggccgtaaagaaatccagacccgcattccagaggagtcttgtccccggtgcctggaggaaggagtgctgcacagaggggccaagacggatctgaacagacaggccttgctgggttttcccctcagcctgcgaacatgggctgctgccctttttgtccaactacagttctatactgccatccagttttccctgtatctgtgggtcttcattctgaatgaaggctcctgtgtcatgtaaaacgtgatcaaataaatttgtcatgcttttctcttgttaacctgtcttttgttataggggtgttggccgtgagccttaggataaggaagaaagggatcacccctttctgctctcacacatcaggggcatctctttaggatgatgttgttgcatctaaatgcaagacaaacaggaaatttgtctttcctggtggacaaaaggattcttaatacatcgtgatcctgccaagtagagaaggtggcctgctgacatatctgcaaactaaataccagaaagttaacccgattttccttctccttcttttttctattggatagtcagcaggtgtaatagcgtagtctaaaaggagcgacccacggggtctttctccttgccgcagctgcaggcttcttattttcttaaaaaagcaaaaagcagggcgccggcaaggacatccattgacctccactgcggctgtgttgggcacacagaggcactctgcttcgtggtgccctgggctgctgccagccccgtttgctctgagctgaatgagggggctcagttctgtttagggacttcccattcgcagccagcatcgtgagtgcatgagccggaagccaaggctgctctgtctgcacctgttccccgtcaaagagctgtaggagggcgagttaaagagttaaaaagtgacagaggttgtcaaactttactctaccccaagggccaagagatgctcctgactgcctcttacaagaaatttgcagacacgtgcacttgggtttgactcacttaacatgtcaagacatcagatcttcacgtcatgagcaaggggcacaaggtaagggccagaagagctttgctggccaatgggaaacaatgttgaaatttgctacaaattacttagagggaacaatcagataaggagaagttcagacctcaggttgcttacagcaatgcgtttacacagtcattcaacattgttctgtggatgcacgagtcacagcacagctgccataaaatcaatcccataaggtgacagaccctacagagaagccacatgggcagtgagcaactcagggaaagaaaccacagagaggaggggtagacaccctacggtttgagtccaggtatcttgggaaattgtcacttcttttatgggggtgcttacatattcagaagcatgactggagtgtaatctgatcatttaatccatataacctggtaatatattataattaatgtcagaagtatttctcaacctcttatcaggtttctctgcaatgtaaataaatattgccccagtgtaccaccctttctacggcactgaggaaggccagttgtgcccagactaaccttctgggccccctgcacaaaaagacacgggggcagttagggtgggaagttaggatggatgaatcctacctatcccatggcaagccagacatcaggtacttagaggatgacatggcagaagcagtgagacccatcttcaatggaacgtaggcttttgggtcatttgttaagcaggatgattttagaaatcaatatctggtctattgaggtctatgcaacctgcttggctaaggtgacgtctacctgagacaaaaatgatagaaataggttgtctcacagtgacgggtgccatctgtcctctacgcagctaagatggaaaagcagtgggagcaaaggggagggtcagcagagcagcagagcctggactgtagcccagcctggccctaatgtatccgtgtcaccagggcaagttctaatacctcttgtaacagggccattatccctaagtcagagagctgatggatgagatcgcataggactattactgagcacagtggcttcaatagttggaagttattcacggagacactttcaccctctctattcctcccttgttttcttcctcggtgcaccccatccatccgtcacgtgccttgttctccttcctcaacttcctgctgcccacttgcatcacagcagggtgggctgggtgtagggctcctggccaggcacagtggcaggtgatctgtgggaggatcgcagagcctcccagagggaaggcagcttagaggacagtaggcagcaccatctgacacttcaattcctcaacacctgtcccaagtagttacacggaaatgctttcagtattggctgaacccaggctgttgttggactttacagattgctggaaatatcttcctcatagcacaacaggattcatcttccagaactttccacacatttggacactattctcccttttggggtcaggtagattaagttaaaaccttcctacacagaactttggatatttgaagcttctgtttacctccaactcttgtcttttcagagtaaatgttcccagctccccacatagtgaacatgttcttctcaccaccaccagggacagccctgaactctgttttggtttatctcttgcctccaggggaggagtctggggcctggcacatcacttgggtgggtcccccgggtgcgctgtagagccagcggttatctcctcctgcagagctggggctaacatccctcagtgagttcagtgtgcagaaggcaactctaaaccacttctattgccatcctgctgagcgaggcttccgggagggctgactagaactctccttgggctttcttcatcagtgtcgttctgattttattcatttctctttactggttctattttccctacaaaatgttagctctgtgccgatatcctttgaggcaggaaattggaattcgcctggtgatgataggaggcatctgttgggggaggagggggcatgagggtggctaactcacccctcctgtggttcccactccactttcctcttatactcccggccttcacaccaagcctgtagctctagaaatcacaaaaggactggaccctgttctttaaaaggcaaagcatgagtctaacacaaaaccacagagaggatccagcggacttcacgggtgtaattttgaagagttctagggaatcattttgtaaaagacccagttaagtaagtactaagttttctttttctcagatattcatttttaaaggctgtattattactctatgtaaaattaagtgcaaagtatttggtttggccctgggcttccaagttagtggtggggtttaggacatgccgccccaaaattcagaaccctggcatttgagaaaagaggcagaggcagaaagatctctcacgttccctgctcttctcccctgaagcaggtcagtcataggacctgcgtttgagacgtgccctgttgatacctggaggaaagaaacgtccttatctctgaagacacaagacttcagagatagatctgaacaaacacctcttcgtaagtttcccctggtttattgccattagatcatagcctgtttgtgcaatcacacttccccacactgtccactcttcaccaacctaagcttaaaaatattcagatttctctgtttctttgggccttctcttctgaaggccctggtgtcttgtaaaatatgggtaaatgtatatgattttcttttgttaatctctctcgtgttagtaggggccacagctgtgcacctagccatgggcaaggaaaagctgttttctccttcctcttccatgaggttaagtgtgcagctgggatgtgctgcaggaccagggccaggtgtggggctcatgcctatcacgccagtgctttgggaggccaaggtgggaggatcccttgagcccagtagttcaagaccagcctgggcaacacagtgagaccctgttcctaaaaaaatttaaaaaattaaaaaaataaaaacatgccacaggaccactgctcagagctctttggtctggcaaccctggaccttcacatggttttgtttgccaaagcaaagtccttattaatatccaaatacagtttgagttttcttgggctttatcctctccagaaacccaggagtgtgtcaacttcttggttgcattgctttcttcaaagagagagtgaatccggtagagatagaaaggatgtcctttacgtatcccacagcggcctcacggagaacgataagagaacaatcattaaaactttcattgccataattttctgctttcgttttttaaaagtttgggttagcaaccaatttcctccttgaccaggtgattttttccttagactgtttatccagagcattaaggaaaacagagcataccaccctcccaccatagctgataaggggattcaacacaggtgcgtgtgctagagttaagggaacatattatgctaacatgaatctagactgacttaaaaaatagatgtctgaagcaagtcttttaattcacagcaaggctgtggctcaccactggaagtgtaactgttgtaatctggctagagaggaaagtccattacattttaatttttttatgacttcattcagcctggagcagggtgaagtggataaaagagagagttgtcgtcttagaaaaattgctgatttcagatcagaagaaggaaatcaacatcaagagcctgggacattctgttgggccaaaacaaaataaacaaaacaagaaagctgagactattgactatgttgacaggaataaggggccatctgaaaatgctcccattggcctaaagtgggggaatttggacattaaaaaaaattaactgcaacagactaggagtggtggctcacacctgtaatcccagcactttgggaggctgaagcaggtggattgcttgaggccaggagttcaagaccagcctggccaacatgctgaaactgcgtctctactgaaaaataaatatgaaaattagccaggtgtgatggcacgtgcctgtagtcccacttacttgggaggctgaggcaggagaattgcttgaacctaggaggtggaggttgcagtgagccaagattgcgcccctgcactctagcctgggtgacagagtgagactctgtcaaaaacaaaaaacaaacaaacaaacaaaaaacaaaaacaattaagtgcaacggattgaaatacatgaagtatattttaaaaatctatgagtatgagttcataatgatgtttttaaaatcccatgaaataatgagtctcaacattgatctgcaatagatattaagtttactcaatgaaatgctgatgagaaatttcgtattggaggggtcaggctgacaccatcactagaagtgggaaaacttgactttatgggctgcgtgttgtaacgcaattggttacaacacacagcatataacctaaaacataaacctgaatgcactcaagcctctaaatctgtcaatttacagcatgtgttggggataaagtaacaagctaaatgacaatagaaggaagcaatcagacaaatgtaggattcagaacattctgccaatgacctgggttctccaaggaatccatgacacttcagagacgtaaaaccagacccaatgagtggactgtgtttggatataactgtgaaaaaatatctttcaaaccatttgaatgtgggctggatattaaatgatattaaagaattatttgtaattttattaggtctggtcatcatggccttgctttaaaaagggaggcctaattaattagaatatatcatactgaagtatttgtgggtgacatggcacattgcctgctattttatttaaaatacttttttattaataaaagtgaatgcagatggagaaaacaagagtgtcaaaattaaagccaccaaaatgtagtcactgtgacaaaggacattacccatgagccacgtcgggccttctgatccttgtgcctctgggggcatccttggtcagctttcagtggctttcttactttattagtttcaaaagaccttcctaaatccatccacttgttcttttagttttttactgcctcatttttcctactgtacaagttggtgtcaacgaagtggtatttgctagaatgaccatggctctgggaaacatggtttgggaagagaaaggataaaagggtggggggtgaggaaccttcgattccttggtggccacgtgctcagccgtgtgtggagccacagttgtgctgtgctcagttactaaaagtgaaagttatcagtggtactgagagatggctccagctccctgggagctggttcactggatgtgtaaggaaatgcaaactagggtaaaatgttcaattccttggttattgttctatgtaacagctaaaatgaaactaaaaggcagtgctggctcagaccttgatgctagaccaagctcagatttcagtgggtctgagtttcagccactggcctgaaagccaccctcaagggaaaaattatgcaggaacaacgtgaagtatctctaagatctctggtcaccagcaggtagtccatgtggggagagggccaaaccagaagaccactgaaaccagaggtgccgtgtgaaggaactgttcattttgtagatcagtatcatcagcttcctgaggagtctttagtaaaaatgggttatgacagcaacaaatataggatgaatatctttggtttggaatgctgcagagtggaagagcgtgtttgggttcatgcagtacccacagcttgctatggaacaatcacaggtggctctaagtgatcagacacacagaaggttattctcaagggaacagccagcctggtggactggttacagtcactgtaagatttgtgtatcctgagaagagggactgttgtctcctcctatgactgaagtggagcaccccagatgaagcggcggacatgctttgcgtgcaagccatatgggactgtctttttgatgaccgcgatattcacctgttaaacatgcctgttacccatgtatagcaatatatatataatagagacagagagagagagagagagatggagtctcactccgtcgcccaggctggaatacagtggcatgatcttggctcactgcaacatccacatcccgggttcaggcaattctcatgcctcagcctcctgactagctgggattacaggcgcctgccgccacgcccaactaatttttgtatttttagtagagacagggtttcaccatgctggccaggctggtcttgaactcctgacctcaggtgatccaccctcctcggccttccaaagtgctgggattacaggcatgcgccactgcgccctgccgtaaagcagtattaattgggcatgctaaatgggaaccagtgagaccgtctgagcccacaggggagagttgaagctggagtcttggtatggccagattctctctgtgttaggtctgtgtggtgtgtgcactggagcttacatcaaagcctgtgagcacctcccagcgacaactactgggactctagactggagaattctcatttaaagggtatttactaacttggtctcagacattagtggaaactactcttatgactgaaggacataaaatgatcttaaaacatgaaatacccctgatgtcttgggtgatatcagagaaatgctctaatgggaatggcagtaccctagaagagtcctgtaataaaatggaagtggtttattcaggatcatgctgcctagggaatacaaggaggcgatatgagcagggagcccattttcctctaggactgaatctggagctatgtgaggagcttctggattctatcgtcagttgaacagagccctgtcaacctctctcaactgaccgacgaagagttgcttggtttgtgggtggcagttccaaggtgaagagacacacagtcctgttggaagggctactttgatcaaagcaggctaaaacaaatcaacttggtgggctgaaatgcatgctgttacctaacagtgatggaagaattgaagggttgtagaagcgcctgtgtttggggttttattgacttttgggcagcgaccagtggcctggccatacactcagcaagagggccatggaaacctggctattaaaaggactcccccatggagcacagccctgtggaaatctgagggtgcattaaagtaaaacaagtcaatgctcatcagaactcccttccagattccaaaggtgactggagtcaacaagcagttatccctgtgtcctcccctgatgtgggcagctgggtccatgaaataagtgggtagctgcagcagtgcagagatgggctgaatctagacatgttctgtatagacgctgactggtctgggctttgcttacccggtggaggatgcaaatgctcactgtgccattcaaaagccagaacagaagatattgcaccaatttggatggcccagtcacatttctttagaccaaggaacacactttacagcctgtaatatccaacaatgggcagagctagtctcctccgggtaatagtttgatagaaaagtagaacaggcaattcaaacattagttgtcctaaacggggggagatgaagacacgaagggctggcttgcacatcttcacaagtgtagtgcacactcaccatgagtggggctaaaggcgtgttcccctaacactttcctccgtttcctggtggatctggggtagaggggtgggaggatgctggtatgactatgcagttcttgccaagggagaagtacccaggcataatgactgcaattttttttccttccctctccacatcacgttaactttttttcccctacctgatgcaggggtcataggcccagggctgcaattataaatgctgacagcagggatgattcctaagcaggaaattgtcactatgtttttaaaacttgtgtcagaattcccaagggcctgatggggatgggttgtgccttcaccccatctggcaaactggggttgacacagaatgaagctatcttgtttggtggtaagtatagcccacggctttgtaccctgtctgaacggagtggacccagggaggggcacctgctagacca

SEQ ID NO: 1319 - DNA, 202319 bp, Homo sapiens
gctgactagaactctccttgggctttcttcatcagtgtcgttctgattttattcatttctctttactggttctattttccctacaaaatgttagctctgtgccgatatcctttgaggcaggaaattggaattcgcctggtgatgataggaggcatctgttgggggaggagggggcatgagggtggctaactcacccctcctgtggttcccactccactttcctcttatactcccggccttcacaccaagcctgtagctctagaaatcacaaaaggactggaccctgttctttaaaaggcaaagcatgagtctaacacaaaaccacagagaggatccagcggacttcacgggtgtaattttgaagagttctagggaatcattttgtaaaagacccagttaagtaagtactaagttttctttttctcagatattcatttttaaaggctgtattattactctatgtaaaattaagtgcaaagtatttggtttggccctgggcttccaagttagtggtggggtttaggacatgccgccccaaaattcagaaccctggcatttgagaaaagaggcagaggcagaaagatctctcacgttccctgctcttctcccctgaagcaggtcagtcataggacctgcgtttgagacgtgccctgttgatacctggaggaaagaaacgtccttatctctgaagacacaagacttcagagatagatctgaacaaacacctcttcgtaagtttcccctggtttattgccattagatcatagcctgtttgtgcaatcacacttccccacactgtccactcttcaccaacctaagcttaaaaatattcagatttctctgtttctttgggccttctcttctgaaggccctggtgtcttgtaaaatatgggtaaatgtatatgattttcttttgttaatctctctcgtgttagtaggggccacagctgtgcacctagccatgggcaaggaaaagctgttttctccttcctcttccatgaggttaagtgtgcagctgggatgtgctgcaggaccagggccaggtgtggggctcatgcctatcacgccagtgctttgggaggccaaggtgggaggatcccttgagcccagtagttcaagaccagcctgggcaacacagtgagaccctgttcctaaaaaaatttaaaaaattaaaaaaataaaaacatgccacaggaccactgctcagagctctttggtctggcaaccctggaccttcacatggttttgtttgccaaagcaaagtccttattaatatccaaatacagtttgagttttcttgggctttatcctctccagaaacccaggagtgtgtcaacttcttggttgcattgctttcttcaaagagagagtgaatccggtagagatagaaaggatgtcctttacgtatcccacagcggcctcacggagaacgataagagaacaatcattaaaactttcattgccataattttctgctttcgttttttaaaagtttgggttagcaaccaatttcctccttgaccaggtgattttttccttagactgtttatccagagcattaaggaaaacagagcataccaccctcccaccatagctgataaggggattcaacacaggtgcgtgtgctagagttaagggaacatattatgctaacatgaatctagactgacttaaaaaatagatgtctgaagcaagtcttttaattcacagcaaggctgtggctcaccactggaagtgtaactgttgtaatctggctagagaggaaagtccattacattttaatttttttatgacttcattcagcctggagcagggtgaagtggataaaagagagagttgtcgtcttagaaaaattgctgatttcagatcagaagaaggaaatcaacatcaagagcctgggacattctgttgggccaaaacaaaataaacaaaacaagaaagctgagactattgactatgttgacaggaataaggggccatctgaaaatgctcccattggcctaaagtgggggaatttggacattaaaaaaaattaactgcaacagactaggagtggtggctcacacctgtaatcccagcactttgggaggctgaagcaggtggattgcttgaggccaggagttcaagaccagcctggccaacatgctgaaactgcgtctctactgaaaaataaatatgaaaattagccaggtgtgatggcacgtgcctgtagtcccacttacttgggaggctgaggcaggagaattgcttgaacctaggaggtggaggttgcagtgagccaagattgcgcccctgcactctagcctgggtgacagagtgagactctgtcaaaaacaaaaaacaaacaaacaaacaaaaaacaaaaacaattaagtgcaacggattgaaatacatgaagtatattttaaaaatctatgagtatgagttcataatgatgtttttaaaatcccatgaaataatgagtctcaacattgatctgcaatagatattaagtttactcaatgaaatgctgatgagaaatttcgtattggaggggtcaggctgacaccatcactagaagtgggaaaacttgactttatgggctgcgtgttgtaacgcaattggttacaacacacagcatataacctaaaacataaacctgaatgcactcaagcctctaaatctgtcaatttacagcatgtgttggggataaagtaacaagctaaatgacaatagaaggaagcaatcagacaaatgtaggattcagaacattctgccaatgacctgggttctccaaggaatccatgacacttcagagacgtaaaaccagacccaatgagtggactgtgtttggatataactgtgaaaaaatatctttcaaaccatttgaatgtgggctggatattaaatgatattaaagaattatttgtaattttattaggtctggtcatcatggccttgctttaaaaagggaggcctaattaattagaatatatcatactgaagtatttgtgggtgacatggcacattgcctgctattttatttaaaatacttttttattaataaaagtgaatgcagatggagaaaacaagagtgtcaaaattaaagccaccaaaatgtagtcactgtgacaaaggacattacccatgagccacgtcgggccttctgatccttgtgcctctgggggcatccttggtcagctttcagtggctttcttactttattagtttcaaaagaccttcctaaatccatccacttgttcttttagttttttactgcctcatttttcctactgtacaagttggtgtcaacgaagtggtatttgctagaatgaccatggctctgggaaacatggtttgggaagagaaaggataaaagggtggggggtgaggaaccttcgattccttggtggccacgtgctcagccgtgtgtggagccacagttgtgctgtgctcagttactaaaagtgaaagttatcagtggtactgagagatggctccagctccctgggagctggttcactggatgtgtaaggaaatgcaaactagggtaaaatgttcaattccttggttattgttctatgtaacagctaaaatgaaactaaaaggcagtgctggctcagaccttgatgctagaccaagctcagatttcagtgggtctgagtttcagccactggcctgaaagccaccctcaagggaaaaattatgcaggaacaacgtgaagtatctctaagatctctggtcaccagcaggtagtccatgtggggagagggccaaaccagaagaccactgaaaccagaggtgccgtgtgaaggaactgttcattttgtagatcagtatcatcagcttcctgaggagtctttagtaaaaatgggttatgacagcaacaaatataggatgaatatctttggtttggaatgctgcagagtggaagagcgtgtttgggttcatgcagtacccacagcttgctatggaacaatcacaggtggctctaagtgatcagacacacagaaggttattctcaagggaacagccagcctggtggactggttacagtcactgtaagatttgtgtatcctgagaagagggactgttgtctcctcctatgactgaagtggagcaccccagatgaagcggcggacatgctttgcgtgcaagccatatgggactgtctttttgatgaccgcgatattcacctgttaaacatgcctgttacccatgtatagcaatatatatataatagagacagagagagagagagagagatggagtctcactccgtcgcccaggctggaatacagtggcatgatcttggctcactgcaacatccacatcccgggttcaggcaattctcatgcctcagcctcctgactagctgggattacaggcgcctgccgccacgcccaactaatttttgtatttttagtagagacagggtttcaccatgctggccaggctggtcttgaactcctgacctcaggtgatccaccctcctcggccttccaaagtgctgggattacaggcatgcgccactgcgccctgccgtaaagcagtattaattgggcatgctaaatgggaaccagtgagaccgtctgagcccacaggggagagttgaagctggagtcttggtatggccagattctctctgtgttaggtctgtgtggtgtgtgcactggagcttacatcaaagcctgtgagcacctcccagcgacaactactgggactctagactggagaattctcatttaaagggtatttactaacttggtctcagacattagtggaaactactcttatgactgaaggacataaaatgatcttaaaacatgaaatacccctgatgtcttgggtgatatcagagaaatgctctaatgggaatggcagtaccctagaagagtcctgtaataaaatggaagtggtttattcaggatcatgctgcctagggaatacaaggaggcgatatgagcagggagcccattttcctctaggactgaatctggagctatgtgaggagcttctggattctatcgtcagttgaacagagccctgtcaacctctctcaactgaccgacgaagagttgcttggtttgtgggtggcagttccaaggtgaagagacacacagtcctgttggaagggctactttgatcaaagcaggctaaaacaaatcaacttggtgggctgaaatgcatgctgttacctaacagtgatggaagaattgaagggttgtagaagcgcctgtgtttggggttttattgacttttgggcagcgaccagtggcctggccatacactcagcaagagggccatggaaacctggctattaaaaggactcccccatggagcacagccctgtggaaatctgagggtgcattaaagtaaaacaagtcaatgctcatcagaactcccttccagattccaaaggtgactggagtcaacaagcagttatccctgtgtcctcccctgatgtgggcagctgggtccatgaaataagtgggtagctgcagcagtgcagagatgggctgaatctagacatgttctgtatagacgctgactggtctgggctttgcttacccggtggaggatgcaaatgctcactgtgccattcaaaagccagaacagaagatattgcaccaatttggatggcccagtcacatttctttagaccaaggaacacactttacagcctgtaatatccaacaatgggcagagctagtctcctccgggtaatagtttgatagaaaagtagaacaggcaattcaaacattagttgtcctaaacggggggagatgaagacacgaagggctggcttgcacatcttcacaagtgtagtgcacactcaccatgagtggggctaaaggcgtgttcccctaacactttcctccgtttcctggtggatctggggtagaggggtgggaggatgctggtatgactatgcagttcttgccaagggagaagtacccaggcataatgactgcaattttttttccttccctctccacatcacgttaactttttttcccctacctgatgcaggggtcataggcccagggctgcaattataaatgctgacagcagggatgattcctaagcaggaaattgtcactatgtttttaaaacttgtgtcagaattcccaagggcctgatggggatgggttgtgccttcaccccatctggcaaactggggttgacacagaatgaagctatcttgtttggtggtaagtatagcccacggctttgtaccctgtctgaacggagtggacccagggaggggcacctgctagaccagtaatgctcccagcaatctagaccagcacagtgtctgatctgagtgtcccttccaagggtggaaacgtttgggtctaaacaaagagaaggagaaatcatagctgagggtaaaggagtgaataaaacgctcctgtaatgagggaagtctcatattatattaacactgaaaatgctccagagcaagagatatcattgcctcttagctcaattatcccagatgcccagaagggtaaagctatgtgtttgccgaggccactcctgcttttgaagccctacaggacagggtggaagcctgcaaatctgagtagccccaccctgggagacatttccataagatatgatgatggactggactaactattaatgaatgagtgggattctagtcatgtgacagtatcttttgagttgtatatcattttgctgtaagagattggtggccagagacagggggcggactgtgatactgtactatagtaagaaatatctattggtctctgccccgagttcctggcacagacctcccaaaaacccttgtaatttcctgggcaataggggtgctaggtgcatcttttattctgatgtttggtctttgactctggttcctgacacaaaactcctaacccctggcatttcctgggtggcaggagcgtctttttttcctggtggactcctgcatgggggctggtcaccagaaagaccaagccatctcctctgggaagagaagaggggctggaaatggagttaataatcaatgacacgtatgtgatgaagctgccataaaaatccctgaactgcagggtgtggagagcttctgggttgttggacatgggggagtgcctggagggagggaaggttccctctgtgccccatcctcatgctctaccctgtgcatctctccatctggtgctcatctgtatcctttacaatatccttgatattagtagtaaactggtaaatgtaagtaaactgttccccggagttccatgagatgctttagcaaatgaatcaaacctgaggcggaagtcatgggaactcctgatttatagctgattcattggaagttctggaggtccagccttgcaattggcatcatacaggcagttttgtgggactgggcccttaacttgtggatggcaactcccagtagatactgtcagaattgatgtgtggggaaaaacccggacatctggtcacagaagtgttctgtgctgtgctgagagcataggaggggaaatcagtttgcttgtgttttcctgccacgtaacagagcctcttctgggagaacctaggattctcttctttcaagcctgatggacacaaaggacttcatctccctgggtccttccttctacacaggattttctttttaaggcttttaagcacaatcaccatggaaaaaaaggacagaaggttactgttgggttcccccaaaatatatgttgaagtcctaacccccagcacttcagaggtgaccctgtttggagacagggctgttacagatgtaattacttgaggtcctgctggggtaggtgggccactggtccgatgtgcctggtgtccttacaagaagagaagagacatatgcacatggctgtggagatgcaggcagaggctggagcgctgcagctgtgagctagggaacaccagggatccacgtccaccccaggagctgggagagtcaaggaagcgttctcccttacagatttcagaggcggcatggccctgctgacaccttggtaccagacttctggcctctagaaccatgggagaataaatttctgttggtttcagccacccagtttgcggtcctttgtcaccacagccctagaagccaacacaactatggcagggggttccagaatctagtagtaattctgtgatgtgcttcacggcaaggtggggagcatctttgctgatcggcttctcactgaaatctccaggccctcatagtctcactcctgtattcctagggacaaagcatgctatagtctgaattttggtgtcccttgccaaattcatatgttggaaactgatgcccaatgtgatagtattaagaggtggggcctctgggaagtgattaagtcacaaggaccccaccctcgtgaatgggattagcgcccttataaagagacttgagtgagcttcctcgcccttgctgccatgtgagaaggcagcaacaggacaccatctatgaaacctcacaagacccttaatctgctggcatcttgaccttggacttttgagccttctgaactgcgagcaatacatttctgttgtttatgaattggtcagtttaaggtattttgttacagcagctcaaacggattaagacagagcccaaccaaacacccgctccttggatcgctcccctccttccttttgttgcctctcccctcattaaggaacgggaagggagagatgagggataaacaagcgtggtgacggattggtcctagactgatgcggatgacgtatgcatcagagatttcctgggccttgctctgactttggtcttccagcagtgcgcaggcctgctctgccccgctctgccccgctctgctggcctcagccttcctcattcatcattgttcacctcactcccatccaccttcttccctttttcccaaacctatcctgatgagaagtttgaattctgttttaaggaaagaccttccaatgcagtgtggagtgagggccattcccacatacatacacactccatactcttttgaagcgattttgtgaattacaaaaccaccataattttcaggagtagtggcatgtcttagtaggaaatgttgaatggaatcacaaaaagcttgagaataagaaaaataaaaagataggatgtgctgacatttttgaaagccctaaaataatttggtgcccatagtgggaaccttgtcatacttatttacatagtatggaaggctatttgacaaaaaaatcaaatgaggtataggaatagtaactcattataaattggggacaataaagccaaattccactggattttaaagttatacaaatgattctctagtccctaaattagggatataaaagtccgtaggcagctttggggctgaaaggggttctgtaagcatcttgctgtataatggagcaagtcctgacccagaaaagaatctgtactttgtcccagatgggctataacttgctctgtgactgccatcatgtgtgttctggcagagattcataggcaggcagaggagtggggaagcttcatagcagaaaagggaaggtgtcaggtgtgtgctgactggaggctgctggccggggaagctggaacgaagtgggctatccagaggtggtgtatccatcctctgtagttggttagggcacttagttcactctctccagttggggttgattgtagagttctaactttttacgtggtctggccattgtccatgtgtatattcagtctctcccaagctagtcatctggtaagtgaccaataagctttagttactcaatacaaagaaaccaaaccagcattagatggggaggagagttccatctagagatctaacactgtgatagtggaagcagtcccaaagaatgatagcctatgataccatgcttgggggtgtggccttccggtctcatcagaaaaagtacagagctcagagcagaatcacatggaagcagctctcccctagactctcctagatgttaggtctctgagatcatagtaatgcagtcagcaatgaaacctacctggttaattagagaaacacagctccatcaatgtaagagagaagtctggtaagccttcttatggaaaattctttacctattttcccttcaaatattgtttctgctccattctctcaactttctctcaactggaatctttccataaataagttggagcttttcattcttttctccatttcttttcactttttgtctatattttctatctctttagttctctgggtcaaagtctattttgtgttctcagatgtagtttcggctcactagttttcccttctgttgcgtttggcttacagtctaacttgtctgtggcattttattttaatggctgaatttgtacttatggtgttttttcagtcaatctccttgttctttttaaatgtgattttgcattcttatattacacattaaatacttcctttatatgttcaaactttgaaaacagacccacttaaaatatttttcacattcccttatttttctgttcctgggagtgagttacccccaactcttagctttatttggggaagtcagtttcagcttctcatcacatacaggcttgaggccacaaattctgtttctccttgagtactaaactccagtgccaagggattcactgcaccccatggactcaaatcatgttgaaactcaagagccacctctctgatttcagtttccttctatgactttatgactctatgactctatgactctagcacctttcttgcttttgagctctctttcccacaatggttctattcagcatttatctgtgggaggagcagccaggtctgctcagtctcacatgttaaccagtgtcaatgagtatttgtaatgcacctactgtatgcccactggggctaggcactgaggatacagaaataaacaaggcatgggcttttccctcaagaaatttatagtccaaaggaccagacagcaaatgaaccaacatttataataaaatgcaagatgtgtgatggtacaagtactgcaggttttatggaagtccagggggggcatctgactcaggcttaaggggaagtaaggggaggtcagcaaagaaaatgcatgttcttctaagcaaagatcttattggaacaaatgaatgagaaagggcatttttgtggggaaagcattttggctttattttctttttaaatctgtgtgtaggccctaaacccacagtcgtacacggacatccttgcctccctacttctcatagtatgaggctttcgtgacttgcgtgtttcctttcggcaccaaaggtatcatctgatgaatcatttattcagcaaacatcatgcaaacagttattaaggtcacttcccaaaaggttaattttactgcttggatataggttataacctggaagactttgaatcattgccaactgccattgtaaatatttatgagaagtttgttcccaatgtcttaggaagctttattctgttgtttttgtttttctgtatacattaacatggataaagaaatatccatgttatgtgccatccacatatttttggtaaggtataaaaattaggctgggcatggcaggtcatgcctgggcaacacagtgagaccctgtctttacaaaaataaaaaaaaattagctgggcatggtgactcacatctgtagtcccaactatttgggaggctgaggtgggaggattgcttgaccccaggaggtcgaggctgcagtgagctcttgactgcaccattgcactccagcctgggtgacagagtgagaccctgtcccaaaaaataaaataaaataacaaaatgaaataaaaattgtttttttttatattgaggataaaggatctggaatgaaagaaatatactgaactatctgtaggaccataagatgtttaagctggatgttaccttgttgaaaatgaggtaaatctaggtgaaaacagggtttcttaccctcagtacaattgaaattttgggtcagataattctttgttgttgaggggtttttctgtgtattgtaggatgttgagcagcgtctctggtctttattgactaggtgcccatagtcatgacatgctgcatgtccccagatgagaacgcctggtccagattctttattctagagctaagaaatgaaggctcagaaagggagggtgatatggcttagacagccagtgagaatcagaatttggaccagcacctctgggttgctgactttataaggctcttctcacaaaaatgaactgcaacaaaacctgctggctaatattagcctctcaatcccatttgcatcagagccctgggctcagaccctcagaataatgtagcttctattgaaatactcaaatttggcaagcttgtcctgtttgagttgtctccaattcacttaagaaccaggatttttgtgaaatttcaatgacagtcattgagttgattctgagtgaccaaaatgttccttccaaactcacactctttttcaacaagtgtctgtttctctttccgtctgcttgtgaaaaaacaaatcctttgagccagtcccagaggattattttatacttgatcattttccatggtactaatgattgagtgactgcatgcatgcttgccaaacagtaaataaatccgtacatagcttttgttcattggataatcgggtgtaatatatgcaaagttaaagttcacttcatgaaaacacccggttttatttgaggttttttcttctggtcagtgaacccaaaggcctagggaaaaaaatcaattcacatttttgaaacactgtggtcctgccatttgcctctcattcatcatgttgacaaacaagtgtaagggaaaacagagggtgaatgagaccaggctccagaatgttcttcttcggggagcgtaccgttgcgggcgcagccctctctggttggcaagaggctccctcacctccaggttgcccagggtcatttggcaggcctgtgttggattctgacactttgcagagctgttgtcactgagaccagcggcttgtggttgggaaagaccacccgagccagcgagtgatcagtgacattcaagctaagctcaatttatgtcagtatgccagtgacgaaattcacaacttgattctccctcagggctgccgagtgtctgacgggacaaatccttccaacggccgcagcaggtgcttcttctagccctgtgttgcaatgacctgcagctcctggggataactcaggcacgctgctgacgccatcaggaggctcaacaccctcacccgcttacgctacgaccagcaaaagcaaaccccgcagctgcctgccagccgggaagaaggactgtgtttccatgttgtgagtctcctcattgcagccagatgatgaatttgctgctggctttgtgcgaaaccgagaaatacccagcgtccagctgagggcccgggtggcaacaaaatcaagctgatgaattaaagaaatatggcctggtcaggatgcctggaggcctcagagttctgatctttcttctgagttactacatcttctgaactgctcccaggatggtgtttgtgataagttggtttgcccagtaaaactgtcgcccagtggaggcaagccctacctcctgtcctttctcatgcagtggtgtggagcgtggtggggaagaaagggcgttcgacagcaagtcaaaaactttggatttcatttgtggctgtgacactgggttggggtcagtggctcagtgttgggagggtctcatttctctccaactccatagggctgtgagatcacccacagctttgatttgcatgtccaagctcatcccagcactttctcctcagaatctggctaacatttcaagtcactcactagcttccagaactatggttagctcagactcagttgtagcttccccaaactgtcatcctactgtttttatcttacagctgaaggaactgaatcccaaacagcccgagcaacccattcagaatcacaccacagatttcctcacccctcttccacaccacagagccttcccatttttacatgtcttttatattaagacaaaaccaaaaactcataattaagtcagtagtgtagaaacctgaaagatattttgttataaaaggttcactgtaaaccaggatttagaaaatgcaaacccttgggtaaaatgaagtgttttcaggacactcaccagcaggatccctggccccaattctgagaatgtgaccataaggacaagaggcctgactggtcaccccaggccaggccacctctctgacagtctgggattctccctgcatgccccagatccatcctaatgatgaagctcaggtgctgagagcaactgatcagatgttggcaggatcatctaaatccataggcagccaagcagccactctactttgcctggcagagctgcagcaggcacctgcagacaccacccaagagacagttctgcagtggctgaaatgtctggaatctgtactcctggagcagtggcgagtgggcacaggtggctatggagacttagaatggggctagtgcaagtgggaaactgcatttgcagttttatgtcattctaactggtttaaagtttatgcagccacatgtggttagcgactaaggcactggacaacacagttagaaaagtccctctcctgggcactgccagctgcaggcacattcctaacctaagatgtcctgcttgttcctctgggtgtgtgggctgcagtctcagtgtctgctcgcgcatgtggacacacctgcctttgccagcacataactcacccacccgttcgcacacacatacacatgcacccaattcaccttgactttgagtgtccatgtcttttcttggccccacctgcagtcttgatgccccaggtaggaatcttggcatgttgagggaggggcctgtgggaagcaaactgcattctcgtccttactccgtgatcgtcaaggattcacccctgccatcttctccccctgacctcagcgagagcactgttcagcagtttgcctaaccgagaatccacagcttctcgtccctgtctggctccctgtctcggaagcaatgttctcgcgtcttcctccagacaggcagctgctggcatcttcacagctccctctctccgcggctgaagtcaggacccacagatggtgccgctcgttttcctcagcagctctgcttaccgcatttacaggggtggcagaagccagtgcgaatgaatattaaatcaactaaggcagaacttctcaaaatacactcctcaaaacaggttttttcttttttctttttttttttaaccccacaaactgagtccattttggcttcagcgaaaaccacactctcaccttcctttctgtgaattaccaggaaatagttcaattttacttttttttttttttctgtcaaacattttcttcctaaactttttggctgctacctgttttcaagcagacggctaatccggtagcaaatgaactgggtttttcttaggcttgacatatctctgtcaacagcctttttcttttttttaaactaagcccagatttttgtgcaaaaccgagaaatacccagtgtccaactgagggcccgggtggcaacaaaatcaagccgatgaattaaagaaatattgcctggtcaggatgcctggaggcctcagagttctgatctttcttctgaatgactacatcttctggactgctcccaggatggtgtttgtgataggttggtttgcccagtaaaactgtcacccaatgaaggcaagccctacctcctgtcctttctcatgcagtggtgtggagcgtggtagggaagaaagggcattcgacagcaagtcgaaaactctggatttcatttgtggctcttacacccctttttgaaaggagttttgaagcaagcttgcatgcggttacacctgaactctcagttaagagcaattccatcttccagttgcttgggccaaaaacttccatatcagtcttaactcgtatttctctcatacacatatgcagtctggcagctccacctccaccaaatatggaaatctggatgccattcctacctcccctgccaaccccctggtccaagcgaccatggcctctcagctgggtgaatgcaagagacccttctctgatctccttgtatcacccttgagcttttaaaatctatttcccacccagaagcctaagaaccccattcctcctctgtggttctcctcctcactcaggaataagccctgcacgatctagagccccttcctggcctctccctgcacaggcatcctgccctcgcttccccttcccccttccccgttcctcacccctcccccgcctctttcctgtcgtccagcacaccctgctccacctccgtgggcacttgctgtttcctctgccagaacactttgttcccagtatcttcacaacccaatccctcacttcctccatattctggccttcctaagcattttatctgaagttccagcatcctcttgccccaacacgtaatacagacacacattcctggctttagtgttccttgctaacatttcgctcttgaaagcatatcttaggcagttactctgtttattttcaatctcccgcgtaagaacgtagcttcctgagggcaggaatttgggtctcttttgttcactgctgtgacctcgttgtccagaggagtgtctagccctccgtaggcactcgggaaaagttaagtgacttcatgagggcgtcttctccacagcagtacccacattctgtattgtggtgtcaacactggcttactttgaaatgactggcctctaatgtagagataacccaaccctcaacacagtcactgcccgactcttcaaaagccctataaccattgaggtaggttattaaacttagtatcataggctttttaaaaaaacaacaacaaggatttttgaggtataactggtgtacaataaactgcataccatttaagtgtaaagtttggtaaacattgatgtgtatgcatcattaccacatgaaatataatgaatatgcccattatctcctccaatttccccatgccctttgtaattccttcctcttgccccctacccttttctacacaactattgatttgttctctgtcactatagattcgcttgcattttctagagttgtaagtagatgaaatcatgcattacgtacttttcccctagcttcatttgctcagcatggttattttgagaatcatcgatgtcattgtgtgcatcagaatccatttctttttactgctcagtagcattccacatttatccactcatctgttgataggcatttgggttagttccagtttggagctattactagtcaagctgctataaacattagtgtacaagtctttgcatgggcatctgctttcatttctttgtgtaaatacttgggagtgaaaatggttgagtcatatgatgggtacatgtttagcttttaaagaaactgccaaactgtttttaaaaatggtcataacattttgcactcctgccaatagcgaatgagagttcctattcctccacatccttgccaacacttggtatggttggtctctttaattttagtcattcaagtggctatgtagtattctctcactgtgctttttatttgcatttctctgatgatgaacaactttttaaggtataattgccatgtattaaattacacatgattacaatatacaatttaatcttgtacatctttttgtttacttgccatccgtatatcttctttcataaagtatgtgttcaaaccttttgtccatcttttattgttcattttttactgttgagttttgaaagttctacgtatattctggatgcaagattgtatcccaagattgtaaagatttctcttatgatttctactataagttttatagtattcagttttggtcacgtatatatttatattctctatgatgtacatgcattaaatttatgactcactttgtgctaatttttatatctgatgtgaggtaagtataaagttaactttttggcatatgagtatatcctgttttttagcagtatttgttgaaaaggctatgctttctccactgaaatgcctttgcacttttgtccaaattatttgtccatatatatggatctatttcgggactctgttttcttgcgttgatctatttggctatctttatactaacaccatactgatttgattactgtagctttacaataattcttgaaaccaagctgtgatggcactccaacaaagttgttttgtctattttagctcctttgcatttctttctttctttctttcttttttttttttttttgagacagagtctcatcctgttgcccaggctagagtgcagtggcatgatctaggctcactgcaagctccgccttccgggttcacgccattctcctgcctcagcctcacaagtagctgggactacagacgcccaccaccacgcccagctaattttttgtatttttagtagagacagggtttcactgtgttagccaggatggtctcgatctcctgaccttgtgatccacctaccttggcctcccaaagtgctgtgattacaggcatgagccaccgtgcctggccaggtcctttgcatttctatatgaattttagaattggcttgtagaattaaattctagaaaaaaagacttctggaattttgacatagattgtgtagaatctatagaacaatttagtgagttaacattttaacaacactgagtcttctgtatgacatatcttcctgtttattaggtcttcttaatttttcttgttcatcttctgtaggtattcaatgtagaggccttggatatcttttgtaaatattttccactaagaatttattatttttggtgctatttaatttcaattgccaactgttgccagtatataaataaacaatttttgcatatttattctgtatcctacaaccataataaattattagttttagtagtttctgttgctgttgttgatgtcagatgccatcagataattctaagtagataattaagtcgtctgaaaataaagaaaaattagttttccctttccagtctagatattttttctttttctcgcctgagtgagctgtatatcctccagtacaattttaaatagaagtgcagagagtgaacgtcttgttctgttaccaatcttaagggaaaacaattagtttttcacgattaattataatgataaccataggttactcatagatccttattatcagattgaggaagttctaatcttagtttgctgagagtttttttttaaatcacagatgttggattttgttgaatgattttctgcatctatcaagattatcatatggtgtttcaattttaatttgttaacatgataaattttattgattaatttttaaatattaaatcaaccatgcactccttgaagaaatcccacttggttgtgatgtattttctgtttgaaaatttttttgacttagttattaatattttgtttagaatttttgcatctattttcaaaaggaacattggtctatagttttcttttcttgtaatatcattgtatgattttggtgttaaagcaatgttagtcgcttagaatagtttgggaagtactccttcctcttcaagttcctggaaaggtttatgcagaattgaaattatttctttttaaaataattggtagaattcatcaaatgaagacatgtgaacctcggattttcctgttgaagaggttttaactacaaattcaatttaatagatacaaggttattcaggttatctgtttcttcttaagtgagttttggttgcatgtgtcttttagaaaatttatccatttcatttaagttgttgaatttataggcaggaagttgttcatatcttcttcttatctttttattatctgtagactcttgtgatatcacttctctcattgctgatattggtaatttgtgcattctcaattttttttcctgatcgttcttgctacaggtttatcaattttattgatcttctttaagaaacagtttttgtgttttattgattgtttatcaattttattgatctttaagaaacagtttttttgttttattgattgtttttaatgctttctatttcattgagttgtactctgatttttctttttttccccttttttgtgcttactttgggtctaactttctctttttttctagttttgaaaggtgagatctgagattattgatttgagatcctttctacttttaactatagccatttggtgctcccagtttccctctaggtacagatttagtgttattccatataatttggggttttatgttgtcatttttatgaaattcaaaatattttctaacttctctttgctttcttcatagattcatgggttatttagaactgtgttctttacttttcagctatttgaagatttttaagtgatttttctgttattgatttataatttaatggtcagaaaacatactttgtatgaattaaagcattttaaatttgttgagaattattttatggtccagaatatgactatcttggtaaatatgatatatgcacttgaaaggcatgcgtattctgctgttgttggatggagaattcaataaattcacaattaggtcatttggttggtattgctgttcatgtcttctataacctttagtttctgtctacttgttttatcaattattgaaagagtggcatttaaatctgactataattgaagatttctttgtgtctttgtttctcctttcacatatataagtttttgcctcatggtttctgaagtcctgttgttaggtacataaacttttatgattgtagtaccacttgatgaattaacccttatcttagtgaagtaaattttttaaactgtgtaatattatttgctctatatttgtctttgtttgatattaatatccacttcaaatttcttttgattagtgttagcatgtcatatctttttccatccttttcattttaacctgcttgtttctttatatttaaagtacatttcttataaacggcatttaaatgagttttgctttatttatacactctgacaatgtttgcctttttactttattagctttatttagatctattagattttttatttagatttatttagctttatttagatttaattagatttaatgtaattatatagttagattaaagtctaccattttgatatttgttttctatttgttttgcctgttttttttcctttttccttatgttctttcttcttttgaattaatttttttaatacctcatttaatttgctttgttgacttattagatagaggcttttgctattttagtggcttctttagggctgatagttacgtacttcaaatggtatatgactttcatatagtacaagtatgtataatagttgaactctgtatttttcttcttcaggttttatgctatgttgaaacacattttacttaaaccacagaaatctataaaatccatagtgacttacttttaaaaaatgtcttaaaaatgaagactttgttgttaaaaagaaattatttttgcccttaaaatgtcaattatgtttaaaaagattttaaaaatagaaaaaaattacatatttgccaaaatcataccatttctgatgtgcttcattccttcatataaaccactagttctcaactgggtataattttgcccctcaggggacatttggcaatgtctggataccttcagtttttattgctgtcataactgaggaaggttacccctggcatttagagggtagaggccagtgatgctgataaacattctatagtacacaagatagtccccacaacaaaaattatccagcaccaaatgtcaacagtgccaaggttgaaaatcactggtataaatccatatttccatttagtttcagtttatgctgaaagagcttctttttaacatttcttataatgtggctctgctggcgatgaattctttcaacttgctgagcatttagaattttttcttttattttgccttcatttttgaaaggtattttactgaatatggaatttattattgacagtttctttcttttagcacttaaaagtgtttcatcatgacctcctcacttgcattgtttccaaaaagaaatctgctgtcatccttattctttgttcctttgtatctattatctattatgtcttgttttttggcaccttttcagattcattagtggtttgtgcaatttaattacgaagtgctttggtgtgatttttaaatatttcttgtgctcagggttagatatgcatcttggatctgtgagtttatactttttttaaaccaaatttggaaaaatttcatctttttttaaaaatagtttttctgttgttcccctcttcactcttctttagggactcagttgcaaaatatacatgtatttggccatttgaagttgtcccacagtttgatgatgattttgtcatttttttaaagttcttttttcttcaaattaattttgaatagtttctattgctgtattttcagtcaactgatcttttcttctgtaatgtctaagtagctattaattcatatctggtatatttttcatctaacagtttatagtttttttctctagaagtttcatttggatctacttaacttcttgaacaactagaatacaattatatagttataataactgttttatgtctttatctgctaattcaaacatttgtatcagttctggatcagttttgattggttgagttttctcctcgttgcagacactttcctgtttctttgcatgcgtggtgaattttactttggtgctgagtattttgatatatctatggatattatagagctttgttctagaaggcagtcaaattacttggaaaaatttgatccttttgggtcttgctttaaagaatctttacttggaacagagcactgcttcatcacaagctaactattccacattactgagaaaagactactttgtgtgccctatctaatgacacattaatcctgatgcttttctctctcagtggtgggaagaggctctttatctggtcgtggtactcttctctaatcctccatgacacttccttccccagcctcacatagtttccttacatgcatgtgcttatcaacactctgctaaattctttaggggcatgttccacaaatctcagaaatcctctctccatgcaactctcttcctctctggcactttaatcagcagactctaggcagcttggtctcccagagtatcagctatatttacttacagggttctctttacctagggagttcactgggtgccacctgaattttcttttcctccaccatggactggaaactttctcatggcagtaagctggagtaatcatagggctcatcttgtttatttcccatttctcaggattactgtcctttactgcctaatgtccagtgtcttgaaaactactgtgatatattttgtttggtttttatgattttttcagacaggaagataagtctggtctctgttattccatcttgatcagaagcagaagttgtaattggatgagtttttggttccttctaacaaacatgtatgcacgttgctatgcttttacattgcatatgtacaatggacattttctctaagtaaaatcgatccttgtttttgtactggaactaaacagatgactaattcatgggttttgtttgttaggtaaatcatacctgccaggtactgaagatgctagagaattcctacccttgtttatctacctatcataaatgtgcattcacagatctcttttcccatcaaaagagtgtatctccttttcagtgggattcttctttgctcctatcaaggtttctcttggaatttagttaagcttactccttaaaattccagcttttccttccctcagaattttacagactgacttctccttaagggaccatctcacatttcttttccagtgttaaaaatctaagcctaaagtttcatgcgtgtccgtgtgaagagaccaccaaacaggctttgtgtgagcaacatggctgtttatttcacctgggtgcaggcaggctgagtccgaaaagagagtcagcaaacagaaataggggtggggccattttacaggatttgggtaggtaaaggaaaaaagggggttgttctctggtgagcaggagtgggggtcacaaggtactcagtgggggagttttgagccaggatgagccaggagaaggaatttcacaagacaatgtcatcagttaaggcaggaacaggccattttcacttcttttgtggtggaatgtcatcagttaagtcaggaaccagccatctggatgtgtacgtgcaggtcacaggggatatgatggcttaacttgggttcagaggcctaacattcctgtcttcttatattaataagaaaaataaaatgaaatagtggtaacgtgttgggacagcgaaaatttttggggatggtatggagagataatgggcgatgtttctcagggctgcttcgagcgggattaggggtggcgtgggaacttagagtgggagagattaagctgaaggaagattttctggtaaggggtgatattgtggggttgttagaaggaacatttgtaatttagaattattggtgatggcctggatacagttttgtatgaattgaaaaactaaatggaataagagaaggagaaaaacaggtataaaaggtctaagaattgggacgactcaggacatctgattagagagtgcctaaggagattcagcgtagtcctgtcagcaaagattatttacttacttcaagagttaagagtggcagtatggggatagcaccaggagatatcagctgtgattgcttggagaaacagcgtaaaccggcagtgtaaacaagagcagggcatgtatgagtagttgagaatggtgaataggagtatgactagacagaagatagtagggatgacaagtttttttggggcacagtctaagttagtctagtgtctggaatgagactggggcctaataaaaaggagcgtttatacaggagctcaaatgcgctgtaccctgtagcattctgaggacaggtctgacttctgagaagggaaagtggtaaaagtattgtccagtcctttttaagttgatggctgagcttggtgaggtgtgtttttaaaagacctttagtccgttctacttttcctgaagatggaggaccataagggatataaaggtttcactgaatactaagagcctgaaaaactgcttggctgatttgactaataaaggctggtctgttatcagactgtatagaggtgggaaggctaaactgaggaattatgtctgacagaagggaggaaatgactgcagtggcattctcagaccctgtaggaaaggcctgtacctatccagtgaaagtgtctacctagactaagaggtattttagttatctgactcagggcatgttgagtaaagctaatttgccagtcctgggtgggggcaaatcctcgagcttgatgtgtagggaagggagggggcctgattaatccctgaggagtagtagaatagcagatggaacactgagaagttatttccttgaggatagatttctacaatagaaaggaaatgagaagttctaagaggcgggctagtggcttgtactctagcatagcctgcctttgctggtgtgtgacgattaggcctggtggaactgccatcaataaatcaagcgtgatcagggtgaggaacaggaaagaagaaaatatggggaaatggggtgaatatcaggtggatcagagatgcagtcatggaggtcaggtgtggtatcaggaataatgtgggaggccagattgaagtccgggccaggaacaatggtaattgtgggacttaacaaagagtgagtacagctgaaggagctggggagcagaaagtatatgcatcaggtatgaggaagaaaatagattttggaagttatgagaaatgtagagagtgggttgagcatagtttgtgattttgagggcctctaaaagtattagggcggcagcagccgctgcacggagacatgatggctaggctaaaacagtaaggtcaagttgtttggacagaaaggctacagggtgcggtcctggctcttgtgtaagaattctgaccacattaaccatgccttggaaggaaaggagttgttgttttttaagggattgaggtttgggagattaatcggacacaatcagcagggagagcacgtgtgtttttatgagaattatgccgagataggtaacagataaggaagaaatttgggcttgactgaagtaatgggggctgtctatgaagctttgtggcagtacagcccaggtaatttgctgagcctgatgggtgtcagggtcagtccaagtgaaagcgaagagaggctgggatgatgggtgcaaaggaatagtaaagaaagcatgtttgagatccagaacagaataatgggtagtagagggaggtattgaggataggagagtatatgggtttggcaccatggggtggataggcaaaacaatttggttgataaggcatagatcctgaactaacttgtaaggcttgtctggttttaggacaggtaaaatgggggaattgtaaggagagtttataggctttaaaaggccatgctgtagcaggcgagtgataaccggctttaatcctttcaaagcatgctgtgggatgggatattggcattgatcggggtaagtgtgattaggttttaatgagatggtaaggggtgcatgattggtcaccaaggagggagtagaggtatcttatacttgtgggttaaggtgggggaatacaagaggaggacgcaaaggaggctttggattggaaagaagggcagcaatgagatgtagctgtaacccaggaatagtcagggaagcagataatttagttaaagtgtctcggcctaataagggaactgggcaggtggggataactaaaaggagtgcttaaaagagtattgtctaagttggcaccagagttggggagttttaagaggtttagaagcctggctgtcaatacccacaacagttatggaggcaagggaaacaggcccttgaaaataaggtaatgtggagtgagtagcctcggtattgattaagaaggggacagacttaccctccactgtgagagttacccgaagctcggcatctatgatggtctagggggcttccgaggcgatcgggcagcatcagtcttcagctgctaagccaagaagatctgggaagcagtcagagagcattgggccagagttccaggggctctgggagtggctgccaggtaagttggacagtccaatttccagtggggtcccacacagatgggaagcggcttaggaggaatccggggctgcaggcattccttggcctggtggccagatttctggcacctgtagcaagctcctggggaaggaggttctggaggaacacctggccagtgcagttcaggcgtttggaagttcttgtgtgctggagatgtgggtggggtttgtctcacagtggaggcaaggaattgcaacttttttctattattgtacaccttgaaggtgaggttaattaaatcctgttgtggggtttgagggccggaatttaatttttggagttttatttagtgtcgggagcagattgggtaataaaatgtattttgagaataagacggccttttgaccttttagggtctagggctgtaaagtgtctcagggttgctgccgaatgagccatgaactgggctggatttttatatttgatgaaaaagagcctaaacacttctgatttgggataaagaaaaaggaacattaaccttgactatgcctttagctccagccatctttttaagaggaaattgctgggcaggtgggggagggctagtcatggaacgaaactgtaagccggaccgggtgtgaggaggggaggtgataaaaggattatagggtggaggagcggaggctgaggaagaattaggacctagcttggcctggcgaggagcagcctggggaggaggggagaggtcagatgggtctgtagaaaaggaagattagaaagactcagtgatgcttggggttgggactgaggggacaggtgggagggaaagaaggaagatttgagatgagttgcattgggaacagagactagagagggaccgatgtgtaaaagaatgcctggacgtcaggcacctcagaccatttgctcattttatgacaagaattatttagatcttgtaggatggaaaaattgaaaatgccgttttctggctatttggaactactgtcaagtttgtactggggtcaagcagcattgcagaagaaaataagacatttagattttaggtcaggtgagagttgaagaggttttaagttcttaagaacacaggctaagggagaagaaggaggaatggaaggtggaaggttgcccatagtgaaggaggcaagcccagagaaaagagaaagtagagacatggagggaaggggtttgggggttcttaccctccagaaaagtgggaaagggtttggggcacagagatacgaggtcagggcatggaaataagggattggggtacagagatataagaggttggggcatggaaataagggatcggggcgcagagataaaagaggttggggcacggaaataagggatccgggcacagagatataaggggttggggtacttgcccctcccctagaaaagcgggacttgccgctaagggtgaaggagaaggggttgggggtttcttgccccccagaaaggcgaagaaggggtagagacacagagagaaggggttggggtacttgcccctcccccagaaaagcgggacttgccgctaagggtgaaggaccaaggcaggcgtccttgcgtggtctgacacctctgaaacctgggtgaataatcagagaggtgtccctgcaatgattaaataccaagggaaggcttccttccctagtccatgaccggcgccggagttttgggtccacggataaaacatgtctcctttgtctctaccagaaaatgaaaggaattgaaattaaaagaagggagagattgaagtgtggtgccaagattgaaaggagaaagaggttgagggatagtgagggaggttggagaagagagtaaaaagaggccgcttactggatttgaaattggtgagatgtttcttgggctggtcggtctgaggacctgaggtcacaggtggatctttctcatggagcaaagagcaggaggacaggggattgatctcctaagggaggtcccccgatccaagtcacggcaccaaatttcatgtgcgtccatgtgaagagaccaccaaacaggctttgtgtgagcaacatggctgtttatttcacctgggtgcaggcggcctgcgtccgaaaagagagtcagcaaagagaaataggggtggggccattttataggatttgcgtaggtaaaggaaaaaggggggttgtcctctggcgggcaggagtgggggtcacaaggtactcagtgggggagcttttgagccaggatgagccaggagaaggaatttcacaagacaatgtcatccgttaaggcaggaacaggccattttcacttcttttgtggtggaatgtcaccagttaaggcgggaaccggtcatctggatgtgtacatgcaggtcacaggggatatgatggcttagcttgggctcagaggcctgacataaagtaataaaacttctaaaaaaaaatacttagcacgatgaggtcctgaggcacggaaatatttagacattttaaatagatattcaacaatgctgtaagtaactggtagaatttccataccaggtctcttcctatgtcactagcccatgggcacaagaggtcatgaaagaggaacagaaataggaaaacctgcatcaacacagaaacagcctgttctttgccagaatggagaacaaggcaaagctggtacttttagaaagctgaaaatttgtgccaatgatttttttcctagcttatttttggctttttgattctaaggagttttgacctacaaagatgctcaatatttaaatagacagatatttttgttttatttcttccattgcttttatacttcggcatcctccttactgagatgagataaagttttcaaaaacattgtatggaattattttctatgtatcattatttaattcatatggaatttattaagggcatgagataaaaaataatatttcttccaaaaggaaagacaactctctcagaccattacttaaaaaaatccccattgatttgtgaagccacttttataaaacatgtccttttggtgtatactatgatttgttgatgggttctcagctctgttctgtttatttttctggctcatcttacttccctagaatgctaattgaaattatttaaactttaaaatatctttccaaatttgatagaaaaaatctcctgtagaaaaaattaatataatacctattcgccaactattcttatttattctattttcttcataaactttatgttaacttttttaacttaaaaaaacattttctttgggattaaatggtacacctcaattatttagggagtattgctattttcatagtattttaatcttcccaatcttcctatgcagaaacattttgactttatttcaatttaaattattttaatatttcaatttatgcaactcagtaaacatacgtcgtgtgtgtatgtgtgtgtatcctatgcattttaaaataagattttctcaagttacttgtttttttcatgatttatattcgtctttgctggttgagggcaaaaatattaaggcccacacatttttttgtcacatcaccttaatagtttcctgtagttttcagttgattttatacggctttttctttcaccaatagatcactccacaatgtatgttatcttgtttcaagattccatttaaaaatacaaggaagtcttatgaaatgatggaaggggagagaccactaaacccaaacttccaaaatataatatcctcatcatatgatatattttgctataaaatcttagaattctttagaattgagtggaaatttaatcataccaaacctaattctttcattttcagggaatgaaatagagaatgtgacatgtagctgttgtcatgttaaatgttggggggtgaaagaaacattggtgaccactttatggcgagcagtcatcaacattccaatatgttatagtcacattacattttgtgacctgtaattttccccataagtcatttcagcatagccccctttgtcttaaatggacgtgctttatttcagaacagaggcagaagggaaggttccccagctgttgctctaagctgttgtctcagcacatagcacgctagcatggggccacatgttgcattggtcaaatctcaaggagtgtctgtaatgagccaatacaaacagatgaagcctctacatggaaactctctgctctagactcacgtttggccagggggcgtggcctggagggtgtaactcagggaactccacaggaatagtcccggctgggaacttgcgtccctaaacccaccaaaactgctataacgagctctgcgagtgtatactgttatttgctctgaaaggcagggctgttacccaaatcccctggagagagccagatttgcaaagtgtctgatgtgagcccagagatcagcaacagataccatagacctttctccccatctgcaaccagtcggaaataactctgtccctgctcacctcatctttgcttctgttgtggcttgaaaatcgtatgagagtaacatcctgggatgaaaaatgcagctcgactccctcaggctccactgcagctaagtcccccagatggctgaggatcatttatgcagaagatgggggactgaatctctgtctttttcttttaatgtttttgagacggagtttcactcttgttgcccaggctggagtgcaatggtgcgatctcagctcactgcaacctcctcctccagggttcaagcgattttcctgcctcagcctcctgagtagctgggattacaggcttccgccaccacgccaagctaattttctgaatttttaatagagacggggtttcaccatgttggccaagctggtcttgaactccttaccttgtgatctgcccaccttggcctctcaaagtgctgggattacaggcatgagccaccgcacctggccaaatttccgtctttataaaaaacattcatggccgggtgcagtggctcacgcctgtaaacccagcactttgggaggccgaggtgggcggatcacgaggtcaggagatcgagaccatcctggctaacacgatgaaaccccatctctaccaaaaaaaatacaaaaaattagccaggcgtggtggtgggcgcctgtagtcccagctacttggcaggctaaggcaggagaatggcatgaacccggcggagcttgcggtgagccaagatcgcgccactgcactccagcctgggtgacagtgggagactctgtctcaaaaaaaacaaaaaacagaaaacattcataaacgtctccaacaaatacagagtgaactcattgtgtgcctaagattctgagagttacaaaggatggggaagacctggtctcagacatcatggagctccataggctaagtatgggtgaggatatagggacaggcttccacgttcacttacagaatctctactagtctcacctgtaagtgctaagtgctagataggtatattaatggaacacatagaatcatttgaagggagcatctacattattgcaaatacagtgattcttgtatatattatctgtgaaagttacgaagaagtaaaaataagggaataccccagaacatcggggttggaatctctgtaatctttctcctcatctgtaagacggaagttgccgtatttatagatcacagtgttagtgcaatatttattgagaaaatgtaggtataagatttttgtaaacaaaaagtcctctacaaatacagttttgggtggtgagctttattagaaatagttttgttcaaattattttaccagcctacagagcatatgtaggtaacttctaccaggctaaaaaacaaacaaaactgtgcatgatcccaaaagagagcacatattagttagataaaccattggtttaagggtttagggaagacagtgattattttcatggttggttggccttggtcactgcatgggtgccaagaggccctgaaatgagttgtgtaaggtaggattaatcaggaagtcttgttggaagaggtgggttttgacctggcttaaagaaggcagtgccaggaggaagcccgagatggtggtggatttatccctaagaatttaggaacacaagttctgcttaaagctatacaggcacagtgtttcccaatgaaaacagagaactcagagtgtgtttttcagtcacaaccagcattcagcccttcctacttacaaattttaagactttggaggcttgtttcatggattatcagagacctggcctcaagggattaaggtcaaacatcggttcctcatgtggccgttacactgaattgttccatagtcacagtctgtacctctaaatgtgtgtgtgtgtgtgtgtgtgtgtgtttctagaagctttagccagggtgtggtgaaaaggtcactattctacattactagggaggggtatccagtgggggcactggcctcatgtttgcataccagtcagggatttactgaatgcccatattgcttttttttttgttcacctgttgctagaccatgaggtgaaggtctccaaggacaggggctgtgacatattcatcggtgtgtgctcagttcccagcactatgcctagaagagggtagttttcagtaaaggcatgagtgaataactgaataaacctctagcataaaaataaatataaggtatactttctatccattatgagctggtgaacactgtcccttgcttcatatttttattttttacagctctattaagatagaaatgacaaaagttgtatatatttaaagtgcacaacatgatgagacacatatatatcgtgacatgattactaaaatcaagctaattaacatatcaatcaccttacttttttttattacaccttacctttttttggtgataacacaagatctatctttagcaaattttaagtacacagtacagtatctttaactatattctccatgctgtaataagatctttaaaacttattcatgttgcttaactgaaattttgtactctgaggccaacatgtccccaaatcccctccctcagcccctgataacaaccattccactctctactcctatgagttaaacttttttggattctacatgtaggtgagatcatgcagtatttttctttctgtatgtggcttatttcactgggcataatgtcctccaggctcatccatgttgtcacaaacggcaggatctccttgttaaaagctgaatagtattccattgtgtgtgtgtgtgtgtgtacaccacatattcttcacatatttatctgttgatggatgctttaggttgatcccatgtcttgattattgtgagtaatagctgcaaattgcagcaatgatcatgagggtacagatgtctctatgagacactgatttcatttcctttggatgtgtacatagagccaggattgctggattaagatagcattacaggtaatacaggataagacgacattgcacctcgggtccaggtagtgagaaggttccctgccaccctgttacctggagcggtctgagggaggcaaccacactcaacagggagattgatctggtctccaaaagccaggatccaaaagccagctctggagtggagctgggaagtgatcctgctcccctgagggacactgagtcgttaactccaccttgtggtggctgctgagccctggccaccctgacaggatgcagggtgaaggctgggaggctccaggcacctgctgcccatgcccagcgtaaggcccctcagcatctgcttcaggaggaggaggactcccagggatggctgggggctcagtgaggcccgaagaaactctctggtctccaaaagccaggatccaagcctcatagagctgggttcccaggatcccaccctccagagcacggtccctagaaaggatgggctgcctacccttgaagcaggacaaggaagaagagcatgtagaggatgctggcagagtggctgtctgaacatcctctggatggtccaagcatggaagggcagctgggaggtttcctctcatatccccattttcccagtgatgagtgtgacattcaggggaaagtagtgagggtgacccagctcttctggcttcgagccagccctctcatcactgaaatgcgaaagccatctctcacctcccatgtgcccagggctccgccactgacttggcacttcatgcatgagctaggacccacctggtcatccagtgaaaacacagctgtcccaggacacaggtaagaagctggacagttgagttgtgggtggctcgatgagggcacccagtgaatgaacagtggcgtgggaccagacccagctctgcgctcttcgtgccccaccacggtggctaagctttcagaatcaattagtcctgctgctttatgtccttgccaacgtgtgtgttcatacttctggcagttggtttgaggaataccacagccaaaacctgctacaatgtggtctgcttcagagagctttgctcagtggcttccttctgtcatcttgagtgagttgagaaaaagaaagagaggatttgaaggtttattcgaggctgttctagagtcagcgaaacacttcccatatttctgtgggcatggccagatggggcattgagatgctgcaacaccaagcccacagtgggcattccaaagacaacacatgttattcctatataaatcaggcacagagatggcaaacatcttcttcatttaggttgtgttgaattgttcactcatcttggctatgtgggacttcgttatgggagaagacaatcccagctgtaggtaaaagcaaagggtgtagaaaaaagaaaaatacgtgtgggcagaggatgaaatggacttgaagaggtcacagagtgagtgaagacaaataaataataggggcaagggagggatatgaaaagtagagctcactgagtggtcagatttgtactttgcttaaccccaaaggggaagaagacgctatgtgttatttcataaatatcctgccatcagagagcaccacccaaccggcatcatttaccaggactgggctaacctaaaatgaaaccacagtcattgttgcttttgactgaaattagaaaaccccaggaaacacacaaccctataaaaatatttttttaaagagcaagtcaccatgtctctctcaaaaagaagtacagaccaagtcagagcagatgcacgctgtgcctgggaaaggacagcatgatccgatcagagtcaaagtacacacacacacacacacacacacacacagtctctttctctcatgcacatgaacacacatatatacacacatgcgcacacatgggcacacacatacacacatacacacgtgcacatacacacatacatacatataaacacacatatacacacatacacacatacatatctaaccacatatatacaccacgcacacaaatatgcacacatacatacacatattttacatacatacacacatgcacatgcacatacacaaacatacatacgcacatatacacacatacatacccccccacacacatatatacatatacaaacacgcacaacacacacacatatatacacacccatatacttacatatatacatacatatgtgagcacacacatgcacatgcacacacatacccatctatgcacacatacacatccacacacacatacacatacacacacagcctggattaattgtgtcccctgcaaattcctatgttgaagtcctaaccccgagtacctcagaatgtggctgtgcttggtgacagggcctttaaagggtgaagttaaaatgaggccttagggtgggcccagatccaatctgactggcgtcctgaggaaatttggccgcatacaaagaccagggatgcgcatgtgcagagagaagaccacgtgaggacacagccagaagacgagaagacggcttggtcttcctgtggatgggcgttccgttgtttccaatgttttgctgcaataaccatcctttgtgtgccgttatgtcccggaatatacttttatttctatgggacagatttccaggagtgggatggcaggatcaaaagtaaagattttaataaaaaccggcaattctgtgaccatctctaagaaactgtttgtttctttccatggggaaactgaggccctgagaggcatctgatttccacagtagccagggagcttcagcagattttggcagggctcagggaacccaggtacataaatccaaagatgacggactcttctccaggagccacttccgccagcaaagcttccctctaaatcttgtagttccctgtcagggagcagagtacaccccgcccccgccccagccttcagaagtcctgggctctgcccttcccctctggctccacactcagctaactccatgccgggcatggtgctgggccccggggcacgatctgaaggcgctcatcgcctgcaggggaccatgaccagcaaacccaaggtggttttacagcacatgccaagggcttggggagatccaaacagggcacctccgagacggaggaaagcaggggcagccagggcttcccagaagtgtgacacagcacgtcttcgctgttctggaagggcaggcaggggccagcccagcaaaggagtgggcagggtgtgtctgacagaggaagtgggtgggaggaggtgtggcccgtgcaggaaacacaaagtccacactctcccatccaggtgccagatgggattgggagactcggctaccctccacaatctcactctgccaggccccagctcctcacccatcccccactgcagcaggttctggccagcctgttgctttactcctgcactctccttaccattctctctaggaaaatccacgtattggctcccaccgtgtctaggatgccttccctggatgctgccacttgtcccttgtctcccacaagcagcccagtgcctggcgctttgtaggtgttcactgagtccctgtggcacttacctctggaaatccacatctggcatttgatgctatgctatgaagagttttaggctcgttagggccttgtcttttgcactcaccaagccctttgccgtgcacaccatcggggctcagccaggtgctgagagacacaaacagcatcctttgggtctctgtggacgttgcagcaacctcatttgctgagaatcatttacactgtgctgagactttgttgagaatgtggctgcacaagcaaaatcctccttcccccaaagtacagtaattcaatttccagccttcccatccaaagagcggggagatatagaataatgtcatacccacaggaagagaaaaggttttttgtatgtttctcttcccaccagggcagaaaaccattaagtattggcaggctgagctatccctgtctcttgtgagcttgtaaggatttcccttaggtatttggctcagggagtttttaggcagatctggtgtacagtttaaacacacttggtagaatcagtactgctctgaataagtgaggagtaagggatcataataaagcccattgctggggtctcccaggttccggagcttccctgtgctgcctgggcagtggccaagctcccagcatctcacccatgtcgagaacacagtcttctgatcagccaccaccctgcctgtgatggacacgggcagctgagacccacttattctgctgagacaggatcacgtgggcattcttgagtcttgccttttaaagacatactaaaattgtcattaaagctcatttctaaaggcccttttcttcagttaatattttgcagtctaaacaaaagttgcactttatctcaaattgaaagaacttaagaaatctatgtttgctggaagtaataacatattaaggaataggatgtttatgctaagaaaatgttcacttggggcactgtgctttgagataactgtgcaggcctgctctggaattattagacatctagtcctattctgtccatagggcagccatttgcagctgcaaagtaacttcaaaggcctcagaaagggtctaccttagaaaatagccagcttgaaagacttccatctattctgggcagaggctatttctagaaaacgattgccccgatagccgatctctaagagagccctttatctaagaggtgtcatctggttggattctgaaatcatctagtagggtttaaggtggtgcattaatcagaggagtttttttcaggaaccatgacaagagggcagtggggtcaatatcatcaatcctggcaggaagagccaggtgctgggaactggtccctgttcttctctgaacaagatttgcaaactcgggcaagtcacttagcctcaaaggcctctctagttaatgatctgatttatttaactttttggagatagttacagagtattaggtagaggaaagcattactggtgagtaaaagagaaacatatatccagtatagtccacactttctgacatgggttggtcccatttttccctgattaatgctatcaggatataatcacttagattacagtgcctggaagagggtggaataattcaggaaaagtttatgaaataggcaaatcttcacttgagtttagagggatggaggaggaacctggcctggaaggggaagaatgtcctgggagcgagaggatttgcttatctggtgccttgaggaagtggtggctggaatggagagttggtgctagagtttggataaaaagacaaaggttgagaaactagagtcataggaaaaaaatgtgttaattgatttgctgagctagataatgcatgggcttactagaaataagagctgtggattcagataagaaatctgctgatcagttccagctggttgatgtgttagtctgttctcatgctgctaataaagacataccagagactgggtaatttatgaagaaaaaaagaggtttaatggactcacagttccacttggctggggaggcctcacaatcatgatggaaggcaaaggaggagcaaaggcacgtcttacatggtggcaggcaagagtgtgtgcagggaaacagccctttataaaaccatcagatgtaagacttattcactatcactagaaaagcatgggaaaaacccacccccatgatttgattacctcccaccaggcccctcccacaacacatggggattatgggagctacaattcaagatgtgatttgggtgaggacacagccaaaccatatcattctgccccggcccctcccaaatctcatatcttcacatttcaaaactaatcatgccttcccaacagtccctcaaagtcttaactcatttcagcattagctcagaagttcacagtccaaagtctcatctgagacaaggcaagtcccttccactcatgagcctgtaaaatcaaaagcaagttagttacttcctagatacaatggaggtacaggcattgggtaaatacacccattccaaatgggagaaactgaccaaaatgaaggggctacaagccccatgcaagtctgaaatctgatgggggtcattaaaccttaaagttccaaaatcatctcctttgactccatgtctctcatccaggtcaaactgatgtaaaatggtggctcccacagccttggacaactctgcccttgtggctttgcagggtacaatctccctccctgctgctttcacagctggcattgagtgtctgtggctttccgaggcacgcagtgcaagctgttggtggatctaccattctggagtctggaggacaggggccctcttctcatagttccactaggcagtgccctagtgaggactctgtgtggaggctccaacctcacatttcctttctgcacttccctagcagaggttctccatgagggttccacccctgcaacacacctctgcctggacatccaggcatttccatacgtcttccaaaatccaggtggaggttcccaaacctcaattcttgtcttccacacacccacaggaccaacaccacgtggaagctgccaaagtttggagcttgcaccctctgaagccatggcctgagctgtaccttgggcccttttagccatggctggagtggctgggaggcaggaggcagtgcaacaagtcccaaggctgcacatagcaggggcgtttttccctcttaggcctttatgcctgtaatgggagtggctgccatgaagttctctgacatgccctggagacattttccccattgtcttggtgattaacatttggctcctcattacttatgcacatttctgcagttggcttgatttttttttttttttttagatggagttttgctcttgccacccaggctggaatgcaatggctgactgcagccttcacctcccatgttcaagcatgggattacaggcacccatgaccatgcctggctaattttttagtagagacggtgtttcgccatgttagccaggcacttaaatttctacccagaaaataggtttctcttttctacggcaccgtcagactgcaaatttttcaaacttttatgctctgctccctcttgaatgctttgctgcttagaaatttcttctgacaggtaccctaaatcatctctctcaagttcaaagttccacagatttctagggcaggggcaaaatgccaccagtctctttgtatagcaagagcgacttttccttcagtttacatcaagtttttcctctccatctgagaccacctcagcctgggctttattttccacatctctatgagcattttggtcaaaggcattcaacaagtctctaggaagttccaaactttcccacatcttcctgttttcttctgagccctctaaacttccaaactctgccttttacccagtttcaaagttgcttccaaattttcggatatctttacagcattgtcccactcctggtaccaatttactatattagcctgttctcatactgctaataaagacatacctgagactgtgtaatttataaagaaaaagaggtttaatggactcatatttccacatggctggggaggccacacaatcatggtggaaggcaaaggaagagcaaaggcgcatcttacatggtggcaggcaagagatgatgtgcaggggaactgccctttataaaaccatcggatctcgtgagacttatcactatcacatggacagcacaggaaaaacctttccacatgattcgattacctttcccaggtccctcccatgacacatagggattatgggagctacaattcaagatgagatttaggtggagacacagccaaatcatgtcagttggacttcatggactaggaaaataaaatttaaaaatagaatgattgacacagggttgccaacaagatactcaaaaacaaaacaaataaaaaaacaagccaaaccagcaatggcaaaaacgttatatggctggacattgtggcttatgcctgcaatcccagcactttgggtgtctggggcgggagtttgcttgaggctcagagttcaagaccagcctggacagtaaagtgagacacccatccagaaaaaacgaatgaaaggaaggaaggaaggaagggaggaaaagaaagaaaattagccaggcatggtggcatgtgtattgtcccagctacttgggaggctgaggcaggaatatcacctgagcccaggatgttgaggctgcagtgagccaagactgcactccagcctggacaactgagcaagaccctgtctggaaaaaaaaaaaaaaaaagaacacgtggatgtcagaaacagtgggaatcatctgcgaatttagaatagaagaaatttaaccttataaaaatgtaatgacattgtttttacactcctctcccattttgacagaaatgagcaaatgcagtcacagaccagcaccatgatctaactaacccattttgcagacaggatgatggaggccttggagatagaatcaaaatgtgccttgatgttcatgggctctttagtttacagtgcactttagtgagatctctgaaaataaaaagatgtgtcttttctttgcaaggggtcactgaagatagggaagtggtaacaagagatctttattttatactttgttattagctttagatcctgaatttatactataagctctagaagctttaaaacttgaatagaattaaaattgtagaattatgaaactaagaaggcaaacgaatctggtctgtcccctcatttaacagaagagccaactgaaccctgcgaagatcatgatttatcttggttcctgacacacagagctggacacgctgtgtctggttttatggccattcataaaacccagaagtcatgtgctgaccaccaaggttgaagactggcatcaaagtgattaagatcaataattgtagactaaaggtagtgaagcaaagtacatctgattggaatttttgatacaaatatttgtaataagaacatgttaaatagaggataatttaaaattggttaactcacacactgatatctgtggaagaatctaaagtaaacttcccaaatgcttgtgtgccgtgctgactttctaactgggctcagctgaggctctaggaagcctggacactcccaggctcgcctgcctgctgtgtgtattccactggggagagtgggggcgggtggggtaaccagggtgactccaccagatgccaggctgggtctgtgcccacacatggggccagccagacaacataggagcctgttcagcttcccccagaacaaaacgcaggattgttccagggctgcccaacagataggcaatagttacactggatgctactaaaggaaatcctgcctttagatcaggaatgctgtaaaaagatcaatcatgcctcatgcctgggaagtaccttcttaaaaagaacagcatcacctctgtcttatcatttattcccccacaatgatccaataaagttggtgggggtgtggaagctatccagaagacagagtaactcatgtctgggccaccaggccagtatttgccaggagctcaactaatgcttggatgaagaaagaaaggatggaaggaaggcgggggagggaagtgagggtacaggtggcatctctcttttagacaggagaaaacaggctcagggaaaaagtgatttgtccaatgtaacacaagggattgatggcaggaatgtgtatgggggtggggggctttgggctcctggcccaggtctcttgcttcccaggacccctccagggcctctcagctctttgctaacaggtacatttgagttacactttttaaaaaaatcttattttaattggcaaatacaaactgtatataattatcatgtacaacatgctgttttaacatatgtacacattgtggaatggctaaatcaagctgattaacatatgctttccctcacaaacatcaattgtttgtttgtgatgagaacacttaaaaatctcctttcttagaaattttcaagaatacaatacaatgttattaattgtagtcgccatgctacataatagatctattgaccttattcttcctgcctaacagaaatttgtgccctttgaccaacatctcctctcctctagcccctggtaactgccattgtactctctgcttctatgaattcgactttttcaggttccacatataaatgagatcacatagtatttgtctttctgtgtctggcttatttcacttcacatgatgtccccaagttcatccacgttgtctcaaatgacaggatatccttcctttttaaggctggatagtattcaattgtgtatatatactacattttatttatccatttatttgttgacggacaccggttgatcccatatcttggctactgtgaatagtggtacaatgaacatgggaatgtaggtatctcttcaacatactcatttcatttcctttggatatatacccagtagtggaattgctggatcataagttatttgtaatccatactgttatccataataggtgtacaatttacattcccaccaaatgtggaagggttcccttttctttacatccttgccaacacttgttatctttcacctttttggtaaaagccatctaacaggtgtgagttgatgcctcattgtgattttaatttgcattttcctgatgattagtgatgtagagcgtttttcatataccagttggtcatttgtgtgccttcttttatgcaatcttgtttatctatttttgcatttttttcctgtacttttgggtcatatcaaaaaaaattattgcccaggccaatgtcaagaagtttttctcttgttttcttctagtagttttacagcttcaggtcttacatttaggtccttaatccattttgattttatttttaatatgatgatgttagacaaggatttaatttcattcttctgcatgtggatatccggtgttcccaataccatttattgaagaaactgtatgtgcttggcaccattgtaaaaaaccaactgactggccgggtgtggtggctcacgcctgtaatcccagcactttgggaggccaagcgggaggatcaggaagatcaggtcaggagatcaagaccatcctggctaattcagtgaaaccccgtctctactaaaaaatacaaaaaacaaaattagccaggcgtggtggtgggcacctgtagtcccagctactcaggaggctgaggcaggagaatggcatgaacccaggaggcagggcttgcagtgagccaagatcgcgccactgcactccagcctgggtgacagagtgaggctctgtctcaaaaaaaaaaaaaaaaaaaaaaaaaaaacaactgactaacttcatggatttatttctgtgcttgctattctctttcactggtcattgtctctttttatgccagtgtaatactgtcttgactattatagctttatagtatattttgaagtcacgtagtatataatgtctctggcttttttcccctcaatattactttggctatttggggtctattgctttccatatggattttaggattttttttctatttctgtgaaaaattttactggaattttgataggaattgcatcgagtcaatagacggctttgggtagtataaacattttaactttcagtataaacattcttaacaaatttagtataaatgaatgtacctcagtgcaataaaggtgacaaacctttatttattcataaattgatattaatattaattattctaatccataaacatgagatatctttccatttatttatgtcttcctcaacttctttaatcaacgttttatggttttcagcatacagatcttttacctccttggttaaatttagtccaattatttggtagccatttaaaataggattgttgtcttgatttattttttggtagattttggtgagtgtatagaaaggataatgatttttgtatgttgtggatagaaaacatatccacaatttatgttttgtggataggaaacatatccataatatatgtttcgtggatacaaaacatatattgtggatacaatacatactgatttttgtatgttgtggacactaatttttgtatgttttgtatgttgatttgctattctgcaactgcactgaatttgcttattagtgaagaatagttttttggtggtgtctttagggttttctatatacaagagtatgtcgtctgcaaacaagaacaatttaacttcttcctttccaatttggatgccttttatttcttttacttgcctactggctctgggtaaaacttccattccataaaacttctattatgttgaatagaagttgcaagggtgggcatccttgtcttattcctgatgctagaagaaaatgcttcaacttttcattgtggaatatgttaactgtgggtttgtcatattaaagttttgtcatctttattgtgttaagatacatttatttatacctaacttttaaagaatttttatcctgaaaggataatgagttttatcaaatgctgttttttgcatctattgagatgatcatatgatttttgtccttcattctgttaatgcagtgtatatcacatttacagatttgtgtatgttgaaccatccttgcattcctgggggaatctcacttgatcatggtgaatgatccctttaatgtactgttggattcaatttcctagtattttgttgatgatttttgcatccatgttcatcagggatattggactctaattttcttttcttatagtgttcttttctgtttttggtatcagggtaattctagcctcataaaatgaatttgaaagtattcccttttttattttttggaaaagtttgaggaggatttctcttattagttctttaaacgtttggtacaattcagtagtgaagccattaggtcctggacttttcattgatgggagacttcttattactgattttaatcttgtactcattgctctgttcagattttttatttcttcctgctttagtcttggtaggttgtttgcctctaggaattaatccatttccttagttatacaatttgttggtatataattgttcaaagtagtctcttatgatcatttgtacttcttcagtatctattatagtgttttctctttcatttatgattttgtttgagtattctgtttttcttagtttagataaagtttgtccattttaattatctttttaaaaattatttcttagttttgtttctcttttttatcatttttctagtttcttgttcttctgtttctgctgtgatctttattatttccttttctctactaacttttgggttagtctgttctcctttttctagttttttgagatataaatgttagcttgtttatttgagatctctcttcttttttaaaataaatatttatttttatttttcactttttgtttgtttgctttttgagatgagtctcactctgtcacccaggctggagtgcactggctcactacaacctctgcctctcaggttcaagcaattctcctgcctcagcctcccaagtagctgggattacaggtgcctgccaccatgcctggctaatttttgtatttttagtggaaatgcagtttcaccacgttggctaggttggtcttgaactccttacctcaggtgatctgtccgcctcagcctcccaaagagctgggattacaggcatgagccaccacagctggctgtctatgtttcactgttttgtgacagagtcttgctctgtcacccaggctggagagcaatggtatgatcatggctcactgcagccttgacctcctgggctcaagtgatcctcccacttctgcctcccaagtagctgggactacaagtaagtcatcacaactggctaatttttctttctttctttcttttttttttctttgtagagacaatgtctcactctgtcatccatgctgatttcaaattcctcctgatctcaagccagtcctcctgccttgacttcacaaagtgctggaattgcagacatgagccactgatctgggccctctttcttctcttttgatgtgtttattgctataaacttccctcttagaactgtttttgctgcataccataagttactgatatggaatgttctgtatatgtctattagttagatttggcttaaactgtagtttaaatctgatgtttcattattaattctctgtatgatttgtccattgctaaaagtggagctcttaaagtcctctattcttattgtattatgctctatctttctttttagatctattaatatttgctttggttgacatatgtaggtactccagccttgggtacatatatttttacaattgttatattatcttaataaattaatctctttatcattgtattataatgataataatatattctttgccttttttacagtttttgacttaaagtttattttatctgttacagattgagtttcctttatccaaaatggttgggaccagaaatgttttaaattaagttttttttgattttggaatatttgcattatatatttactgttttagcattcctaatctgaaaaccaaatccaaaattctccagtgagcatttcctttgagcgtgatatcagcactcaaaagaattttaattttggagtatttaagacttcaggtttttggattaggaatattcaatctgtacaactatccctactcttttttggtttccatttaataaaatattttttccatccctttcctttcagtctaggtatgttgttataagtgagatgagtatctaacaggcaatatatagttggatcttattttttaaaccattcagtcactgtgtcttttttttttttttgagaaggagtctcactctgttgccagcctggagtgcagtggcacaatctcagctccctgcaacctctgcctcccaggttcaagcgattctcctgcctcagccacctgtgtagctgggattacaggtgcacggcaccatgcccagctaatttttgtatttttagtagagacagggtttcaccatattgttcaggatggtctcgatctcttgacctcatgatccccccacctcggcctcccaaagggctgggattacaggcatgagccatcatgccccacccactgtgtctttttattggagaatttaatcaatgttcattcaagatagttactggtaagtaaggacttactattggcattttgttaattgttttctggttgtttggtagatcttttgtttctttcttcctctctagctgtcttcctctgtgattaagtggtttttctctagtgttatgctttgattcctttttatcttttgtatatctactattggtttttgcttctggttactaggaaacttacaaaaaatcttagttataacaggctattttatactgttaacttaattttgattgcaagaaaactttacaccttcactctccacctccccacatttaaaatttttgatgtcaaaatgtatatctttttatagtatataccccttaacaaattattatagctattattgttattatttacttttaccagtgagttttattttttcagtttttttttgtaactaattagcatctttttactcagcttgcagactccatataacctttcttgtaagacaggtctgggggtaatgaactccctcagcttttgtttgttcagtaaagtcttaatatctcattcatttctgaagagcagcttcggtgaatacagtattcttggtttgtagttttttcttcagcactttgaatatattatcttactctctcctgacctgtaagtttcctgctgagaaatttgctgatagtcttactagaactcccttataggtgatttgcttattctctctttctgctttcagaattatctctttgtctttgatttttgacagtttatgtcttgatgtcattgtgtttgaactgaattgaattggagacttttgaccatcctgtacccggatatttatatctttccttgatttgaaaagttttctgttattatttctttaaacaagctttctaccagtatgtttctctctcttgaagtcctgtaactcaaatattagctcctttcatgttccttcataagttcaataagctttttcctttttaaaggataaattcctttttatccttttttcttttttcccctttgactgtatgttttcaaataacctatcttcaagttcaaagattctttcttctacttgattgattctgtatctgatgtgttctgttgaatttttcatttcattcattgtattcttcagtttcaaaatttctgtttgactgtttaaaacaacttcaatctctccattacgtttctcattttggtcatttattattttctgatttcattgaattatctgtattttcttaaagtttgctaaactcccttaaaacaattattttgaaatcgttgtcaagctgttaatatatctctatttctttgggaccaggtactgggagattattctgttcttttactggtgttacatcttcttggtttttcatgtttcttgttgccttacactgatgtttgcacatttaaaacagagacttattttagccttggcagactaaaaaaagtgtcctacacaaatcagcctgcccagagattctaggcaggctccctggtatagtttgtaagaaactttactgctggaatcttcaggcaggctgacctggtgcctgggcccatgtggtgggtctacatcctggatccactggggggacaagttgactgggtctatggggtgggcctggagcctgggtccagaagggcagccctggagggaatggcctgaagcctgggtccacaagagctgacctggcactggagtgggccttaagctttagtctgcaggggctttctgggcactgagatggtcctggggcttggatacattggggtgtgcctggtgtattggtccattggggccagcctggagggtgggttcatgagggctaacctagatcctcgggctgtagaggctggtttgaaacttaggtccacaagggatgaggtctggggggctggcccagcactgggatctactggcataggcctgtaaaaatcttcatagatcatggaatctttggctgagaaacacttgcttctgaacagaatgaggttctatgaggcctgtctaagtaggagttctgttaagctgtgcacttaacagagaagatgaaggtagtataatactgagagacaagagttccactcagccagagaagagtgacctcactgaacatgccaggctttcagctaatgtagcagaaaggccacatcttagaagtaaagctactctacttagagtaaggactattccagactcagcctaacagggtttaaaaataggcctcaaaagaattaagtttatctacctgtaaattttctgtcagcacaaaattatatggtttccagagaaagacatcaaaatatggactcttaacaatgtagtattcacaatacccaccattaggtcatacactgatggacaggtagtgagcaggaaaatgtgatccataatcagggggaaaaccaatagaaagtaaccctgaaataatctaaatgtggtaattagaagtaggcaaggactttaaaatcgttattataatatattcaagaaattaaaggggaaatgcttataatacaaaaataggcataggatttcagcagagtaatggaaaccataaaaatgaagcaaacagaaattttagaactaagaattaaaatatccaaaatgaaaaattaattggctgggcttaatagtagattacgtttgacaaaataaattatcagggaacttgcaggttaatacatgaacactgtcaattctgaaaaagaaagagaaaatagattgaaaagagattgacttgtgggacaagatgaaaaagtctatacacatgtagctggagttccagacagagaaaaaggagaatatagggcagaaaatattatttggaatacatgacttaaactttcccaaatttaaacttacagacccacgtaactcagtaaacccaagaaaaataaagacaaagacattcacaccttggcatgtcataggcaagctgttgaaaattgaagataaagagaaaatatttgaaatgggagaaaaaaacaactaataacagtgagaaaccacattaactacagggaagcaacaacatgaataatgactcacatcagaatgattcacatcagaattaatggagggagaatactttgaaaaaaacttctttaaagttcaggggaataaaaacaaccttcaacccagaattctgtacctagcaaaaatttcattcaaaaatgatgatgaaatacagactttttcaggtgaatgaaaatagaatcagtcaccagcagattcacattataaggaatagcaaaaaaagttattcaggctgaaaaaaatcgactccaaatgtaattgtagaagtacaggaacaagcaaggagcatcagaaatagtaagtatatggcacatatgaagattacacagttttttatttctcttaatttttaaaaagacaatactgtattggggatttataatgtatttagatatgataaatatgacaataatataactaaggatggtaataagtggaactataatacttcaaagtccttatattttatgagaagtggcacaactttaattctaagtagacagtgataaggatttatattgcaatccctacaggaacaactagaagaataatgacagacatgcagctgaaaatccagtgaaggaactgatgaacactgagttgtgccttctagatccctctaaggaaagacttgttgacctagcagcagggactgttgttggctgatgtcttctactgtcagacccttcagtaattatgttagcttcagaaaggcgtcttgcccactccttccttgggcagcccacattaaatgagagaacaataaaaaaaatataatgtctgaccattttggcccaactgaggtcaactctgaaaagccactgtagctccagaggtctctgtgggtcttcaggtgttactgttgggcccctgttacagctcaacttctctctctgccccattctccttccttttcctttctccctccttcaggcattaatctcaaggacactcttgaacaagcacttatgcaaaattctttctcagagactttcccagagaactcaatctgtaacagttaatagcaggaatgtactaagaaagcaggtgaaacaatagagttttggagctggcacactcacttattcagctggcaatgaggacctcatcactggtggtaggtggagttggtagatggaggtaatagatggcagatggagatagcttctagtataagactaagaagtgaagtctaatggcttcacttctctagtgggaaactgagatagtataatgaagagatgtgctgaaatgtggatgacatgatacatcaggcatttcaaagaaaagtataacaaagacttgagattgattaacaagcaagtggaaaccttggtagcatacaaagactttcccatctgcagcatgagaaaagacagagctgaggataagacctcagacttaattcagagtagccaagctttaaagaatgctaaatgcccaatcaaggcaggtctgttataccaaagtcagggtgctcaatgggacgcatggagtggggcaagcgggtcaatgttcctccaaatattttttttaaatttgttgtttaacatagataaaattcaccattacaatgtcaaattcttcaatttagtggtttttattatatacaaaatgtgcaaccatatcattatctaattccagaatatttccatcataccccaaagaaaccatgtacctccccattccctccttctcccacgttctggaaattgcctatttactttctgtctctacagatttttctattatggatatcctatagaaatgaagtcatacaaaatgtggcattttgtgtctggcttctatcacttagcataatgttttataggttcatgcatgttgttgcatgtgtgaggtcactaaaacttgtacctatgttttcttctaagaatttatagtttcagctctaatatttgggtctttgacccactttgcattgatttttgtatacggtgtaaagcagggatccacatttattcttttgcatgtagatattcagcatcattcgttgaaaggattattatttccatcttcaaatggtcttggaacccttgacaaaaatcaattgaccataggcatataaacttatttctggactttcggtgctagtccattgttctacacatttatccatatgccagtatcacattgtttcaaatactgtaaatttgtagtaagttttgaaactggaaagtgtgagtcctccaattttcttcctttttaaacattgtcttggctatttggtgtcacttgttcattttagaatcaatttgtccatttctgaaaaaaaaaaagccactggaattttggcaggaattgcatggaatctgttgatcggtttggcatatattgccatcttgatattattaagttttccaatccatgaaattacacatctttccatttatttaggtctttattatttttcaataatgttttgtagtcttcagtgtacaacacttgcacttccttggtcaaatttattcccaaatattctttttgttgctattataaactgaatggttttattaactttatctttggattgttcatcgctactgtatagaaatacaactgatatttgcatgctgatcttgtatcctgcaacttttctgaactcatttattaactcttactgagttgtaacttacatttgcctataaatgttgtttgacagatgctctcaggtggtgattttagcactgggtgagttcaaggtatgtgatatgaaggcaaaccttttaagttggtgttccagggatccaccaaacaggtcaaaacagttacaattcttggcaaatgaagtttattctgctctctattgcactagggatgtaggattggatgatcaagactatcactgagctggggcatggcagatggaattgggtaaatgaaaaagccatagagtttgattttcttactgagattcaactttttacaaaagcatctcttagttattggaagctgttagctcacttctcgagttctgaacaattgattttgaaagtttttgccagttttttttcattgcttttatggttgggtggacttttggattttcttgctccaggattttcacatacttcaagctattgttaaatcttgaatgcacaaattcctctaaatccgaagagtctatagaggtgggttacttttccctcacatgtaaacaatgcagaggcctctaccctataagacaacatgtgaccccttgggatccccccacctgcccatctatcactagtcttatagctaaggataagtttgaacccaaccttagccacggttgcactgaccctgataggagaggaaagggactatatcccaaataagctgcaacacttagcattgataggtaggagctggaagaagactcaaatcataggactggattcagaggagactgttttgtttttttttaactttttaaattgacacattgtaattgtacatatttatggggtaaaatttgatgttttgatacatatctatgttgtataaagatccaatcatggtagtttgtatatatatcacctcatgcatttatcatttgcttgtggtaagaaccttcaaaagcctctcttttagctattttgtaatatacaatattttaccattaaccatagtcactctgctgtgcaatagaacatcagaatttattcctcctaattgtaaccttgtgcctgttgaccaaccctttcccatatgctccctagtctctggtaaccactgttctactctctgcttctataatatcaactttttttttcttcctgagcatgctgttttgaaaaagagaccaaaacatgaggttggaaactggagagtttattgatttgagatccctttcccagttacaagctttaacatgctggcaagggcctcagaatacagtgtgaactcactactgggatggctcctaggagcctagaaacagtaatggtccatgccaagtgaggttgaaattccagaattaccatggttgccagtgggaaaaaggattaaaaggctcagagaagtgagcctgcgggagggcatagactttgtaagactgggaaacccaccaaatgcctgtgtttcatgggaaacttcaagagaacactatttccaggccacaaggaatgcattggtacatgcagttgccacagtaaacggcaaggttgtagggacagtcggggacctgattacctgagagttagacccctaatagattatggcatgtttaggggcaaaataaatgagctgccaacaaggttactactcaatctgtacaaaaaacaaaacaaaacaaagaacaaaacaaggatagatgatcaggaggttgacagcaattgccctcgtacagtgttatgattccttgagcagttactgaatcaatgccatttttattttattttatttttaccagaaatgacattcatcttttgaaaagtatctgggctccaggaggaagaatcctgcaacatcacagcaagttcacacaataataattaccccagtctttctgcaaagggatttatggccagttacttgggtaattgtacactacggaaaggagaataccaaacatgtcaaggattgttggacactgggtcgaagttgacatagacatccagaaactcaatacattatcatgtaccccatgtcagagattgggcatattgggggtgagtaataaattgagatctgccaaggttaggatctcagtgggtgcaatggccattttccttctctatacatggatgcatcatatttggtagttggcataacctcatatcaggtccttggcctattgggtaggagcccaaaggaaagctcctgaaatggttccctcccacccttgcctcagcagagatagtatataaaaatcaatattgtatcccctgaggaggatgatggaaattaatcccctccttaaagatctaaaaagtgcagtacagtggttctcatcatatctttatttaactcaccaggctgggctctgcaaaacccaggtgaaccctggaggatgacagtagactaccaccaactcaagcaagtagtagcaagccttgccctcaccctgcagaatatgatatatttagaagaggtcaacacagccttaggggcatggcatgtggctattgatttggcaaatacgttttttcacatcctttgcagaaaagaggatgagaaaccatttgcactcacatgaaatggttaatagtgtaaattttaactgaaatggttaacagtgtaaatttgcagtgtgtcccagacctgttagttctttgtcctacccaccctctgttacaatatagtccaaagagatctggactgtttgaatgtcctggcctttgattcattttatcagtggtatcgtgagaatggggctggatgacaagaaatccaagaattggaagccttggtaagtcacacgcattccagagagtatgagataacctccatgaacattcaggggcccgccatcttagtaaaatgtttagggattcagtggccaaggatatgttgaaatatcccatccaaagaatagggcaaagtattgcatcttacgtctcccatggtgaaaaaagggatcacaatgttagttcctatagtggaaggcatgagagacttccagcttggagtggggcccagagtaggaaagtataggatgtaagcagccctgccacttgggccatacagcctgacagatcctatgatacaggaggtgttagtggtgggaaaatgtgccaggtacagtttaaaacacatgccttgtgggagaatcataatgaggactcctatgtttctggggcttagtcatgccatctgcagtggagaactctatgccttctggaaaacaatttctattgtgctactgagccctgaagatggggcacctgactgtgagaaccaatgacaatgtggcaacaattgcccatatgaatgggctctgtcagaaccaccaagtcacaagatcaggtgggcccactgtatcatggaatgggtgcatttggtattgagtacgagctgagccagaaggtttaccagctcatgaacaggtaacccaggaccccatgtcacccactgtgttgcacagggtcaaacagacacatgggcagtggagaatcacttgactgatgggccactggtctaaaaagagaaagattggaaggctggggagttggaggcctgaggcagtggtgtgtatgtggacacaggagaaggatgagtattccatgtcatgtgttgtatgtttccaccttggaagaggaattgaacaactgaggaaacaaaatgactaagccaaatgatatgagctggccagtaactggtcaccaccaggccagcccagtggatacctggggaggccagctgaggcaggaatggaggcgtgggtgcaagactctgggcttgcaaggggcagggtggattgagctgctgctgccaccaaatacacaacctgccagcaacaaagatgaatgctgtgcccctacaggctccatccctctaggaggccttggtcactcggtggtgagttgaccacattggaccctgtcagtcatttaaagaccagctcttctcatggatagaaatggacacagtactttccttcctgcaggcccccagccactacattaatgagaagaataggattcttttttaaggagctagcatttgctagactggtcttcagagttacagctccctatcatcaagttgattgcaaacattcatctgcaaacagctctcttagctcatgagccatgcaaaaccagctggtggctgaatgcggcctgtagccatcattttatatgcatcattactgagtcttatgtaacagtacagatgtgccaccacatctgtgtgtcaggtggcaagaagaaaaagaaggacatggacatcaattatttttgaaggagacttccgaagtcccacacaatactgctaacatcttgcccagaacttggtcacgtggccacacattcctgcaaaggaggctgggaaatgcagttgtttactcccattgttagaactctctatgaatcttaattttcatcagtttacttcatttgttaggagctactgatagactcaagtaaaattgtaattctccaaagaacttaaaataaagacattgatgttaattaaatataaaacaaatacctaatagagacaatcagccaagctaaaacaactctcttaagaatacaataaaaattggcaagtctttggtaacattagtcaagaaaaataggagaaggcataaataaccaaaatagcccatgcgaagagggacagaattccagaggctgcgggaggattctggtctggctggagatgctggtaacttctctgtcttgccaatatgaacttcttagcattgctcaaagctgtcctctgtgctcacagcccacccctctgctggcggctttcacatgttctgttgccctggtccctccttggcccctcacctctgccctcttccatctcacctgtgctgtgctttcagactcttgcagcctccagaagaaatcctagaccactcagcatccaaagcccttcttgggctattgctggtctcttttccagctctattgtctagtcctaaattaaaacacagacgattctccaaatttctccttgtaactgcctccttccataatcttgctcaggactcttctacttttcttctcagagaacacaaatgtaatcaagtaaaatgttaccatttctccaaggttcctgatatggtttggatttatatccttgccaaatttcatgtcaaactatgatcccccatgttggaggtggggcctggtgggaggtgattagatcatgaggcggatttcccccttggtgctgttctcttgacagtgagttctcgtgagatctggttgtctaaaagtgtgtagcaccagccatgcacagtgctgactccccctttgccttctgccatgataggaagcttcctgaggcctccccagaagcagaagccactttgcttccagtacagcctgcggaactgtgagccaattaaatctctttataaattgcctaatctcaggtagttctttatagcagtgtgagaacagtctaatacagtccccaagttggaaaccagacttctccccaactcctataataatttttgtatctttttatcttgacatcatttcacatacatagaaaagctgcctgagtaataaaaagaagttctgtgtaccatttcccagattcacagactactcacatcttgccttacttttttcttcctctgcacacatgtgtgcttgtacgcacacacacacgcacacatacacattttatgaaacacatacacacattttatgacatgtgagagtaaattagaaacatgttgcctcctttttcttaagtgcttctgtgtgtatgtcttcagaccaaggacattttcttgcataaccacagtgcaataatcaaaattagaaattgtaacattggtacagtactattatctaacccaaagtctatattccagtttcatcaattgtcccaatatgtcccttatagctgttgtccccaaaccaggatcaatccaggagcactggctgcccttggttaccatgtccctttggtctccttcaatttggatcaattcctcaacattggtttgtctttcttacaggactgtgaatggatttgtctcacagaccttaacaattgctccctcatataatggttatttatgtacattattcatgtcccttgccaaccattcgactcatctgaggggtgatcagtgtgtggcacaactttcaagcttgcccagcatttcccaaagtgcctggcacattctagatttgttacgaacaaaaggacagctgtcccagtatttggagaggttgctttgtaggaatacttcctagctccaaagaatctgtctcaattaatggtgcacctggaaactgaagatgattcctacattttgataaagaaggtggtgggccaaggagaagagagagattttttaaatatttccataaaattgagagcgaagagcacaaagcaagaccactcaggccttagtccttgtcctgtgctgtggactccatgccctgccccaagcagtctcaggagcagacgtgtcaaccttccttcacagaggagtttagtctatgtttagtctctttttttgaactggatcttttctattaacatttaaacatgttcatgcctctttcaccttaaaataaaagccctcactatacttcagttgtccatctttcccagtgactctatcggtagttatgaacaagaatggcatcggtgtcaccaaactgaagggatgttttccagaccttagctcacttggccttcagcactattaaaccctctccatcacggacttcagaaaacactctcttattctggcttctcaagacaccgcgccctgggtctcctcagacaccgcgccctgggtctcctcagacaccgcgccctggatctcctcagacaccgcgccctgggtctcctcagacaccgcgccctgggtctcctcctgcctctgcggtcacatctatgtttcctgtgagtctccttctgctcaacccagccattaaatatgagcctcctctgtgtgtggagccttctctttgcacttgctactctctccctcctcatgtcagccttgtccatggctttaactgacacatatgtaaatgactgaaatttacacacccaggcctgccttctccctagagctccagaccaaatatctcactgcttctttgatgtctccattagtgcgtctcaaaggcaccctaaactcaacatggctggattggtttcctaggggtgcaataaccaagtaccacagacttgggggcttcaatagcagaaatgtgtcctttcacgattcaagaggccagtagatcaaggtgtgggcagaggttgacaactgttctacccagtgaggcacaggcaatgtgttagctgtgggttggctgtcatcaccgggtcagggatctgatgggttttggatgtcccattgcaggcagagccacagtgaagtctcttccctctctctcagcctgagggactgaagctcccccttccccagacctgaatggagaatgaacaagtgtcagcccccactgaagaccacacagaaaaagacatgagaccttggggaggggagtgaggaggagagagcagagaatgaggagattgaaagatctgaggggtgggggtaagaaggtacaagaggaagggcacccccaaaatccagaattaaggcaccccattgtgagctgcccgtgagtccagggcaagtacagagaacagcaaataaggtagagaatccagccctgtatttgcaaagtgctgtgatggacgggcctctaggccagcgcaaagaatgactaatgcttttttggatgtgtgtgccccggccggcccccccaccctgcttctcctccaggcagcacccttgcctttggccaatgtggactgcagggagccggtgtggacggtggggtcaaagcctgggggaaaccagcttggtctgagaatgcctttgtggctggccttgccacctctcctctccctgacatgaagctgatatatccttagggccatttgttcctttcttcagaacactgatcacagtggacactctcatttatttgtgtgataattgtcctatttctggctctttgaaggtcatgggtaactgggggctggtttttttctcattgtttcaattctcatgcatattaattagtctcttaaaaagtattcattgtctgataactaaataaataaattgatttactcttttctgtgaagacattggctactatggctattttgaaatataagggaataaatatatttagccaagaaaaagccatgaaacatactttccaattacagataatattcatcctaaatatgtaactgtaatttctcaaggaatgaaaaaaattattttaaaaaactcttgaccagacacggtggctcatgcctgtaatcccagcactttgggaggccaagacgggaggattgtgaggtcaggatatcgacaccatcctggctaataccccgtctctactaaaaatacaaaaaattagccaggcgtggtggcggatgcctgtagtcccagctactcaggaggctgaagcaggagaatggcatgaacccaggaggcggagcttgcagtgagcatagattgcgccactgcactccagcctgggtgacagagcaagactccatctcaaaaaaaaaaaaaaaaaaaaaaaaagaacaaaaactcttaaaaggatgtaagtttatatttattaaaatatatttttctcacgtggcatgttttattctgaaactcagggcatcatcttgttttagatgcacgtgttaacacctcagttctgtgttctgatccaatctgagtgaacgggaaaatttaacccattcactttaaatataataaagtgaaggagtgatgaaagaatgccaacaaggacaggctgtgttctgttcaaaagaaggtgaagttgtctgagattacagcagcctgattttgtcaatttccccattgctaaggccccagtccccttccagtttccaactgaggcccacagcacttttgactgagcccagttgatttttcagagtcaccagcctccttccctgagataatcccctccctccatcttttcctcccatttcctggcacccagaactttcacatttcatcctgtatcaaaatggtgtgctcagaaaaggatgcaactttcaaaggcctagagtgaccagcttagcaactgagaggcttagcagcttctcaggaacttacatttaagctttgagacgaattatggaatcaacacctttgtttccaagtaaaaaattttctagatcaagcaagcgatattttggagattaaactgtaactacagtttagcatactgatactttttaaacaaatagcaatatcatgagttttcacattattattattattgttattattattattttgagatgaagtctcgctctttcaccaggctggagtgcagtggcgcgatctcagctcaccacaacctccgcctcccaggttcaagcaattctcctgcctcagcctccctagtagctgagagcttttcacattattaaagattctttgaatacaggattccagacatagatattttattggacttcccctcaaacagagacttattaagaatccagtccaggcatggtggctcatgcctgtaattccagcactttgggaggccgagggtggtggatcacttgaggtcaagagtttgagaccagcctggccaacatggtgaaaccctgtctctactgaaaatacaaaaattagctgggcatggtggtgtgtgcctgtagtcccagctacacaggaggctgaggcaggaagaacttcttcaacccaggaggcagaggttgcagtgagccgagatggtgccactgcactccagcctggacaacagagcgagactccatgtgaaaaaaaaaaaaaaaaaaagaatccatttggttgatcccaagaatcccataaacaagacagtgtctgaattgtgaagctatattagcctccacaacactgttcagttgatttgcttattacaaaatgagaaaagagggcatactttctccccaggcccctaggcaagatttggtcacagcacatagcaaagggaatttctctttggtgactattcaacaggatgaattcctgctatctatgatcagctacgtattgacatcagggagggttcggggcacagaatgctctcagtgcttcattttggctacatatctccctctatcaagtttctagtgtcagaacaaaatttgtagacattgcttggatgatccagataattaactggcaacgctgaaattcccaaaaaataaaggcttttgtgctactgtcttctacaacaatacaatgatcaaaatgcatagcaggagcaactggtaaatgaaaaggaaaacaaaactttaggtcaggtattccagtgtgtccttgggacacctcagtgagcatgtggcctctatgtgcacattaactgcttcttacatcacaaggaatttactgacatccttcactgaaggtcaagatcatgcggcttctggtagcctcgccacatggtgccaggagtctccagtcatggagttcataatggagcccctcccgcaggggctggcaatgccacagaaagttttctcaggctattttgggaatcgtattcccagcgagaaatgaggaaggcagactcacgtgaaactggaaaggatgtggggagaaaataacttactaaacgtcgtggggctggaaaggaagaaggagtacacaagttcaggcttattattattatttttttaatgggagaaaggctgtaggagtcattctgtgtactcacctgggtcctgagggaggagctgtgctcacaggtgtggtgtggatgcatggcactcatgttcccaccctcctcccaatccggctagatgtcctggcagaccccagactgggtttatgtttgtggagtttatgggactttagttattggctaaaagaggaaaatttcaggaaatgaagtgttttagtgcctccaaaagaagccaggagcagtggccaatgctggagctgggatggcgtccgtcctgccagacctgaggtttggagtgcctgggggaaaggggacaaactggaaactgaaggaactctgtgcaagactctgagacgtggagcagaagcttcatggccaggtggcaagacaatgcagagccacctggaagccagctcatccaccctccacccggaggtccaggaccagggctctggtgccctgacagctccaggcagcacagagccagacaggagaagggtggaggcagccacctgcttagggacatactagctgcagggccgatggggacactcaggaccccaaagcaggaccacaggtcaggctcacttcggagggtgcagggaggccccgccatggtggggaggcctgtggggtggtgggaggcaggctgggagctgattcagcgggtaagagcggaaagccctcagccctcataacataggcagacctgccaaaataatatcatttcctcctaaaggctggagagccctagaacattcagtctagattctcatatcaaaagcagttgtgtgggcttatcttaagagaccctgatgagatggaatacaaccattctcccttgagggaaaaaacaaaacaaaacacaaataggcactctgtgtgtcagggtgaagtttaggggcttcttttaaatagtcctccccttctggccccccaaaatccccaggaactgaatctgcatcatagaaagtagttccatgaggccagtgcctcctgcgggcaacctgcccccaagcctcaccctcaaaaaaatgttaaacacaaaacatcaagaacaacacttaaattgaggcctggtttgggcaaaagactctagctgtttgccatgggaaggcttccttcctttccgtatttttagaggacaaagaaggaaaaaggattctacctttatttttatatcaaaacatattttttccaggggcaatgtagtaggctgaacagtatatcagcgcaaaagatacatctacaccctcacccttggaagctctgaatgtgattttatttggaaaatgggtctttgaagatgtaattaagttaaggatctcaacatgagcttatcctgaattatgcaggtggatcctaaattcaatgccaagtgcctgagctgcacagaggagagaaacacagggagaagaggagaaggccatggggagatggaggcagagaagggagccatgcagccacaagcccaggaatgcctgcagccacaagaagacagaagaggctgggaacagaccctcccctagagcctcaggagagagaacagtcctgttgacaccttgatcttgggcttccgtcctccagaactatgagataatagaggtctgttgttttgagccaggaactgggtcttctttacattttagcctacactcttcatccttccctgtcattcagtcctgttcaggagacggcaaaaagctttctgatgtttttatttgtgactctccctcaaagctaattaacacaagagtgaacactgaaataactgaagtttgaactgagtagccgaagaaatgaaatacattgtgagaagcctcagtttcaaatgccagcagccccaccagaggacttggctgatgacaggcatgcctgaagttcggtgagatttattataccattcaggaatggcccatttcaccatccccatgggaactcttaacacttttgaagtcgggggaggcataaaaaacgttagaagctcagagatgggggaaagctggtattcttgtcacacatggttgagtcaggagacaccgcccaaggttcctaggacaagaaatcaagatttaataactttatttaaacacataactcaaaattatctgtagcagtaaaacacttagaggactatagggaaaaattgattatgtttttcagaaaggagtcactagatactatcaagggttactaaacaagaaacagaagcctaggcttattattccacattacagcagtaactttcaagaggactgaaaactgaaattattaaaaaatggtcaaccctgggaagtggcactgaggaaggggaagggtttgtgaaagtcgtcaaaatcaaaatggagtcacttgtgttaaacaaaacaaaacaccctgacagacagaactgggaaggcaatgaagagagggttcttacactttgtatgcctgataacaaaactctcacaaaagattctgcagaaaccacaaccttgcacaaaggccattgcaacttacacagaaaatacttctgcggggacatctgtttagcagctgcctgtccaaccttggacagacgtcagccttgtgattgatccttgtagccaaggataatcatttgaaagcaagtgtgtcatcctcttaatctttcctttaaaaacctgtcttcctttacctccctgaatatgcatatagtttaccacggtgcacgtattcccactgcaatgccctagtcctgaggaagcctctttttcctttagagagcctctgttatttaaggtgacaagttgcatgataggctgttgttttccatatttccttttatatcatttagttttcatatgcatgtattattttaacgaaatgtttcaaaataaagtaatccaacagtaaaatatgtttccaaagtagagatggagggagagtgaagaaggagtagaggaggctggagagccatagaatggggcccctctttcctagtcccgggtatcaggtaccagctcccagagaggacaacttgtaatggactgcagagttcccaaaaggtctctggtgtcacagggcccctgcttgtgcctatgcctgagggcccacatttcataagccacctttggcacactggggagcgtccatgccaagcttggcttggctcacaaatccgtgaagactgggaatatggggggatttaaagattgacgtaaatcatccaggatgctttttgtccaagagtagaagtgctgatgatgtctaactggtcttgatttcgtttgaaaaggtatccctaccattagtatctgtagcaagtggcatggcacgttgccagcattcatggacttgcaaggcagccagaaaatgccggggtaaatttggagttggaagaggtttaattttttttattagaaaggggtagagaagagagaagtcatttccatctagttccacacagtttcctctccctctctcgctctctctcactctctctgcctctctccatttaaaatttatttcaaagatgggttttggaaggcaattttgattatgtaggggatatgtagctatgtctgtcaaagacaaaaaaaaaatgaaccctttcactaggtactggagaaggctgtgctcggaaatgcaaggcactatctaccactcaacaattttgggggtaaaaatctcactttttgtattcttcaccaagtttgttcaagaattcaggcatttgctgtttaccatctaaagcccataggagcaatgaggacagcttctctacaagattcgggagacaagggagagtggatgacagcagctgtgatctcctccgcattcctcagggcaagttcttcttgggaaaatgtaaattaatttgcaaatgtagagccaggaacctgggaaattaatcactaatgctgatacagacctggaacacataaatatagaaaggactcagagctctaatttgggagtaaaaaacctgggtttaaattccaactctgcttcttagtggtggcttatttgtttgtctgaacttcagtctctgaaaaagaagaaagcagaatgaccaggtgcagaaatcactggctttagaatctgatggacttgtatttgaattctggatttgtgtggatttaccctctctgaatcctggtttaccctatgaaattgggcataaagattaaaggagacgaagtgtgcaaaaatattggggacagtgtagtgaatattccaccagaagaggtaagagctgaggaggtaaaaataaaataaaagtctgcctatgaaagtgaggtaggagaaagagggaggagaggtgggaaggactgaaagtgagaaagaatcccgattttgaggacatgactgggaagaagactctcagttgttccttgtcttagcaaaattaaaggtccattggcttaatgatataagtagatcagatatgatgagtcaccatatattttggggtccatttgctactgcagctatgcctacgctgctattgatgacaactggagctgaggggtagtggagattgcccaaggggagtttgtaggagagcaatttggacagaaccccatggaatgcccgagtgagaggagtggacagagggaaaaagaacccactaagatgtctgaggagtgggctttggggccgttcagaagccaagggaagaaagtggcccacagagtggttgcacattctttaaggaggaaggttcaatggcatgaaacactgccagggatacaagtaatgaccttgccagaaggaggtcttgaacaatcgtgtcaagatagtggcatggtgaggacagggtaagtggacacggtggggtaatgagggcaaggggagaagtggtagttgcaggaagatgtgctttcttccttcttcttttctttcttttcagttctttccttcattcctccttctttttcttctttgagcagaggccatgtttaaattctaatgaaaaaagggaaattaaagatacaggcaaataatttccaaaactctcatctactgtccaggtggctgtctccttccaggtgtcttgtgtccaggtggctatctcatgtccaggtggctgcctcatgtccaggtggttgtctcataccaggtggttttctcatacccggtggctgtctcataccaggtggttgtctcatgttcaggtggctgtctcatgtccaggtggctgtctcataccaggtggctgtctcgtgtccaggtggctgtctcatgtccaggtggctctctcatataacaaatttgttgccaacccaatggctccctctgggtgtcccttggacacttgaatttcaacatgtctaaaactggctttcctgttttttctcccagtctcttgcttctcttatcctcctgcctggctccaccatccatcctcccaatggccaagtcagatgcctatggaccaccaaaaaatccaacttctccctccccacacagtgctggcttgctgcctcttaacacccactgtcaccccttagtaggtgtcctcactgtctctccagggactactgacagagttttctgaatggctaccttgtctatatcctcatttccttaagatctttccgcaattaaataacgtagtctttcaaggaattcttctcctttgggattccagctgtaggagaaggtttgtagcattccaaatgtgatgtggctttcttgtctttacctgtttgcattcatcatcctcagcctggagtggcttcttatcctcatggctcagacccaactccagggcttagtcttttctgattcccagacagaactgaggaccacctttcctttgtctggggacaaaactagtattctgatctgacttcatatatctctctgttccttctatcctacagagcacattctttcagggcaaggataatatcttattaacctccgtacgcctagtagctggttcaatagtaggagctccatgaatgaacaaatgaatgcataaatgaataaattaaatgaagaagatagggataaatgcagttttgtggtactgattcttcatcccactttttaggttcagatcctttactaggcagaaagcccccagatcatattgttactctctgggctcattcctcttattgcccataggacatctgccataaaagggcctgcatgttggctgcatttcccgtggtttgcccctaggaaccactagtctttcaagatgttctgtgagaaaaggataccaaggtcacaataacttttggaaacagtgtgtacccttcccttcttgggaagaagttttacagtaaaaagcttagtttagtcgcccaaggcctcccaaacatgtttgaaatggaacccttttttcttcaagtcacatcttgaagttttaacatctcctaaagttcgcaaacgccgtgctgtcatcgtctttcagtttactaacatggtgggctggctctagttaagatagcccactggattcctgtgcagtgactcgggcagtcttctgaaaacaaaatggctatgagttttcaacagatttctgcttttcaaatgcacaatatattttgagtttatgacatgttttataaattgattatttttttctcaattaggaacatctatgcttatctaagagattccctttattttatgaggtttatattctttttggtagaaaacattttgttccaccttaactgtttgaggattaataaagtaagatgtataaatgttattattttgatttcttaattgaaatgtaatttaaagttgggtcttgctgccttttggggcttcgtgccgggcacctgaaggaaagacaaattaaattattctccaacgtgctctggatggtgagcctcaaacctgaatattttgtgttttgaaatttgagttttcagagtcagaaatttagagtatatccatacagatatcctagaataaaacatatacttcttatttaaaagtaaagtttaaagatactttatcattgaaatcatccatccatctagttgatttctacaggtgagctagcataattaaatcattttcctttcatttccattaatattggcttttctgaaaggataacaggaatctcaaattctgttatagagctgatatttaaaagttcaatttcgccatttttccaaacccaattttctaagtattttgattaattaatgctatgtatacatcatactttcagccatctgaaaagtcattcctagggcatttcatgagtgaagattatgccagtgcttcagacatcacatctgtaaaaagatttttgatattctctaacggagatttcacagtcataaaatatccaagtggaaagatttttcaaatcagtttgtctaccgctatatctgaggtataaaaatgcacccccattgaacaaaagtctgccaacaacacaaactgaggatcttttaggttgcatctatatgatacctgcaagggcaatgaggccataaatcaactctcactctggcaagtttcctttgtaaagttgttgtgttggcatcaccagctcatgacaggctgctcagaagcacatccgaaaacgtcagtggagcaataattagcaaccgcgtcaggcatttgggcccattttgataatgtgagatcatggctttcctgctcttggatgaacaaaaaataatggtgtttggaaaccacagaagacctaatttattttgttcacttgggtatgggggaaggtgtgattagatcaaatcattttttaaaaaagaggtgcagaaaatatggatattctaaactcataatcaaatgagtcgttgggttttcctcaaaatgattcagagagctaaggaattatttgtagaatatctagtgatatgtcctgcactacactgggcatttttcacacaagagaaatatagaatacagtgcctgtgttcaataagattaaggacacaataataacttatttaacacaatttttaaaaagtactggttaggtgcagtggttcatgtctgtaatcccagcactttgggaggccaaggtgggtagatcacttgagcccaggagtttgagatcggcctgggcaacatggcaaaaccccgtatcttccaaaaaatatgacaattagctgggtgtgagaacacacacctatagtcataactacttgggaggattgcttgagcctgggaggtggaggttgcagtgagccaagatcatggcactgcactccagcctgggcaacagagagaggccctatctcaaaaaagaaaaaagaaaaaggctgggggaacttcctgctaagggtatgctattgaatgttaagtggtttgacgtgagcataaatatttaggagttaagagaaacaagcagaatttaggaaagaggcatgagggaggtgagattaagtgcaatttggaaatggcaagaattttgaaaaacagttaacattgatcaaacccttctttttttctgactctatgatgagcagtggacttacagggtttcttttgtttctccctacagttctacagggttgatactgttatttatccccatgttaccaaagaggaaatgaaatgcaaagagggtgagcaatgtgtctgacacatagcaaatgaatgacagaggtggaatttcagagcagcttctagcagttggccgcttggccaccttgctgcaatagctagctatgttgatctacagggagtgggtatagatatgatatgggtataaatggagatgtagatattagatgtggtgtgaacgggagacagtgataagagagatcatctcagattgaagagaaggattaagcacatgtatgaagtgggaattggcatgggcttgggggtggtgatgaaaagactgactgataaagagggcttatcttgcgaggggtcacatgattgggggatgggttatggaggccccagtgggttagtgttagcatgtgacaggaagtgttggctagtctagaatgaagattcaagtgtgtagttgttgatcaaataggtgaccaccatactttttctgtgggcttagggcacacagaatatttagggacacgagcctagatgccagggatatcccctgatttgattggagtccaggaaacctttgggagagaactcgaactctgactgtacttggggttcagacatgccaatctgagggataaactggagctgggagcagtgggaacctgtggggggctggaagggaagttcgtccagttccctttcactcctatccagagaacagaggcccctagtgagtgtgcactaagagatgtgaacctgctgttcctggcattctcaagcctcccacgtgtacacatcaccaattgaattgtttactttccagcaagatgattcctgtgctcaagccaatggcttcatcaaacccctgaccagagaacccatgatctgttctcattctggataccgaaaaggcattcaactatgattcttaaccatgtactattttcttcttgtgctctgacttaataacttgcctatgagtaaaatgcacatccacagtacacatgagacacccacacccatccttgtcctagagattcctagaaaggtacaagaagtgcagaaaactgtcaaaatgatgtttggggaattataaaaatcagtccctgggaactcccagagacgtttgagtgtgagaccaccgcgaggacagggcttcctgcaggactgaagaatgaccactactgaggttcacacggagatgttgaaggggttgcatttgtaagcacagacagtgatgccccggagagcaaggtattaaatacaaactgttcggaggtacatttaggtgtgttgtgggatgtgcacacacaagccctatgcaccatgctgtattgttgtattcattaagcaaagatagcaagtcttttgcagtaagatcactaattaacaccagtaactaaaacagtaaaagagtagaagaaacacaaacattatttttttcagtaatggccttcttataagacttcggcttggggaaatatgcttggtcaccatatttgtaaaacttgtttctttgcccattcatctttagatgaatgcttatttcaaagcagaagaaacccatagctgtggcttccatttcacttgtcctctgtgttatacctaaggtcacagtcacagcaggttgtagaccaccctcaagctacagatgggttggacttcaagaatacagttgtgaattgattctctataacacagaagcatttccctatagaaacaatgctaggaaagaagcctcgactctcaggccagcctgtaaaactctatttagccccctgagctctgaagtgtcccaagagcccccgtgcacctgtaaggctgaagatagagcagacctgggaggcggggctggatctggaattcaggggctgccatgtctgttaaaggaggagcaccagggtatgatcaattttgcaaagtttttcaggactggttgtcctgctgtgtatcatcactgaaaaaacaaaacaaaacaaaatgactttttgttctgaagtagttcaagactcacaagaagttgctaaaatagtacagaggggttctatctacccttcagtcagcttcctcaatgaccatgtctttcagaagcagagtgccttgtcagaatcaagaagccgacgttgatacaatgctattatctcaggtagagagtttatttggatttgatttatttccttttttctccctaatcaaatacagtgctctggaattatttttcaagtgttataaatgctaaaaatctttatttttgcaacaaaagcttccattcttcactgtagaaaaactttactgacaatgttatttgaatgaagactgggtaggttttacattcatacaaattaatttcaatataaataaagcaattttttaaatgtgtagaatatactgtaaccaaaaggagatttatgaaatgaaggatttaaaaaatgaatttgaggcagtgtgtttatcacagtgcatgggcctgggccctatttccactgttgctataaactgagtaaagttgctttagttgagtcatttaatctctttggtccttaattactttattgtaaagcaaggaaattagattacatggcttctaaaacttctttcaattaaataaaaatcctaagataccttcatgtctaagatattatgtagagatcattgtagaacgcataaaatggttttatttttttaaaaaaatactagaacttaattgaaaagaaaaaatgccttgtcagaacataaaagtcatggggaaagttggaaagaaaatgtaaaggtgtcgcgagtgtccagggtaccaggagacctgtgggtgacccagagcagcaggaagggctggctgtggggctccacgagggagccacttcagcccacatgacatttgtacgactgatgccaacatttccaagcctcagtgtccacacttgtgaaaggctggcagcccccatcagtgtggttctgaggattacaggaccacaatatgtccagcacacagcagggcccctggcacagagcccattccgtggaggacaaggagggcctaacccgtgggaatgaagtatagcctgggaagagtgcgagttgaacgatgcagagggaaccggggagccagcctgcctttgacagtggctgctagcttaagtggggagcccctggtttctgaggaaacccctgaggggaacatgttgccatgcttgggtgtggctggaacctgggcactgaccgggctgaactgaggaatgtgagtgggctttctcacaagaggttggagaggcactctcggtctcaacgggctctgaattgcagaaagccagaaatgcacaaaccagagctctctcattcatgtttaggaaaggcaaacaggtcccacgtaccctttatctcacagtaaatctgagatcagaatttggactgtggattctagggagaacctaagatatcttaatataaaaacaaaacaacactttggtgacttgctgctcatactagtttcttatccatgaactcttctcttctgccattctcctgggcttttctctgaatgtttacagtagcatctcagatggagtcttcccattgctgctactcaatataaattgtaaaattatctagacaattagttacataaaacaagaataaaagacagttaaaacagaaatatttgtatatactcctgtcatttacatcaaatttcctaatgatattcttgttccccttctgtttctttgggactcattataaaaagttttccttttaaatttttcagatggatttcaccttttcatgtttaagacatagctttaaaatcttacaaaaccaaatatttcaggctgggcacagcggttcctacctgtaataccggcattttgggagtctgaggtgggaggatcgcttgagcccaggagttcaagatcagtctggacaacctaacaaaactccatctctacaaaagatacaaaatgtagctgagtgtggtggtatttgccagtggtcccagctacttgggaggttgaggtggaaggatggcttgagccgaggagtttgggactgcagtgagctgtgattgagccactgcactccagcttgggtgacagagtgagaccctatctcaaaaaaaaaaaagaaaaaagaaaagaaaaatttttgaatatttcatcttccagtgttctacaaactgcctcagaaaacctgccttagtttgtacaggttttgtacaaatatgtacaaactgcgcgaaaaataacctggatggccataatttatacattttggtttcatgataaaggaaaataacttgaatccgctgcattttacaaccaggaaatggtctaatgatcttaattttattgtattttgaggaagaaatcatttattggtttataccacaatgagaaattatgatttgactcagaaaaaatcacttataattaaaaaatacaaacaaaaactaattgcaaaagtaatctacaagtagaatggcgactgtaatttaaaattttttttaagtatcccattaatacttttcacaaaagtttacatcaaaccttcacagtgttataagtgaacctgcctactttaacagtgttaggaatttcagtcttagcatttattgtgccaaatccaatgacttctgaacccagcactatgggcttagcattggacaggctctgagcctggaaggtgaagattggtcacatcagggtaaaaacagtttaattcgactcttatacaaccacatgtgcaacattatttggatagtgatcctctgcacgtagagatgaagcttcatattccattttaagatttctacaacacaagcaaacatagaaggccaaaaaatccaggtttccaaattgttagaaaccacatctgtatatggttagaatggaatattctaagagaatttcagtagctctgtgggaaaaaaatgtgattcattagatgaggcactttatgatgtgacttaagggacaggatgcctgccctaagagttgtggaggccgatgaggagtattgtggcaatgtggtgcttctccagctgcattgatcagtggaaggttgaccaccttttcacactcattctgccactctccttttctcttcctgtgttggacattcctaaccagctggggcctgttttccactcagcctcaaagtcagcctcaacactgtgctctagatagctcctgccaaatgagagtggtggggcatgagcaaaagcctagttcccatccctgcccaaaactgcttgatgaaaagatacgaactctagaattctcttgttgtaattcaactctggaatatttagtcctatttagcattttctttttggctacccctttctccaaaggtgactttaagtctaagatcctataggctttaaatatagaaaaagcatctatttcaaaaggtctgtaatagtttccccaaaaaatgaagactttcctctaacaaagtccaaatcataatccactggcaagtgacagataattatgattgctggtcaatttaactcaactttagggtctatttataggccatagaataatgggagtgctctgtagattttattacattcacatgctaaggtaaaaaacagcaactccacgccagataaggaaagaatgagagactttcagacattcttatccacttgttaaaaaagtaaatatgaattttcattttttttttctgtaggctggagcacatgtaccagttcacctgccaaatttccctcccatgaatcttaggaaaaaagtcttgaaaccaacatttattatagcattcccaaactaatcttcttagttctttactcttcccaaactgcataagtgtcatgatgacttagttcagcaactcaatatgtggtgaatattctggtattggtatattcatttctaaatgcaataaaactaccaactataaaacttcagatgaataaattaaaatgattacctttttaagaaaagttaatgtcagcatgtttttacaaaagcctgcggttgtggggcaattgattcttattattgctatttaaccaacatttattgattactatgtgttgattagctctgtgcaccagaatgtctggtggcgactgaaatgttctctctctctctctgtgcaagccaatgtgttagttcctgcacttgtggctgctgagcacttggaatatgcctggaacataattattcattttatttaatcttaataaatctacgtttaagtgggcacaacattttggatggtgcagatatagaacagataacggatgtttcaaagatacaaaattgagagtgattcggtttttctctcaaaatgcctacaatgccatggaagaaaaaaagtgcatacgtgatttaaaactaagacttcaactgatttttgtggaatttgataaaatgtaaaggttgtgtggaagaaaaagagtccaagaatagtcaaggaaattttggagaggacaaggtgaggggagaggaaaggtgggatttgtcttattagatattaccagattcagtaggacagaatgaaggctcagaaacagatggaagcaggggcaggaacctaatttaggagacaggcaatagtgtaagtcaagaagaagttcagttaagtggcatctgggcaagtggttgtccattcgaaagaaataagtaaagttagatcccaccattctctgcacaaaaataactccagagatattaaacctcaatttgaaaaataagatttaataagaatatatagaagaaagtacttaagatctcacactagagcaggatttttagaacaagtctaaaaaagcagaagctatgaaggaggatgatcagttttactatacgacaatttaaaatttgtgtagcatccaagatgctaaaagttaaaagacaatccccagactgagaagattgtatatatacagctggcagagaagcagaatacacaaatatgcaaataatttcccaaaaatccaataagaaaaaaaaccgccacaaataacaaagagagcataagcagatgataggaagaagcaactcacagaagagaaaacctgaatgatgaataaatatgtaaatgtgttagtcacatccctgactagatcagaacaatggggccacatttttcatccatagtatctgctagcgtggttgagtctaacaagaccaagtgttggtatggacgtgaagcaactcatgtgttgctggtgggatgtcagttgaggacagccattgacagcaatgtctagtaaagttcaaacatgcacacttatggttcatctagtctacttctaggcatttatctttgaccaattcttgcataaatacataaagaaatatgcacaatatgttcactgcagcacaatttgtaattgtgaaaaattttaaatgagctaaatgttccccagtaggggaatggaaaagtcataggatgacctttcaatagaaagacacaagaagttagagtaaacgagcccgatctctatatatcaaggctaacaggtctcaaaaatatattgtagagtaaaaaaaaggagggacagaaagctacatagagtatggtaccatttatgtaaaattttcaaagcactctaaatactatctactgtttcgttgcaatacctgtgtgttaaaggcttcaaacagataagaatcatagcttcctgcgaattacatctgggcaagagaggcctggggccttgcgggtgcccactcaggccctactcctgacctcctcaaggggcaagaggttgcgctcacctcaagccaatcaccctcactccccaacccacttccaaccacactctgagagctgggaccctgggattccctgcccggtagctctgagccccatgtcccaaagaaaagacctaatggctgccccaaggaggaagggaggagacagaggataggatctgaagcaacaggaaggagactccagtcgtgtctgtgatatgtcaggactttataacaatatatccaaagcaaacataagatgatgtttgctaattctgggggtgggtggtggttttatcgctctttttattattagctgactcttacctagcacttatgtttcaaggcctgttctaagtgatttgcattaaaaatgagagggttctattattactcagtttcacagaagaggctaaataacttgcccaatatcactcagctataaggaggagagggggatttgaatccagtgggtctggctcccaggtccaccatgtagctagcaactatactggatctatctgtccataggctgagatgacttcctttaaaaaaaaaaagtaattaaaattaaaataccctgacaaccacaatacaaaaaaaatatagtgaacttccatgaaaattttcttagatatgttaggagcactgatggggactgcattgctgagggaggaaggccgtggtggtggttgcggaagactttaaagaggggctgttgacatttgaaccaggccttgctgggtgatgggcagggaggaatagggggatgaaattctaagaaaaggaaactttgtgtgtacaggcatagattttaaaaatttcaagaagaatgtgaagattggcaagtagttctgtttggctgtccacagggaacaatttgaggagaaatacaggttaggagctagaaagggagagtgagaaaggaggattttagaaaacaaggcaaactgctgaaggtggcacccccaagctgcactgtgggaagatgatcccaagtgcaggctggaccagaggacaggtgctgcagggacagaaccctgaggggagcccaaggcaatcacatagctgagatgaggggacatgtgagtgtgtatgagtgtgtgtgagtgtgtgtggtgggggagtcaagaagcatctgtttatttcacaaatatttactgagcacctacaatgcaccaagcactgttccagaaggtatcgatagaagaaaatacaaaactgtctgccctcatgaaacttgagttgtaatggagagacacagataagataaataaataaaatgaataagtataaatataaatatatgataaatgaataaaaacatatctatgacaatatatggtgatgataagtgctttggagacaaagcaggaaaggggggaatgtgctagtgtatgcagaggttggggtgggttgttgactggtcccagttccctgaaaattcactgacaagaggcagatggctagaagaaaaggtgtacttatttatttaaggtgtacatgggggccttcagaaggaaggcccaaagatacaggggaaattgcctagttttatgcttaggttcaacaaaacatggagagccctgtcgaaataggattggaccaaaagggtgtgatctgatgctgatactgagtgaggaaacccagcgaggccggtggctctagattcttcttggcctctctgagcagcctttttttccttctgggtaaggggcaggttcttctgtggaatgggaggtcttaggactgcaatcaacaaggtagaacagttgatttctttatggccagtttttacacagacaagtgagggaaaatcacagtgatatttttgttttatgactggctttggggaaaagcgttctggtttcgatggctagcctgggggagaatgggaccgagagacaggagggcagaagatgacacagagactgcttctgaggccttcattttggcgtattgttttctgagctccaacattggcaaaaggggttccaagccgagatgacctaagagtacaggcctgaggagtgagtggtgtccccgccatactgaggttctgagtctgggcccaggacatggttgcaccgaaaggcagggcaggaaaggggagctgggttggagggggacagactgagtctggggtccagcgggcagttgaaactgctggtgaggacatgaggccagtttgaatccaagcagcctggcttcaaactccttgttccggaggaggaaccgcaagtcctcccaaggccttggagaaaagtgagctaaaggcagaacgtgggccgataacgtgggggcgtggggggaccgcgacccagcccggggaaggcgtcccagcatggacccagcagcctgggcagcctgggcgggaagttctgatcgcgctctgccgaattggcaggcgcaataagtaagcggaaaaaccaggattcaaaccaaccaccaacacccttccctggcgttcagaccgaaggtgggtgggaaggccctggcgaaggaggtctgcatcaggcctggccttgaggcgatcccttctcaccccaaacctcctggacgctgagcaagccccttcgcctgtgtgggttgcccggctgccctctggggaaagttgggtgatcaaatcccaagttgtagctctcgatgggtcgagggcgatggccagcgctgtgctgggaacgggcagccctgccctgccctgccctgccctgccctgccctgccctgccctgccccacatgggcgcaggaggcctccgcacgcgcaagggccaagggctggagggggctctcccgggcacaggcaccggacccggggcgcgcgcgcgcgtccttagtccccgggctgcactccgggccgctgagagatcgggtcccagaagttccgggagtggtcgggtgaccctggaactttcttcttctggagcccgacctggggctgactgcagagcaggctgctggcagggaccaaaaggagctccgcgccaggccggaggctgcgcccgtcactcgcggtcccggccgggtccctggcgcgtagtcaggccgcaccgcccgagccccaccgcgcgcccaccccggccgggtgcgtccggctcgcggccgtccctcccgcgacctgtggcccggggctgctgcgggcgcccggggaagagaggcgggggccgcggggggcaggaggagcggctgcggccggcacagcgccagggcgagtgaggcgggtggcgcgggggaggcggcggagtaaagagaggccgccggctgggtccgcgggtcactccgaggcgcgggctgcgggcggcgggcggcgggcgcaccatgccctccttcgacgaggcgctgcagcgggtgggcgagttcgggcgcttccagaggcgcgtgtttttgctgctgtgcctgacgggcgtcaccttcgccttcctcttcgtcggcgtggtcttcctgggcacgcagcccgaccactactggtgccgcgggccaagtgccgcggcgctggccgagcgctgcggctggagcccggaggaggagtggaaccgcacggcgcccgcctcccgcggcccagagccccccgagcgccgcggccgctgccagcgctacctcctggaggcggccaacgacagcgcctccgccactagcgctctcagctgcgcggacccactcgccgccttccccaaccgctcggctccccttgtgccgtgccgcggcggctggcgctacgcccaggcccactccaccatcgtcagcgaggtaagggcgccccggccctttggaagccggcgggagaggacgatgctggctcccaggcggacaagccgcgtgtgagacgctggccgccaggggaggtcggtggagacggggaccggtcggctacctctggggacagacaggattcagcgcacccttggaagtgccgcgtcgtaaatgctgggaaaagcctttcgttatctgcctgagcccgtgagttaatgcacagatactttggtttcgggtgtgaacaaaaactttcttcgaagccgagttgtaaacgcctggcgcacgcctgctcaggagtcaaagacccagcaccgcgttccttatctttgaggtgtgcgggcgccgtcattggaaattatggttaggtgcgcgatagggaacttcagtctctggggtgagcgacgttggcagttccggattcgcttatggtctccagggtcaaaggaaagggcgaaccaacgtttgaaggcagcagcagcttttttccagttgcccaaatggttactcaaaatgcaaggggacaaaggtcgaggctttcccggggaatggttttggtaaaattgctttggggcaaagagcaacatctgggataagttgggaaaactgaagtattggataaattttagtttttttttctggtaataaattttaggaacatagcgggagggccacagccttccaacgcaaatccccaacccatttacaggcggaggctgctgccggcgggtgggcgggggcgatccccacattttgggcagtcagtgcatttggaagttaggggagcttccttcacccttgccctcagtaatctgtttctgcatccttgctgaaatggaagattgcctctctgtgaggtccagatatagagcagagtcactttgtaataatcggaactcagaaacggcctcaattgagcatgggttgcagagatgagcagttttactgagctttgtctacaatcacagcttaagttaattttaaaaaaagattgaatgtgatcaggtacattaggaaaaaaggtttgtcttttttttgtgataaactttaaaaaatcacctacttgaagagtggggaaaacactggatgaggaggtaggagcgccctttctgccgctgttgctgttggtctggtgagcttatctcgctgcagttgggagtgtcggtggttgcaattgtacatgttttatacgccatgtgctggtgtgttcgcacagtggatggctctatgctatgtgctccagggataaaacccatggcaggacagccaggcgatgtgtgtatgtgtttgggatctttctgtaacgccgtgtgctgctgtgttcgcacagtggatggctctatgctaagtgctccagggataaaaccccctggcaggacagccaggcaatgtgtatgtgtgttcagggtgtttctataatgccacatgcaagtgtgttcgcacactgagtggctctatgctgagtgatctcaggataaacccccctggcaagacagccaggcaatacatatgtgtgttgggatctttaatttctacttaatccatggtaaggctggggactgctttataattggtgatggtctggttagagatttcacagttgaaaggacagggcatggacttggatgagagagggcattatctctgtgagtcgcatctgttaggtggcttcttccactccactcagcagcgctgcctaatgcttacttcccaagtgaaccagaggacccacatggagggcagacagctgatttttggagacatttaaagatgaagaataaaacgagcctcaacaagtgctcaagcgaggtttgcatgagtgagtatgatccatggacatcaaagaagacagacataaaaatctgtaatttaatgctctgacggatactttggaagcattctggagttgcagggttactagcatcccggggttacaataaggtgattttatgaagatcagtggctactaaaatgcagtgtggaatgatggagggtcaggggctggctcggtctccagctggctgtgtggcttgggtgagttactcgccttctctgggcttgtatttttcctctgtaaaattagccattggattcagcccgttacaatgctccaaatgccatcagggtcaccacctggttactgtttggtgtgcccagaacaatgattaaaaagtctttaagaaagtagaatgatattaggaatgtaccccgtaaagccccaaaaaagtttttgaaatatattggagagattcttttttgttttgttttgttttgttttctttgagacggagtctctctctgtcgcccaggctggtgtgcagtggcgtgatctcggcttactgcaagctccgcctcccaggttcctgccattctcctgcctcagcctcccgaatagctgggactacaggcgactgccaccatgcccggctaattttttgtatttttagtagaggcggggtttcactgtgttagccaggatggtctcgatctcctgacctcgtgatccgcccgccttggcttcccaaagtgctgggattacaggtgtgagccaccgcgcccagcctctttttaaattccaaatagttttgtgcttcttttggtttgtttttcatgtttggtttcttaagaggaaaacccccatctattcataaagttcaactatccaaaacaagtcagcaactctctgaattctgcatagctaatattttgctgtctttggttcaactaatttttttctttcaaattctgtctgatgaaaggaactgtagttccatcttcagctaacattatgtatccagtgtatttttataaacttgaagcctaagatacaaatcatgcaaaggggtgaattgggagagtttacaaagtgggcgggatgaccagactccagaatgcctccatatagctataatacttcatccttgcaccatggtgggaggggtatcattgtcctggcttcatagaagagagacctgaggaccttccagggtcccacgccatttatgtagccaaactggattcaaatccgggggccttgattgtaagtcagtccactttcctccataaagtgctcaaaatccttcaagcaagtccatgaaacatagtactcagatctctcacactttataacctgcagaaacctcgttgaaactttgtatttattttcttactatcatggtcctccaatgggctactttgtttcattttacggtgtcaggatccacagtcagccagactggcagatggggaggctgtgctttcatttggtgggaatggttctctagcctcctgatgtgaaagttgcaaaatggtcatttaaatctcatacaccaccttcgcatcttacaacttgagatagttctaagacactaagtcagaaatcaatgccaagggcacatccctttatggccagctcctaatttgtgtctcctgctcaaggcaaggcagtggatttatcacccacattgaacttcctcagtggagacttttctaatgtccgaatctcggccttatcttgttgtcagatattgggcagaataaaatacaatgtaacgcagagaagcgagtctgaccccctgtcccaaatatttcaattcactgcccagggagtgtcttcaagattgatgctaggatttttcaatgcttgctaatatggtatggatgaaaaaaaaagagcttttccctaggctatcactcagagcagggcttcagaacacctttaaaaatagactgaatcacatttgtttttcctttccagatcattttgacttggaatcactttttcccttccagattacctggctgaatctataaaaactgaatccattgtttgtttttattagaagagtgtgtctttcccatactttctgaaacatcaacaattcaacaaaaattttatgttggcccttgtccctcagagtaactagtcctttctgttgatgacaaaagtgttttaatagtgtaataggtttttgttttgttttgttttttgacaaagtctcgctatgtcacccaggctggagagcagtggtgcaatctcagctcactgcaaccttgccccccgggttcaagcaattctcctccctcagcctcctgagtagctgggattacaggcacccgccaccgcgcctggctaatttttgtatttttagtagagacagggtttcagcatattggccaggctgacctcaggcgatctgcttgcctaggcctccgaaagtgctgggattacaggcatgagccactgcacccagcctaatagtttatttttaatggagtgaaagcaggactctaatgagtgaacagccaccccactaggtgtctgattcttggtctaggcagcagaatggccaaacagattcatgcagcaatgctttctggacctcagaacaaggaaaatatttacaataaggaccttcattatgagaatgtgcaagagtatctcctgctcctctctggcagctgatattttggattatcaacatcagttcagctgaagtttatttagcatttattttattctaggcactgggctaggctggggatacaaagatacacgagtctttctcaaaacagcgtgaagcttggcagggaaaattgcagcgataatgtgatgacagtggctgtgggtgtgataaagggtaccaccctctgatgggacagaggagtgaaccagggcagaaagtacattgaccttaacctcaacctctgagtacaaggaggagtccaagaggaaaatatgagggaaaagatgttctattctcacaccctctcatcttcattattttctctgcacccatttattttgtgccctcaggagcagtggttggtgtgcattctcgggtcgcacacacagggtttggaatcaaaagacgagggttggagttcaggaattttcctttttcacaaacatctagggcccttttcagatggtccatggaccacacagagagacaagctgggtgtttcttaatgaggagcatgatgagaatataatgactgggagagaattgccagttccaccaagcacaccctggagactctcagaggggaacattatccctttatcctcagacaggtatcccaaatcttatcagatgaaatgctgctgtttattttcagagagctttgagctctccagggatgggcaactgataataaaatcctggaattaactggggagcgggggaagcccacagctgaaccacactttctgggagtcttggtaaaccttagaaaggagctttgggcaaaggtaggggactccaacagatgttgcagagacatctgtacttttggacccacgggttatttttggcattgacatcttagtagagtggaaagaatacacatgtcctttggtgtcagataaatcttgtcctaaatcccagctcctctattaacttgaagggcaagtcaactgagcatctgcctgagcctcagtttcctcagcactagaatgggtacaagaatgcctgccttagcaattggcttgacatatgcttgcaaagtgcctggtcataggtggtgctcagaacagttggttcctgtgaacacataaagacccttaagccaggtgggagtcaggagggagggaaggaacaggctatgggccagatttgaccctggagctgtaagtttgctgatccctggtctagcataataaatcactgataaatttgccttaaatataaagagtcaaagccttggccagttgtggtggttcatgcctgtaatcccaggagtctgaggccagcctaggcagcattttgagactccaactatacaaaaatattttaaaatttttaaaaaattggccgagtgtggtgatgcatgcctgtagtcctatctactcagaaggttgaacccaggaggtcgaactgtgctgctgtattccagcctgggtgacagaggaagaccctgtctctaaaaaataaaataaaatatctcggacactaatttgctctaaaggctgagaataccgatactttcccactggaccccacaggtaggtcatatttcccagcttcccttgaagctagagaggccacgtgtctgagtcctggtcagtgatgttggggaagtgaatgtggaactgctaagcctggagccggagcaaccttcctcctgcagtccccggaggatggtggaactcttacacggaaggatatgcgttcctggaggcatgcgaggcaggcaggagccccacagctcccctccacaccaattcatctgcacaggaatatgggattgcgaataagaaataagctttattgtgttacacaactgaggcttgggagactgcttgttgcagctcttcctgttaggctgctctgactcatacagcatcttagtgtgcttcctggcagggcacaggtcacgaggctgtgggcacctgacaaaatggtatggaggctggtgcctctaagagcatcctcccctaggtctggtacacaaggtctctgtgcctccaccccatgtctccgcctatagaggcttttccctctcttagcccccggggctcccactctccaggcagtcaccctgggacatgtgccacagctgtcctccccttgggctcttgtgtgcgctgtttcctttcctttcctcaaaatacctgtctttcctcggccgggcacggtggctcacacctgtaatcccagcactttgggaggccaaggtgggcagatcacgaggtcaggagatcgagaccatcctggctaacacggtgaaaccccgtctctactaaaaaaaaaaaaaatacaaaaacgattagccaggcatggtggcggctgcctgtagtcccagctaccggggaggttgaggcaggagaatggcgtgaacccgggaggcggagcttgcagtaagctgagatcgcaccactgcactccagcctgggcgacagttagagactctgtctcaaaacaacaacaacaacaacaacaacaaaaaacttgtcttttctcatgaggctgttccgttttgtacctttacacacaccaattccagacacaccttccccactgctgcctctacccagggctgggcttggcttcctttatctgtctagctgccttccctctactcatcttgtgctcactgcctcatcagactctgaggtgctggagggccggcgctctgccctcctagcctaacgcagtgtttggcaaatatttgtgattaaattaatgaatgaaagagaaagggattccttggcacgtgtaatgctttttatgaccatggctaggccaaccctggaattggctttcagagattaacccaggccctctaccgatggtgttgcttcctgttgactcctaacgccgattccttgcctcatcctccgccttcatcatcttctgccttgcatccatgaggtgtgatcagtcacagggtgaacaatcatcggcggccatggccgcccgcagacctctggagcaggaggaaaacaggcctccactttacttgactcctatctgctcatggggtctgtgtccgcagaatcctaatgtagggggtgtgacctggaacatgaaagggacaggaaggaatagaactgctggctctttggggccataattttaatgtgctgacgtccattgtgcagaagagacttttcccagctgtcctggcaccacacagtagtctgtgtcatcaatcgagcctgctccagggcagctgggcacaggtgcaaggcccggtgcagggaggagcactgaagggcctgggctgagcagctcccagggtgcagcgctgtccccttcatggctatggagtggggagcaaacaccacctaccttccaaaacaaactaaaacctttccaacattctgcctcggttttttccccaccccctcttaaatcataaccaagaaaggacatgtatttatattctgtgaggaaaaagcaaagttttaatggtctttggtgtggctttttaaaatgataaatgactgttgagcttgtcaaatcatggctaatactgttttatctgggtgagatcagtaacagctttttaagggttaccatgctgttatttctcttcgtgttggtaataaagcaaaataactctgtggctggtacttgtgtgataatagagaaaattagtgaggggtgaagtttaggggcttagaagaaggtgaataaataaatgtaatttaaacaattctggggcaggcatccatcccaccttccttaacatctgctctagattctagtgccctgtagagtccaaggaggggagctgtccttgactgtgagcatagtggaaaccactggatggaggaagggtaggcacaagcctggacctgagaaacaaaggcacctattctgctttcaaattcagtcctgggagagcaggtgacctctgtcataggactgctatagggcaccagcagtggagataaccaagtgataagcaagtctttggctttccattaacagagaccactggtcccaacatggaaaagcgtcccagaagcctttcccagttgctgcgtccacctagcatacacacaggatggctctgatttcatgacacttctgccaacgggaagctttgggcaatcgacagcacaaaatgaaagacaacatgtgtgcttccaggctagtggggagggacgccgtaagctgatgcttctgagacagaaaccgaagggacaaggtgccaggagctcctatactaaaaactgtttgtagcacatttatggggattaagtggttgtggtgaaaacagcctgcacgtttaatattgatgacgttttaaaaagcaatgcactgcaaatatctgttgagaaatgaatgccctttaattgttcacaaatgagtatcttaaagaaaatacccatagagaagtcacctggatagttaaaaacattaactacccagggtagaggagaaaattagattgaaactaattcagattaatttggcatcaactttaaagaaatcaaataaataaatgtccaagttattagagtgtaagaaagtgttccaggaaccttttccacagaggttcttgatcttcctgtgtggcagttagtgggaaattatgtgacaaatttatcacatctcttgtcagctcctagcatccttgtaagattgctacaattccctatccagtctgtatctaatagagcatacataatgatttttattttaattccaaccaagttgaatacattataaaaccaaataaaattgtctatttatcaactccagagatcattagataataacaatttattgttgcagagttttgtgaaaaaattatcaaattttagatccaaactggtttagtgtagtgtattgctaaggcaaataggtggctaagaacgtagacttcctagttttgtggatgcaagcaaatggctgaatttgagggtttttgagctctggactagcccagtcctgagatttcctggttttagtggggagacttaggtaaataaggcattcaaagtgcttgtcctgttgtctgagatatgtaagtagctggtgatgatcatagatgctgacaacagatactgagaaagttgactcagagaggcagcttgggcctggaaattcaggcaaatggcaagcccctagggctgagggaagcgtgctttaggcagggcaccaagattccaatactaaggacgtggccagggtccactctctggagctggtataaactggagcttagtaatgaaaactagggaaaggcccagggtagaggtcggagctaccagatttggcaagatttctcaagcccccgtggattcagttgtgatatagagtgaacaatccccccatccgggtggctctggggacaaatgagaaacatgcaggaaccgctgagcatgtggaaggtcctgggcacatgccagttccctccttcttgctctttgtcactaactgtggtgcccaagtcctccccttgcctggtctagtctggggttgctggatgtggactcactcagaaccccacacttctttccaattgcagtctgagcagagggacgctgggacagagccctggactttcctaaaaccgggaaatcccaggacaggactagaccagagctcagtgagggctgaagactcagctgtggggctgcagggcttgaactccatcgcatgttttctcatgagcctggaaatccttcaataaatatgaacaacaaaagtgccccaaaggtgctgtgttagaaaggcacccatctggctcatgcctgtattctagttgagtcaataaggcaaatttaccttatgttgtttgtgggcagttgcaatggtcctataggcaatgaaaacatcagatcacagtttgcttgtgttgctgtgagaatctgacctcaaagaaaatactcccccaacccaaatccaaatctatgaaatgaagacacagcagttgtggtggggcactaattatgaatgttgagcttcaggttagggttgaagtaaatttgggctaaagtgctttatatattgagcattccaattctcataacattgaatagacactaaaacttaatttacgaaagtagtttaatagccaatggggacaaaaatttattcttacagttatcaatactcacttcctgcttagaaacttgttttcttccttaattaccagaaaacagagtacatttaataatcaatcatactaaatttaaaattagggaaagagagcttatggtgttcagcaaaaagggaaatatcaaaaaagacatcttagcatctggattttttggccaaaaggagagcctgcagtttaattaatggtctacatcaaacaggatattttatgaagcaatagaaagctgtaattaaatctagccttctggatttgatacatcacaaaaccaggagataaaaacaacagaaaattggtgatagggttgaaactcaaccttgttcaagaagcattcacaatggaagctgttgacctatattctatatactttacatttcaacagatagtctatgtttgaacagtgatttttttatatgtgaagattttctgtaaagaactgtattaacatttgtaaacagagtccaagaaaaattaattatgactccttttttggatttcacattggtacagcatgacctttaactcattatcttattacaactattagaagaatagtaaaaacatatttcatatacttttcaaatatttataatcatagtattctttttataatagttttcaattcttatttgatagcatgctatacaattatttttccttactaaactttcatagacatttcacttaaatgatttttctttttttaaaccatataacctgtcaaagtataaaagacacatacaagcggccgggcacagtggctcatgcctgtaatcacagcacttcgggaggccaaggtgggtggatcacctgaggtcaggagttcgagaccagcctggataacatggtgaaaccccgtctctactaaatatacaaaaattagccagccgtgatggcaggctcctgtaatcccagctacctgggaggctgaggcaggaaaatcacttgaacccaggaggtggaggttgcagtgagccaaaatcacgccattgcacttcagcctgggcaacaagagcaagactctgtcttaaaaaaaggatatatacaaggtacaaattatttgaattagtctatattgatctcccttttcattctctcagtttctctttattaaacctctttctcttaagaacataaacaaacaacaactactagaaaagctttaaagtccagcattagtcaaattgaagtactgtcctgacccggaaagcattatccaagaaagtgcatttcaaggccacctttcctaaaccagtctcaggaaggtccacgctctatttccctttgcaaaagcatttaagttaatgctgatatatgatttgtatttattaactcccccccgccccaaccaatgtagtcttttttaccttaacctattattgacttggtgacaagatatagagtgatcatggagctgggatccatgttcctatgtgtcatcagttagaagaatgaagaggccaagggagtcattctaatatttatatggaagaataaaggcccagaagcaggtaaatcattctaaaagaaggggtagggagtaagaggagggcttcctctaccagaaattaaagtgaaattccaagccaaagtaatcagaacagcatggtattggaacaagaacagacaagtggaccagtgaaaagatcagagcacttggagactgactccacccaggggaacatcatatacaataaggatggcctcataactccatggggagaggatggattgttggctaactgatgttgagaaaagtaatgactcatcagatatggagaatgatcaatctgcctatcaccatgtacaaaggtggactcagggtgaattgaagacttaaatgtcaaagtaaaaggtaatattaacaaaggaacatacagagaaacatgacaaggtcagggaaagactttttaaagaaaagtataagccaaaaatggattatctagattatatcagatttctgcctcatgacagataccatcagcagagttaattaagtgatgacaatgatactgagtagagccatgctactctaatcaagggtcgttatgggagttatacaatgcatattgtacaatgcatattgaagccaaaggcttcaataatgttcactgtgtgctcaacactgttgtagacacttgacatgtgttcaactcacttaatccctacccacttcatgaggcatgtgccatttttgtagattttttttagaggaggaaaggaaggtacagagagattagataatttgtccagaatctggagctgcaggataggagacttggaaaagaaattgcaatgtctgaaccaacaagtaattaactgacatctctagaacaggaaaagaagttctgtaaatcaacaagtaaaagatagcaagtcttgcagaggaatcagcaaaggatacagatagttttcatgagaagaaacttctccaaaaggcgactaagcacatgaagaaatgtgtgtgtctggggagctttccccttctaatactaggtcagtttctgtgtggtaacttgagaatacaatgaaacatcgtttaaagtaacctgtggcatgttactggtaccttgcaggctaaatacatcctaagtgtgctaatactgcagataccttgatccccttaggacagttgacccaagccttcccaggagctgtttacctgggggtgtcacctggctgcaaaacagggatgaacaatgcacagatttcaggggtcacccagggatgctgcgacctcagaacacgtcacatggaagatgcctctcagtttccatctgaaaagcctggtattaatccaataattcaatcaccaaatttagtagttgcattccccagattttcttttgggcaatccacagtttgtagaatgcttttctgtgttcccaggttcagaatttcagggattgcttctgtcttcaaggagcacttcagcttcctggttaggaagagaaggtagcagacgtgtagaaaaccctctgcgagactctgctctggcagttttatgggtaggcgcaggcctgcctgaaaccaaacgctttcctttttccttcaccctttcccgttgttgtctttttggttcctttggtatggtagtgtctccatgtgagtttccagggaagcagaggctgaagcgagggcgtgggagctgtttcatgcattagactctctggggagcagccacagggaggggactgagggacaccgcgggatgtccagagaggccggtccccagcgggtgggggcgggccagacggtgcggagggggagaggaggaagactgtgtccagggcatgagccttctggcattgtgggttcccccacgctccagcgccggaggggacccaggcggcaccagcgcgttaggctgcccccgggagcagtgctgcaggagccccgagctcgaggtggtgccggcagccgcgcgctcagagctccaacagggctgggccgcggccaaggagccaggagggtgcacgagaacgtcccatccagggacccacggatacttcgttcctgccagggtctcctttgggccgacagagttgtctctaattgagtgcaggcagccccggagcccgccgagagctgaggctgggctgggctcccggggactcgggcagctatttcaggcagacgcggggcatcgcgccccaatgcgcacagtgttgccgaggggcagaaagagagggtctcagcctaagccaggtggaaggtccgagaagaggctggaagggggcgatggtccagcaggagctgggatgaacaagggctggaagagcaggtgggagttccaggtgagggaagtgacctggaagcggagcagaggtcgcagctggcccctgctgggcctagtctcgcttctgtcgtgaccccttgtctaggaagatcccatcgcgaaggcctcatgagtcccacgtgaccggcacgcctgtgaggcaggaagctcagagtccaggccccgtgcccctctttgggggctagagcttctcccaggtgcaggcagcctgttcacaagagcggggccctcctgggtgaggcctcaggctccggttgtcacccctggcaggcgtgtgcccagcttagatccacctgcagctggctctgaacgctggatggggctgggttggggttttcctgtggcctggggtgagtcccagcaagccaccaccatccttgcccactccccacaggacagagcatagaccctgttcctaatcctcccaggccacactccgcagaatgctgcttctctgtttccaagcgcctgcatgtcttgcatcccctgccaccatcttttgtccgcctgaaggggcagccccataaaccttacttagacatgtccctgcccccagcacaggggctgccttcaagaccgcctttgtctgtggggtttttccttgatgactgttcagcatgccggccccactttcttctgcttgcatctggggttctcccaggctgaccagctgtccccacttgctgggagtgaaggggtttcctgggatacgaactttcagtattaaaaccaggagagtcccagacaaactgggacaattggtcaccctaactgacccacaagtagaaaaatgattcataaaatgtataataatgaaaagctgtgaattatttgcatgtataatagagggagaacatggttaaataaatgtggtgtagccatttgaaatagctactacagggatgaggaaacaatacctataaaataacacagaaatgttgatgacatattaaggaagaagaagtctgggttatacatttgtgcaaactgtatgatttcaaccatatttgtacactccatgtggtagatgggttgttggaaggtaaagactggctgcataggggccctaaaggtgagagcttttcaatactgctgcttacgctttcttcttaactaattcagatattattttgccaaatgcagagccaggaggtgtgaagcagccttcatggtggcaccacatgtgacacagatgagtagatgggtgcagcgttgacaataactgcagtcatattgttcatcttgatgggatttctgagtaacaagtcaaagatgcagaaattaaagtatacaaattggattgggttttcagtaaaggaaaaggcaccaaatcgtttctcagtaaggcacagtaaagggaggctatcaaaacctattgttagtaaaagtacctattgatgatctcttaagcaaaattgttacctagttgtccacgtgaaggaaaggactctctgaaaagagggggctgtttagagaagaatcaagcctctggcaccagaggggactccccagttaggaaactgttgtaacaaaaggactccatcgctcagagcaggatcagatgataaatcaggctgaaatggtataagaaacctacaattaccttcctccatatgaataattgaaaaggcaatggcttcatttaggttgtaatctgacttacagcttttaatagctatgctctgttaaagtgtacacattatcttttaccttattgagtttatattgctttatatcaatataatgatttttttactatgtaaaaaaatacacttacatagtaagtatatttacatagtaaaatcaataattttttttactgtgtagcaaaatacacttacttgattcatgaaccattaagtttttaaaatctgtgtgagataatgtattctctgggtttattttgactactgaaaatttctagtcacaagacattatagctagatacattccaggtgtttttaaatgttaaactgtcttcagcatcagaaatggcctcatgaggtaagtcattattttcccctattttcaaggatggaattgaggctgggagcagttttgtgactcacccaagttaagatgtcatgaaaaattgtttccttgcaaggtctgccacaccctaaaccaatgtcctgtcccaatccacctgacttgagggctgttagattttagatgtcagaatcacatggagggcttgtggaaccagactgctgggcctcactggagtttctgatccaatgggtctggggtagggcctgaaaatttgcatttctaacacttgcagttcccagatgttgccgttgtcacaggtcttgggaccacactttgaggatcactggtctagaaggaggcttgtattagctagtgatttttttcattgtgatgatgatggctaaccttacacttgaacaaaaaatgtggctttctttaaagaaaatcatcagaagttcagttctttaaaattcagctactactcactgacatggtgtattaccctgttctcatgctgctaataaagacatacctgagactgggtaatttataaaggaaagaggtttaattgactcacagtacagaatgtttggggaggcctcaggaagcttacgatcacggtggaaggggaggtaaacacttccttcttcacatggaggcagcaaggagaagtgctgaacaaaagggggaaaagtctcttagacaaccacgagattccatgagagctccctcactatcatgagaacagcagcatggggtaaccacccctgtgacacaattacctcccaccaggttcccccatgacacatggggattatgagaactacaattcaagataggatttgggtgggaacacagccaaaccatatcattccactcctgtcccctcccaaatctcatgtcctcccatctcaaaacacaatcatgccttcccaacagtcccccaaattcttaacttattccagcattaactaaaaagtccaagtccaaagtctcatctcagacaaggcaagtcccttcaacctatgggcctgtaaaaccaaaagtaatttagttacttcctagatacaatggggatacaggcattgggtaaatacagccattccaaatgggaaaaattggccaaaataaaggtgctacaagccacatccaggttacactgatgcaagagatgggctcccacagccttggacggctctgcccttgtggctgtgcaggatacagccccgtcccagctgccttcatggctggcattgagtgtgtggcttttctaggcacacggtgcaagctgtcagtgaatctaccattctgggttctggaggacagtggccctcttatcacagctccaccaggaagtaccctagtagggactctgtctgagggctctgaccccacatttcccttccacactgccctagcagaggttcttcatgagggctgtgccccacaatacacatctgcctggacatccatgtgtttccatacatcctttgaaatctagatggaggttctcgaacctcaattcttgtcctctgccaacccccgggaccaacaccacatgaaagctgccaatgcttagggctgagacctcctcagcctggattccattgtccactatcagcattttggtcaaagtaattcaacaagtctctaggaacttccaaactttcccacatcttcctgtcttttgagccctccaagtctctaggaagttccaaacttttccacattttcctgtcttcttctgagccctccaagctgtttcaatctctgcttgttacctagttccaaagttgcttccacatttttgggtatccttgtagcagcaccccattctctggagtaccaatttactatattagtccattcttatgctgctaataaagatataaccaatactgggtaatatataaaggaaacaggtttaattgactcatggttctgcagggctagggaggcctcaggaaacttacaatcatggtagaaggggaagtaaacatgtccttcatcacatggtggcagcaagaagtgctgagcagaagggggaaaagctccttagaaaaccatcagatctcgtgataactcattcactattatgagaagagcagcatggaggtaactgcccccatgattcaattaccttccgccaagttcatggggattatgggaactagaattcaagatgagatttgggtggacacagcaaaaccatatcacgtggtttcttttactgaagcattttcccctccactgcaacttgcatacctgtattgcaactttcaagtgctataaaaatagcacatacccccatcaggcattgatagcacctccatgtgcagattttgaaggtaactgaaacttcctctgccctgacaggccatgctgctgctcagtgtcttccgctgctgtctccaagtggtgttcttgtcatcctggaagccctgccttgggccatgcctgaaatgcactaatatgctcatttgtgaggtagtacagagtggtcagggcatccaggcacatcatggatgatggggcactgttacgggtgctgggacactgccatgaacaagaggcccaggtccctcccctgtacctctgtagtcggtgccagcctcatgccattcagctaccttcacccataatgtccctgcaccctctctgttgagtctacctcctcttcctcctccatccagcctaggtctctggcccagttcttcagcccatatcttccagtggccccactgcccttcccactggcctgcctgggctgagagcactgctggagacaccactcccagtacatgctgctctgtcctctctagttcccggtgtcctgatattgcctgatagtcatgttgagtgtcctgacgtccactctggctctccagactctgttctctgccaacttccaacctgcccctccccactcataccctctccccctactcttagcaaaccactcactctccacttccctgagaaaatagaaaacttggaataatacgcttcttcgatgtcctgcaccaggacaatcaacttctctatctctgctcccatagcttccttctaaccccacagcagaagagttataatactgccccctgttgaaagcttattttccacctgtgctctggtccccacccctcctggcttctcaggtgatttccacctgcctaccacacccttgatgcctgtcttcagtctctccttcactggtgttctttgcttgtccacccttaaacctgcttaagttcacctgtccacgcttaaacctgcttaagttcacctgctatttaaagcagtgtcccttatccctgtgttcctctgcagctgagcacctgtaattccctgtcataggcacattcatcatctctacattctcaccttccactcactcctcaacctagtgtggtctccatcatccccgccacaccacagaatctgtgcttcccagggtctctgatgaccttgaggttgctgttcactcacctcctcacccctggtcttatgtatcacaccaaagtgtcagctgtgcaaaagccaggaataggattcctactctgtagggacccctgtggctggcgcaggtagctgccatagtcaccggttcatatttcaccgttctgctcatttcgtgctccctggtacatctcttatttcactgcttgcatattctgtccaagctctgataaagccaaacacatttaacagatggacacaactggccatgcttcaggcttctgattcacccatacttccaggagccatgaatctgaaatctggagctggtctgtagaaagcattctatttagtgaaatgttgaaggaattttaggtcaactatcatgtatttcattgtctccaatgccataatttccaagtgcctacttgaacagtagatactttcaggggattttcatatcaatgattgcattttgccattgttctttattttttcagtaatgctccatctgtaaacaacccaaatttcaaagcctgacatagtgtattgacaaattattcctggatgcctgtttttatcaggccaaaatccatagttattctaaaatggatatcatacaaataatgctgctgtagcatgctaacattttccagactattatgaaaatgtttagctcatttacaagtcatgggaaacaatatcggaatttgctactgtgtagaaccattactatagcacttccagtgatgcctgcttgtgatctttattgcccactttatagttctgtattttcatctccattttttaatccttaaatatacaaagtaaaatgtaaatatcttttttgtgggtcttttagaattattttttagcattagcacttgtaaatttactggaagtttcaacaatttgtatttcatgttagataaaagtaaggaagctttcaaagaaaagtctaacaaatataacacatgtacccacctccccaaatgaaaaaatgttagcattttgttgtattttatttagatttttttgcagagaaataagccattatacatcaagttgaaattctacttactattgttgtgcgacaaattatctcaaaacgtagtgatttaaaacaaccatttttttttactcacagattatgagagtcatgaatgccgaacaggcacaagaaggagtgtttctttctgctccacaaagtgcagcttcagataggaaggcttagaggttgggatgacccaatggccagggcaggagccgtcagggtgtcttaatttactgatttggcagagagtagtgctgtcagttgggccctcagttagctgcaacaactgcacatgatacctctgtgtagcttgggcttcctcctagcatggtggctgcagacgtcttacaaagtggttcagagccccacaggtgtgttctataatagctcacaaggcagaagctgcattgcctttcaggacctagcctcagaagtcacactgcctcatttctgctgtattctgtcagttccaggagagtcacaagcccttcctggattcaagggaaagggaattagatgccatttcctgatgaaggtggggcaaagttttgaaagagcatgtgtgggggactcatgccatctttggatagtcccagtctccctcctcaaggacatcaactcttgtagtttgtctccagtccaaacatgtgtgggcactttccctgcatatgtgggtatccacgtgaatgtctcttcattgcttctccatctttctaaaaagtaatcacagagagtcatgaaatccagtgttagaaccaggcattgttaatgctcttatgttattattattcaagctgggctaggggaatgtggcattaataaaacaatatgtacattggatttagttatactatactctctattctaatactttgtaatcattagtaataaatagtagcatattacttcatgtaggattttgcaaagcttaaactattttcacatttgttccttcagtccaggcttcctaaaaataaaatataataagagtcttgagacttaagttcatattttgcatgaatcagataaaataatagatagtaaaatgctttgtaaactgtgcagagctattaagttgccccttatcattaagtttttaagtctgattttctgatattgtaatcctgtcctaggcttcctctcatttctttgctgtaatctttgcttctacctcatttcttgtgtccaaatacaatcagttattcaaggcctggctcaaatgctgcctagaagcctttcctgacacagacctcccagcttacctcctctccctcctctgtgcttttatcgcattctgtgtttctctggtagattatcttttgtattctatttcacgtatcacatcactggggctcacctggaagcttctagcaaaccaaaccccagtctctgtagcccttagtgcacaacaacatgcctcccacccaggagcaggctgtgaaagtctttttattttttaattattatactttaagttctgggatatgtgtgcagaacatgcaggtctgttacataggtatacatgtgccatggtggtttgctgcacccatcaacctgtcacttacattaggtatttctcctaatgctatccctcccctagtaccctaccccctgacaggccctggtgtgtgatgttcccctccctatgtccatgtgttctcattgttcagctcccacttatgagtgagaacatgaggtgtttggttttctgttcccatgttagtttgctgagaatgatggcttccagcttcatccatgtccctgcaaaggacatgaactcatccttttttatggctgcatagtattccatggtgtatatgtgccacattttctttatccagtctatcattgatggacatttgggttggttcccaagtctttgccattgtgaatagtgccacaataaacatacatgtgcagcgtgtttctagtagagtgatttataatcctttgggtatgtacccagtagtgagattgctgggtcaagtggtatttctggttttagatccttgaggaatggctacactgtcttccacaatggtggaagacaatcccaccaacagtgtaaatgcgttcctatttctccacatcctctccagcatctgttgtttcctgcctttttaatgattgccattctaactggcttgatatggtatctcattgtggttttgatttgcatttctctaatgaccagtgatgacaagcttttttttcatgtgtttgttggccggataaatgtcttcttttgagaagtgtctgttcatatcctttgcccactttttgatggggttgtgtttttcttgtaaatttgtttaagtttgtttacaagtgggatgacagtgtaaagtctcccactattattgtgtgggagtctgaatctctttgtaggtctcgaagaacttgctttatgaatctgggtactcttgtattgtgtacatatatatttaggatagttagctctttttgttgcattgatcttttactattatgtaatgcccttctttgtcttttttgatctttgttggtttaaagtctgttatatgaaactctgggatgaaaattattgtcattcagaatgtcgaatactggcccccactctcttctggattgtagggtttctacagagagatccactgttggtctgatggacttccctttgtgggtaacctgacctttctctctggctgccctttacattttttccttcatttcaaccttggtgaatctgacgattatgtatcttggggttgctcttctcaaggagtttctttgtggtgttctgaatttcctgaatttgaatgttggcctgttgtcctgggttggggaagttctcctggataatatcctgaagagtgttttccaacttggatccattctacccatcactttcaggtacaccaatcaaacgtaggtttggccttttcatatagtctcatatttcttggaggctttgtttgttccttttcatgcttttttttgctgatcttgtcttcatgatttatttcattaagttgatattcaatctctgatatcttttcttctggttgattgattcggctattgatacttgtgtatgcttcacaaagttctcatgctgtgttttttagctccatcaggtcatttatgttcttctctaaactggttattctagttagcaattcatataaccttttttcaaggttcttagcttccttgcattgggttagaacatgctcctttagctcagaggagtttgttattactcaccttctgaagcctacttctgtcaattcatcaaagtaattctaattctccatctagttttgttcccttgctggcaaggacttgtgatcccttggcgagaagcagtgtcctggcttttggaatttttagcatttttgccctggtttttcctcatcttcgtggatttatctacctttgatctttgatactggtgaccttcagatggcgtttctgtgtagatgtcctttttgttgatgttgatgctattcctttatgtttgttagttttccttctaacagtcaggcccctctgctgcaagtctgctggagtttgttggaggtccactttagaccttgtttgcctgggtatcaccagtggaggctgcagaacagcaaagatttctacctgtttcttcctctggaagctttgtctcagaggggcactcaccagatgtgagccagagctcttttgtatgaggtgtttgtcaacccttgctgggaggtgtctcccagtcaggaggcatggtggttagggaatcacttgaggaggcagtctgtcccttagcagaacttgagtgctgtgctgggagatctgctgctatgttcagagctggcaggcaggaacgtttaagtctactgaagctgtgcccacagctgccccttcctccaggtgctctgtcccagggagatgggagttttatctataagcccctgactggggcttctgcctttctttcagagaggccctgcccagagaggaggaatctagagaggcagtctggctacagtggctttaccaagctttggtgagctctgtccagttcaaacttcccagaggctttgtttacacggtgagggggaaaaccacctactcaagcctcagtaatgatggacacccctcccccaccaagctcgagtgtcccaggtcgatttcagactgctgtgccggcagcaagattttcaagccagtggatcttagcttgctgggctccataggggtgggattcactgagttaaaccacttggctccctggcttcagccccctttccaggggagagaacagttctgttttgctggaatttgaagcaccactggggtatgaaaaaaactcctgcagctagctcagtgtctgcccaaatggctgcccagttttgtgcttgaaacccagggtcctggtggtataggcacccgagggaatctcctgatctgcacgttgtgaagaccatgggaaaagtgtagtatctgggccagaatgcatggttcctcacaggatggtttctcaaggcttctcttggctaggggagggagttcctcaaccccttgcacttcctgggtgaggcaatgtcccaccctgcttcagctcaccctctgtgggctgcacccactgtctaactagtcccagtgagatgagctggtgcctcagttggaaatgcagaaatcacccaccttctgcatccacctcgccgggagctgcagaccagagctgttcctattcagccatcttgccacctgtgaaagtcttttgaatggatgaatgaataaatgaatgaatgaactgttttttcactggcttcatatgctcatgcctcactaaggttgtagaaaatacaggatcttgaatactttaaagtggcaatgtcttgtgagacagacatcatccctgctgtcccaaaattacccagcgtgtgtggagaggcccctggctttggagatggggggcatttcccttgactcccacctcctcagcaccacagggctcatctctggggacctggctttccagttagagcagacctggatcaagaagggccacaggaaagagaaaagaaagacttggcagtgggagggcagggcgttcaggcctctccagggaagggtgccaacctctggacttagcatgatgtttttaaaagaaatgaatgtgtgtcttgtctctaccttcaacttgtaaggcaagtgcagtgccagaggctggggtatctctgctgcccaggtgcactccacagagacagagcaagagcacgtgcagactgtgctgtccaactcgcatagaaggctgacaaccacttccgtcctaatggggaaagtgaagttggcaaggcagaaatgaccacatgctcacccaaaaccttggtagcagcatgtctttccagaaattttgcaagccagatctggaaatttgatggctttgctcctctttttcctgaaagaaatggaaggaatcaggctcatgaaaagccagatttcacctccatgcacacaaccaggacccttgccttcctgaaatgccccacaggctttcacagaatagatgcagtcttagcagtgggcagcttgcttgttgtctggcctaagtctgagccaagataaagacatataaactgccaaggagacactctattccagaaccttctcttctttgcaaagcaaacataattttaagatcaagatgcataactcttgtaatcaaaagcttacacatttcctagcccccccaccaccctccacccccaagcaatgggttctaagcaatataaactgccaaagtggtgtgtagagggaaataaaaaccagactggtaagataccaacttttttataccagtttcagaaagtgcttatgcagagcaagtgtgggacaatattcaattggcaaaaatatgatgaaagtagctcacttaagaaaggaataaagtcttgtttattgaaagaacagtgacaagtttttttaaattctgaaagtcttgcatatttcctgcactgtatatttacctaagtacaagtgttttaagaatgatctcttgagcctgcttaaatcaagaacgcatatttcagcaatttgaaaaaaattgcatttctttgttcatggctgttctcggggttgagaggtatggacccaggagtcagaggtctgagtttaggcttccacctgctaactagcttggaacctctgactaggtttttaaaccctctaagtcttgggtttctcacctgtagaatgaggataataatcatgtctacctcacagtattgttgggaggacttaatgagatgtagagaaactaatctaaagcctggctcacagaaaggtaatgtgaagtctcaaaaaaagtgaattttacaatagcaaagacatggaaccaacccaaatgcccatcagtgataaagaaaatgtggtacatatataccatagaatactatgcagccataaaaaggaacgagatcatgtcctttgcagggatatggatgaagctagaggccatcatcctcagcaaactaacacaggaacagaaaaccaaacaccacatgttctcactcataagtgggagttgaacaatgagaacacatggactcaggcaggggaacaacacacaccggggcctggttggcgtgggggcaggggggtggtgcggagaggggtgaggggagggcgaacaccaggacaaagagctaatgctcgtgggtcttaaaatatagatcatgggttgataggtgcagctaaccaccatggcacacgtatacctatgtaacaaacctgcacatgtatcccagaacttaaactaaactaaaatttttttttaagtgaattttagccactagattttagagttgaagcatgccatggtacttgtgattaggcatctacctgtgtatttattcacctgaacacctggatgtgtagaataaaaattgctcaattgttgaaggctgctgcatcgctctatgctacttgttctgttaaagtatgttcagggagccagcccagagaggcacctccttttagctctgtgaggccttaaagctgggtcaccatgaagtccctgtatatatattttttgttttaataactccaagtaaccaaatgaaaacaattatttataaaatgtattaagaagtaaatgttatcaatttgggactttgcacaactattattaatgtgacctcaggtcccatgacaaattagaatggcaatcctgggtgagaagttaattttgtcctgaagctggcagaatcaacatgcaccccagttgtgggataggcctgttctctcactccatcacatccaacacctggcaaggacagcttttggtatgctaaagaatttgggaaagatgctgttggtgtaggggcggggagactagaaacaagatctttccatgggcagagctcttcagagcttgataacaaagtttggtctgcagcctttgtcaaataattataaactctccagttgaaacagggaaatgtgggctggcgtggtggctcacacctgtaattccagcactctgggaggctgaggcaggtggatcacttgaggtcaggagttcgagaccagcctggccaatatagtgaaaccccatctctactaaaaatacgaaaattagctgggtgtggtgatatgcacctatagtcccagctactcaggaggctgaggcaggagaattgcttgaacccagaaggtggaggttgcagtgggctgagatcatgccaacacactccagctgatagagtgagactctatttcaaaaaaaaaaaaagaaagaaaaacagggaaacgtttgcaaagcttccatctccaggttgacttcagtcaataatcctattgtcttaaggctggagtggacttccttgaagctctttgcccagaaaaccttgccaaaactctcctaagattattaagagttttctcgagtctcttttcctgattccaatcaactggaaatgttatgaaaataattctgtggtcaagtctcacttactcttgctctcaaacacaatccaccaaaagaacaaaacacaaagtaaaagtggatgcaagacacaagaggaagaggggccctctgcagaggctgctaagcaaacgtaggtttggctcaaagatttttgtttctttgaatcagttcactatttttaacctgtggaaatttgttcactcattctaacagtagcttttgctttgtgaaattggtttatttagtgttatgttcctcctgtaaaccttttcattgtatgtttttctcctaatctaatggtaatcctctcagtgatatgagtaacctggtgtttgtatttaacactccttcaacattcacagaatcagaaaatatcagaacaagaaagccccagccttcaagattgtttgatttgtgttccctaattttatgtgtgaacaaaactgaggctgtgaagattctagaataatatgttgagctcaaaaatatggtagtagaattagaatatagctttctaatatttgtataaaagtcaatgatatttagaagtttaaaaaagatacacattaaactgggaaaatactaaatatttaaattctgtaggctagttttcatattctggaaaggtggattttcatatggcactggtgctggtgtttcatcaggtcagctgtctatgtcataagagggtgttcttattagaaaatgtaggctttggcaagctttaaaaggtacacgtgttactgcatgttctgacgagattttgaaaatctttggcaactgtgctttccaagtggagaaaaagggctaccataatgttgaaagacggaaattaaaatctaatcagatatggtggcccttatcctccaccttagaatttcttttcgtggaatgtctggtggacagtaatatatagaggctcctcgacttaggatgggatcacatccagatacacccattgttaaattgaaaatatcataagttgaaaaatgcatttaatatacctaatctaccagacatcatagcttagcccagcctactttaaattgctcagaatgcttacactagcctgcagtcgggcaaaattatctaacacaaagcctattttgtaataaagggttaaatagctcatgtaatttattggatatagtatcagttgtttccccttgtgatcgcatcactgactgggagttgtggctcactgccacttcccagcatatatgactagcctggaaaaagatcaaaattaaaaaacaaagtacatttctactaagtgcatatcactttcacaccattattaagtcgaaaatcgccaagttgaaccatcctaagttggggaccgtctgtagatcaggcaatccttgacattttatggcggcagattgccaaaagagattggagtctagaagtcctggaagcagccccaacaattacacagaactcagcatcatgccctcacatcaaggcaaggagggagagttgtccctatttttcctttccttgaaagggatagtgaaactcattctgaggtttttaaaaaatgtactttttaatgcttttcctctatctgttttgctctcccttgataccctgtctacatcatgatggctgtggcactgctcctgctccttacatggggtcttagaatgcacaaagctgcccaatatcactttctctgtatttgaggaaaatttctagtagcaaaagaatatcctctgacactcttttcaaaatgccaactaaatgtgatagaactactttttgcaacagtgaagtcccaaagtctctttcttcctgatgggttaatttagtaccttcctttttccaaatcaaagaaccataaaagtcagtgaaaatctgcattattattatcctgtgtgtttagttttgctttttagtacttaccattattaaacacttggcccatttttggctaattgttgtgtaattccaaatacaaaccagtcaccatggattattgcagttagagtcatcagaaagcaaggagctatgactcatgctctgttcttgccatgtttttctgatttgtatttcatttcttacctgtgctcacaagtcacatgaagatcaatacatctgaaatatatatgctgactatgtcaccagattttatttctcccatcattgaatctggacaggcttctttcaaaagtgttgagtcatttttatgtctttatcacactcttctaaagtccttaaaactcctaattatttcagaggattattgtcatataaggtatacaaaatcaattatatgaagaagttgtaatcactataattaaactgaggcttatctagacagatcctgtgtcatatttttcacataatgaggctaaaaactttgtggagaaaataatggatatttatagaatatactcaagtgtatttattttagaaggtctgttagacatttcacaaaagaatctgtaatctacagaaattaccaaattatgttacataatattttaaaaacttgttttagaataagttggaatgtgaggtttataaaacaactggaataataaactgaaattataatttaatttttatacccagtgcatttatttttcttcctatgacttgactatagtttaaaattcttataggtttagtatcccttttttgaaaacaggttttcaatgtgtttctgtaacaataatgaaaagtaaaggcatgtaatctcttttccaaaataaaagattggtttgagaattatgatcatatatacaatgtactaaatgcaaccttttatgatgatgatataaaagattcacagactcacaaatcatatgccactcaactaaaatactaagagaacataactttatctttataaaacatatacataggcataaatacatagacaaaggtctagaaaaatatgcatatcagtgtggaaatgcaagtgatgataatgatttctgttgttttcttctaatttctatagagtcactatgctatttaaattttcaaaaaattaagttatgtgcaataatctttttaaaattatttgttttttaatcagctttttaatctgatgacatagaatgataacgtagtaaatcatagtttctgaaccaaaaaacagggacacatagactgagaagtgccaagttcattttagagattaaaaatacaacggcattgggacttttctagaaaattcaagatatgtggtcacaattgaggtgttcagcttctagagcgaactgaaccagatatctgctaaggctctgatagagaacagctggaagctcagaaaggtaaacataattcaaatattggtgaatatgccagtgcagccgagaaggtgacaggatttgaaaaatgtgccaggacacaatgagaaaggccttggaataaatacaaaaagcccaaactttattctgtaaaagtggggagctactgaaggttttaatcaaagcagggataatctcatttccaaggcaaaaaaacaaaaagaggcattccttcctaataccacatgtaggagctgttcttattctatggtggattattactttagtagtatcttataaagacagtgcctgaaggtcttttatctgtacattgatgtaacacttttcaaaagcatatcagcagacacatttttggaagcatgcattctgaaacttgaacttcaaataggagttatggctgatatcatggagtaaggtaaaacagaagctgactcctctccagtattcaaggctgactgttgtctctggaactgagaatactgggaaaagtgtgagttggacactgtgcacaactctaattaacactgttctaaagggaaagtatatgaatatattgtttaaacactaatagttaaaagttatactacaatatcttcaaggtttaacacataaattgagacacacacttaattaggcctaagaaagaagtggaatgtaaactcgttgattttattttcataaatgatttattttacaactatgaagaggaataatagaggccttttattagcaaagagattattatgatgtctattttcagccatgatttttctaccaatggaaagtggaactgaaaacctacttagggtgatgtgttggggttgggatcaaagagactactataactgtcctacctctgagattccagcatcacatgtggtgacaataacacttcatttagttatatttctagtgagtccagtggaatggagaaaattttttaagttaaaaattctaaaggacatatgtataatggtaggaattatttagtcttcttaataaaataaatcatttattttagaattattttgtagtctgaaagcacatttcctataatttttaaatgtgaaagcaggcaatattatcttgtaggtattgtattatattacaagagccaaagcatgctgattcccaatttcatccagtatgacttgtcttagaaaaagaaataaaaatgcagatccatttattcacttattaactgagtacatttcctgaatccatgtgcacgttgggtgataggaagctgaggccctgctggctaaagatgtaagagaacagagcctaaaactggcacaccagctggaaattaggagggcaagtttccctagaaatgggagaaccacagataggatgaaccccaaaatctgaatataaactctttccaaatacttggctgaccaccaacttatgcaaacataagggagacttcagtaggccagcctgaaacaaagcaactgcagaagctgaaaaatttagggatttgtcagttgctgcatatcacaggagagcagagcttgtagtttgagtccaggtcagctaacttcttaccagaacaataagccaatgatcaccaggagagcacaatagaactcagaaaggctgcagtgactattatctactagctttaggccctgtcctctgatatatcaagctagtaagacatgcaaggaaaccaggaatgtgataatgcctggggctgggagattatggaaattgtcagtcacccaaaactgactctaaataggcctccatgttgaatttagtagtcaaagacttcaaagcacctattgtagatatgctcaaccaaagggcattaaaagaattaaaggaaaaattgtcttaatgaatgagtagatagggaatctcaacagagaaattacattattaaaaaaatggaaattccagagctgaacaagtacaataattgaaataacaaacttgctaaacagtctcaatagcatattggagatggcagaagcaagaataagtgaaattgacaatagatttttaaaaatggcccaatcttaagaatagaaagaaaaaaatacccacaaaaaacactatcaaggagtccagcacacaaaatccaagctctgcctgtgcattaggcttcaggacatgagggaatggcagtgaattagggctgcactatgccaggaacactcatttaccacaactggatttgtcagcagttcgagtgaactttccttaggcattatagaattaactgtacttagagagaggttcttggttaacctcagtgttttcacattttaaattatttcctaagtttcaagtgaaactaaatatcatttgaaagacttttaaaggcagtctgcccaccccactccaactcaccccaatttccactaacaactacttcaaatgtaattgtcagaaagagcaccccactccactgcaccccaaatcagcctccgatagatattgcatctgaccctggggggcccttcccgctttcctcttgctatgctcactacactttatttccctcaatgaaaactccttccccaccctcctaatgtgtgacttcacattctatacatagaatttctttttttttccaaagtgaatatagttttatatattttttaactacataaaaataaaacacaatcaatacaaaaagaaatggataaaacgcaaatgtgaaaacaaactcaccaatcaccaaccactcagaactttaggtcagtttaataggtgtcctcttctgacatttcagtgtccagtctgccctccttatccatggggtctgcatccacagatttatccaaccatggatagaatatatgttttaaaaagcaaaaaaaaatatataaataaaaaccaatacagtataacaactatttacatagctatgttgtattaggtattgtaaataatctagaaataatttaaagtgtatggaaggatattcataggttatatgcaaatactacatcagttttggtgggggggatggagtctcactctgtcacccaggctggagtgcagtggtgccatctcagcttactacaacatctgcctcctgtgttcaagcaattctcctgcctcagcctcctgaatagctgggattacaggcgcacaccaccaggaccagctaattcttgtatttttagtagagacggggttttcccatgttggctaggctgatctcaaactcctgaccctgtgtgatctgcccacctcggcctcccaaagtgagccaccacgcctggctcaaatactatatcattttatatcagggacttaaacatctgtggattttggtatccaaggagggtcctagaatgaatcaccagattatggtcatctcctgaggatgattgtatatacataaattcggggtgttttacaccaatggaatcatatgcccagttttataatctgattttaatttttactcagaatgtggatatcagtccaaatcaataaatatagacaataattgacttagttcagcagagaaactggaatctcacactaagggtgaggaaggcgggagacaggagcattcagggaggggcaactcacaccttagagaccaggaaagactcaggtgtttctaagccaggggagccagtggggctgaacacaagagaatcgtgcaagctttaagaggagcatccagatccccagatctccggttcctccaggcagccccaggggtctgggaggctgggtgggaaggagatctaagtgctccctccatgacctgctgctcgactcccaccttccttccaccctcagaatttctctgtgggcctcattgtgactccgctcccctccttcccacccaggggaagccatctccacatgatggactttatctgtgtgcctcatcatgtctccactcacctctttcccatgcagggaaagcaggctccgcacagtgggctttctctgggctcctcttcttgtctcacagtctcctcctctgtggcttatgctctcaggttcctggtgcatttatcaaaccagcgctccgggtcctgctcactctcctctggctgccagtgggcagctccctgcctcccagtgttcttaagttcagcagttataattttcatctccaatgattcctttttgcaggatgctcctttttcatgattaattgctctcattttgtcaatgcagcagactcttgtgtctcactgaaagcatgaattcaggtttttagttacttcttgtttcttgtgtactgttgtgcatggaatcattttctccagttctgctcttctgaagaattgtgctgagccctgctgccctgcctggccagcatcttctcttcatatctgtagatggacagagttgttcggtgtagcaggtgccctgcgttctgtcatgggagacacagtgccttgttcaattctttcacttcccagttactgtattttttctggttggtggggctcagggggagatatccaagggttcaggagctctggccacttttccttgtgagagtttgatggggctgaacaagacagttagggaaggaggtaagccctcccttcaggtgctcagcccctctgacctctgtactgtctgccccgtggcctccagtccctcaacacacacctgcacccaggaccaagcttcctcggccctactgtgcgcagctggacccatgggctcctgcacaactggaccccagaatcctccctgcagccttcctctgccttccagccgacgcaggagctgttagtgaaggggaacagaaaaatggatccataaatccttgcttacctccctcgcaggctctcttgcctgggacagatgacatggctcctgcctgctctgctctctgtcaaaacttccccaagtattgagtctgtgggcatgaccattctctagtttctatctgtggcttggaatttgtgttaatgtattggttgggtcctttcaattggaatggggagagagaggaatccataaatctgtgactcagtgacctttaggaattggaagccaaggtctatttcttatgtcttattttgttattgtgcatagcagtgtctctcaactgtttgaatccaggcccctggagatgaatgtggactgtcagtggtgtggctttttccacctgcaccttctgcagagcagggtgcaccttgagcaccttgagcacgggcaccttctgcctgtgcacctgtgcacatgaaggagcctcttggggtcttgctgcctttggggcttttgctttcgcctccagctccttatacttctgcccatatatctcactctctgttttccagcctgtcttttctgttttctgaagtctgccctttccccttcatggttaggtgaaggaaggggaaatagaaggaaatatttgaagaggaaaggttgtggcactgcagggtatttgtgactttgtccccaattgcattcttcaagtgcagttcttggtttttagggtatctctttgagtgagattatctttaagtcttttgtccttattctgagaaaatcttataaagtttccctatatcttttcatagcctggatttctcagaaaacacatggagaagcaaagcttctgctaggttgctgtgggaaggggaagtataggcccaggcgggcagagtgagggaaggggagtggggcagagtgggcaggaaagtggacacatgtgggtccccacagagccctccagatcccatgcatagagcagctgctgccaccagcagcacagacatcttccaagggctggcagagccagggcacctgctctccaagaagggcagaggtcggcaggcatgcacagcacttaccccaaggcatggtgtcattattgctgttgctttggagcctcttatgggactggaatctgtggagaggatggagagagtaatgcatctggaatggacctcctggctccttcctatttctcatcttgatggtcacactgcacacttcccaggccgcttggccacctcactgtcatgcagccaccaggacagccagatccctgctccaagcactgcaggaggagtcctcctccagcagggtacaacctggcactgcagctgctgtgactcatgcgcatggcatcaaggcagccatgcccaggcccagctcttacctctggggaagatagacagctgacaggtcaggacacagactttggtggcaactgcccgagcacccacatagcaagttgccgaggccaggggcatgcagagccaggaaaacctgggaagatgcataaacaggcccagcccaactttgctttctgtaggtttcaggttggcagaggaaagcaaataagtgaagaaagagtggtgggggaggagcattggacagagggaaggaggccaaagacaaactcttctcactgcctgtaagtgagcaggagtctgacccccggcttttctcccagagcctgcttctggctttacagttatcactgccacactcatgagcagtatttccaatactgcacagcaagaggggctcccaaggaaatacatgtagacccaatctcagcttaggcaaaaagatttctttgctacaggatttgtcagaaccttaaaatgtcaatgtattggaatgtctgcattcagaagggctatccgagacattatactaatgtatgatggtctccactcatgtttttggaggcctcatgggagtagtgtttataggcgtcaccttaggaaatgctgccctagacttttctgactgtttgccagccccatcaggctttggatctcgtatcttcagaaatgctgtcagtattttccaaggtaaaaactagtaaagaaaaccaaacaaaaatccagaaatgtgctcagttaatagttctcctagtatcttcccagaatagcatgtgcatttcacccttgtcctggagataatgtctattacctggattataatctggaaatgaattctaactccttttattatgggcatgaccttgtttctgtactcccagcctccaaccagcaagaaaatgggggtctcagtcccacagccacaaggactgggattctgtaaatgccccagatgagctgggaggcagattcctccccagagcctgcagatggagttcagcctgcccctgacaccttgcgtgggagacactaacagggagaagagctgagcctcccccagccttctgacctacagcaccatgtgatcatgaatatgtgttattctaagccactaagttggtggtaatttgttatatagcaatagaaaacagatgcattaagtttgtctacaatgcccatgcctgcagtcatattctttggcttcctagaaggtgaccagcaatacatgtcagagtgtacaattagaaaaaaaaatacaaacaatacattatgttgtggttctcaaacgtgagtgtgcatcagaatcccctggagaagtgtattcaaacacagatttctgggacccacccctagaaattttgactcagtgtgcccgaggtggatcccaagaatttgcatttctggtaagttcccagatgatgctgttgctgctagaccaggaaccacactttgagaacactgtgttaagtcatgagctctccttttgaaaataatgatttactaagttgctgtatgtttctcaatctctactttaattgcttattttatgataaaaaatatttctataaaatgctcatagaaatgcctcttattgtgagtccagtccccattaagttgcctgtctacattgtgcttctgaatttagtcatttttccctttgggactgttctatacaccaccttattcactatttttattttcttacaaataaactttacaggaatcagcttaagaagctaacagcaattatctgcaacaagaataagtatgatgaaaatagagatgttacctgattgtggttctttattagagagtaaaggaacagagaaagaattaccccaaagctgcattgtgcatcagctgctaagtcatggcctgcttgggcaggtacgagaccagtgttaggaaatgcaataatccagacaactggagctgcagggcactggctgtcagttacccccaaaccaaggagagaagccaaggggaagactcccctcttgggctcccaaagaggtgaatgtattagatagtcactggctagagcatccaatttagtcatctttccagaacactcacggtcagatgacatgatgatgaaatatctcgtatagaaggctgatcatctcacttgattaaaaagttgtgtgacctgatttttccatagaattggcccttaatcatgagccatttttttgtcttgtatttaatatcagtcttgtgccagttccttggaatatccaactgactgatccaatcaatgaacgagtgtttatggagagtctaccaagtgccaagcaggagaacatcaattctgtcagccagtccttggaataatccaacgtggccatgtgggaggccacggcaaaggatggccaagcaccttaactgacagggttctgttcttgttcacagtggggagggtaattctccaaaattcagtcctgccactgccactggagcaagtaaggggtgtcaggcaactgtcactgtgccctgatgtgcagcgtggcatgtccacttgactctgtgacacgtctctcctcctagcccactggtagagcaggtcagagattggtcccttcttgaccatttgtactcccagtgttgatgatactacacccagatggtcagagcgaggctgcaatttcagctcttaactcatgccccggcttagcactcttctctcttagtggaagggaaaccctggtagtgccaggtttatggctgcagggctgagagcaacaaaacccatccaggcagcaggacctgctggttgggctgacagccttggagactgtgttgaacctggtcagcactggctccagcagggatggggcagagtctgtatagtgaagtctaacgtggttggccttgggtgggattctgtgtgggtctcatccttttggatggaattgcattaaatcaatgcagtgactcaagatgtttagttcatgaaaaacagtagctatgcttgccaagtatttgtgcctttgattaacttacttagaactaattaatcaccacttataatgtatacttttttaaacagactcctccaaaatggggaggcatgaatttaaaatagagtagccctattcagatggctatgatccacttgttaagcactccttagcctgagtggcctaaaaatcggagcctggggcaaaagcttatatattaattcttgatcaagggctgccatcctagggaaggaagaggggggaaagcaagagcggcaggaaggagggagagcaattcagagcgaggaaccccaagccagccacaactccacagccaaggcactggcctcattccccagggagctctgcaaagtctagtggaatatctgtgtctcagaacagccatggagggggttgggctccctcttctcctgtgctccatcttttactggtcagagtctgtcctgagagacagtcccatcatggctaggttgtcgggtcctctctgcttgggaagccagtatcttgcgggtccaggctgacacctgagaggtgggaaaaagatgtacactctctccagggggctgcaactggggaatgagatgagtgagccaccagggagatgcagctgtgtggaccaggactcagcacaaagctcatccctgaattccaaggagtgagaatgcagaagagagagctatcttccttgttgttttattaatctttgttttatgtgaaactgataggagtattcatttcctagggctgatgaaacaatataccagaaactgggtggtttcagaaaatagaaattgattcgctcctggttctggaggccagaagtccaaagtcaagatgtgcacagaaccatgctgtctcttgggctctaggagagggtctgttccatgcccctctcctggctccagcactgctgccagtccttggcactctttggctggtagatgcatcaccccaatctctgtctctggcttcatatggccttttttctggtatgtggctgtgtctctgttttctcttcttcaaaggatacctgtcattggactagggcccgctctgatacagcatgatttcatcttaactcattacatctacaaagaccctatttccaaaggtcaacttctgaggtttcaggtagacataaaatgtagggtgttgagggaggggggaagccagtcctataaaatacgctgaaattaactatcttccagcaggtaaatagttgataacctctatatcaactgcatattagactaaatcctatttaattggactggagttgggctcaggcattttttcatttacctcaagtaattctatatatatatattttattatcatcagcattatatcactgattataatgcaattggtaacatttattggacagttactgtgtctcaggcactgggctgagtactttatgtatattataccaatgactcatcattccagttcttcatcttacagataggaacacaagagtcaacaatgttggaaaatcgccagaggacacagacctgggagcggccaagtcaagacatccaggctgtctggctccagaactaggactcgtctttgccaagagaacccagaacatatttagaacctttcatcttcttctcgtctttagacagtctcagttatttagagaaattgtaaacattttaagatgcgtaactgcaagccttcactacaaagaaataaaacagcctggagagagaggggctgacgtatcatatgtatcttgtacaacctgaggatgagtcaccaagggcagaagttaataaatgacaggaattattattcaaacagatttaatactttcatgtctcccaatttcacaagtttagaaaaaaagtgatgcatttagaagacatctctccctcctatttcgaagcttagctgcctaacctacagtaaagcctgatagttatgaaccttggagaacagcttctatgacaagtgaggatctaagagcctatatctcataatgatgcctctctgcattaaactaaatcaccccattctgggcaatcattgcagatcccctggtttcctgtcttggccctggacccacactcccttccccatcaaaggtgggatggggagaagcagctgcccagcttaaaacagtgtacttcccagtcatgtgccaggcagaaccttgttggcacccacgtttctgtctctgtggctggacctgctcctcatcttgtcttcagtgcccttctttttcctttgatttctacctaaatccagctcattgtgggaccttctctggtccaaccttcttcaagtctccagctgctcttacctccatgggccatttctttgtttgaaattatcttacatttagtcgattccattctgtttagatctcagctgctctacatttgcttcacagaaattgaccttggctcccaaactatataacaagtacctcccagggacagaaacaaggtgtgtatatgcctggtattcctcccagccttctcggcataatgccaagcaaacaaaattggagtgatctccaacatacctgataattactctttatacctgtagtataagaagtgttaactttttgacattaaatgaaggtgcccaaatagtgccatcagatcatgttaaaattttttcatggtgacccaaattaataatgacatcctttttcctcatggaaacccaaaccaaattattatttatgattactataatttttagccattattaggctctgttatggtactgtgtggttgattaaaaatggaagttgcccatggaggtctacatgtcattgttttggccagtgcaaaatgtagccaggagcacaccacacctgacagtatcagtgattattattattattattattatttttaatactgatgaagagtttagtgactcctgatttcaagctaagagctgattaggaaaggttccattgacaactcatccctagaaaattaaaacagaagcacatagatattgcaatttgacttcagagacttccctttctcctagaacaatgcacaccgcaaatgagggctatttccgatggcttataactaaagtaaaatactgtgatatcgtctaatcttagaatctcttaagtgagaatttgttcaagagggctaacctagaacccagtggaaaaatccagctgatggtcacctgggtccattccctatggtctgaggagcaaatgaggcccctctcctgagtttatttatttatttatttattttatttatttatttattattattatactttaagttttagggtacatgtgcacaacgtgcaggtttgttacatatgtatacatgtgccatgttggtgtgctgcacccattaactcgtcatttagcattaggtatatctcctaatgctatccctcccccctccccctaccacacaacagtccccagtgtgtgatgttccccttcctgtgtccatgtgttctcattgttcaattcccacctatgagtgagaacatgcggtgtttggtattttgtccttgtgatagtttgctgagaatgatggtttccagcttcatccatgtccctacaaagaacatgaactcatcattttttatggctgcatagtattccatggtgtatatatgccacattttctatgccttttgaatacttgcattattttctgccttgcttcttacctttgacctttgtaaatgggagattatttgttgctcttgttttaaggataatttagaaatgacaactttagcatatatctaataattacttgccccagcatttcatcattacaactcaaattaacataatgtctgtttggattttaacaaagaagaaaagctaagaaaaaccttcacttggaaacccttcaaaagtttctcatttggctacagttactcaggctttctgcaaaacgaagcaatgttatccttacattacaccaacagttgtttgagtcttttatcagactgactttctgctcatgccaaaaggcgtcattttctttgtgtaaaagtgactttgaagattaataagtaacagaatgggtacacatggatttatgaacatttaaaattgcttaatgtttttgcatgtgtatactttgaaaaaaaataggagatgccccagttgttctacatagattgccttaggagaaggacataaatgtgcgtcattgattcagacttaagtgaattgttggtgatccacaatgatctcccattgacaagaggtgggtttttggtctcccaaggaactacaacaagcttttagtactttatatcagaaaaaagtacttagcctgtgaagctcatggctttggtgcccgctaatctctctttaaacacgaaagatacatcgcaggcccagagctgttgcatcagcaggcaggcagcaagctgagagctgattaggaagcgtcagcccctagaggcagaggtctgccccctgactctatgagcaagagtcaacatcaagcccttcaatccttgggcctgcagttttccctgtacaggaaacacaagcgtgtgtggatgtgtgtgcatttctttagaaacacataatttgtttgttgctttattttctacctttgaaagatggcaagatcccagtcacaaaaacagaaaccaggctaggtattttaaccagagagggatttaataaaagcgttaggatttgagctgttttggaagagctgaagaagaaggagaggacaggggtcaggaaggacagttcctgcagtgtcctgccctgctgggtggccattacaaagctggcagctgtggggcagtatccctttgcccccatgtggccaggcacacggggcactggctgactcccacagccaccactgtcaggattggagctggagctgctgccacagccagaagcagaatgtccactacctccctcctaccttctgattttgcactagctccctactggtacaacctacacagaaccctgccagtaaaggaatctgagaaatgtagtcccctgaggtacagaaaacacagaagggcaggcagtatctggcccagatgcctatcataaagctttagaaaatgttgtgttatcgctgcactttaaccattgaagtatttattttaaattgattcttatttaaatatcaaatataagagaaatcctatttgactatgccttttatgggacagtcaagaagataatcagtattatattaaagaatattttatgggtttaaagaatattttgggggcattttaattcacatagttcaaaagcagctgaatacatgtattaaaaggcaagctcttgataggccttgctatgtcatctacgaaaagcactcctgtttgcctctgctagctaactcagctatttgaagtacagatggatgaagcaaattctactgtttgggtttttatatttgacactggttgatacttttccaaagcaaatgttgcatttccgctggtagtttgatttcgctgtttgctttctgaaattctatgtacttttattttagtacatagaataactatgcctgcttaattccaatgagaaattatttcagataaataatcatcaacttgtttacttaaaataaaatttttgtacctcgaaaaaccaaaattgataataaaaatcctttaaaatgaccatgattacaactattatgcatatctgtaaatctctttacttcttacatcttgactgatcatctcagcaactctgtgagaagccaactactactgcctccaaattttttccaactatgttaggtgacaggtcattagctgtaaaaccaaggcaagaagttggactttataagtaaatacgatagtttacttatgaatatgtatttatgagactcctcaaaattcatattccaaccacattaattttctcttcatgctagagtctaatgcagtggttagactgcagcatgaaactggggtaagcataccacttggagatttgcaaagatgatcacaggaattgtcggcctggataattttaagggagccagttttcagatcctcaacctacattcgtactctttcccaaaacaaattcgtctaagaatatgtcccttttaaggatgcaggttcctacccaaaattgtacttttcccactttgcaaaattaatcatgcctctctctcatctttctctgaggcattgacttgaagttttaaaatcttcagggcaacaaacaatgggacaatttgacatattgttccagtattaagaaagtaactttcttaatgtaagactaattataagtaaatgtaaatgactgatgacttaattaaacaactttttgtaagtctgatggtttccatttttttccttagagcagaactgtaggagaacttacatgacatgctggctaataaaaaagtaaaaataatttggtgatagatcactgtgaatcttggcatacagctgagaaggaggttaaagaattgagtaacatttctgtagcaaaactcccttcattcccactgatttatttatatggaaaaatcttcttggcccataaatttataaaaatgaaaaacagaaatagaattaattttgagccctaactcattctagtaataaataatatatccactgatttcatgacctaactagaaaaacttagactcgcttttggccatggagacatacatttccaacaaaattttacttctgcataataattatttcttaaaatttattacatcttatttttttatcaattatgatctaaagataattgtaattataacccaagcagaaaaaatccaatatttagagacttattgccacaggaaaattttaaaaattaaatgtcaatttatatatgtaacttattgtacatagaagtatggtgacaaaacctataaaatattttctacacgaaatacattacattagaataaaagtctgtggaaatgaaaataagagctcaaagagaaaaaaattgatgtcaaatttcagactattaaagaacagtctgtttatagcaattggacacctgatagcatataatattcatactctattgcagccatcccttcctttttggcactagggaccagttttgtggaagacaattattccatggatggagggagtgggggctgttcggggagatggtttcaggtgaaactattctacctgagatcatcaggcattagttagattctcataagaagtgcgcaaccgagatttcatgcgccgcccacaatagggttcacgctcctatgagaatctaatgccgctgctgagctgacaggaggcagagctcaggcagtaatgctcgtggcccactactgctcacctccttctgtgcggtctggttcctaacaggccacaaactggtactggtccatgactcggtggttggggactcttgctctattcaatacgcttaaaagaatgatgttggccaggcgcggtggctcactcctataatcccagcactttgggagtttgaggtgggcagattacgaggtcaagagatcgagaccattctggccaacatggtgaaaccccatctctactaaaaatacaaaaattagatgggcgtggtggcgcacacctgtagtcccagctactcaggaggctgaggcaggagaatcgcttgaacccgagaggcagaggttgcagtaagcagagattgctccactacacttcagtctggtgacagagcgagactccatctcaaaaaaaaaaaaaaaaagaacgatgttataacaacatagtatactgaaaattacatcctttgcagttatttaaacaaaggatatttatgtgttaatgtaaacatacgtatgtgatacattttcaaaatttatttaaagagtatatgagcaaaaatctttacagatcattgatctatacaaaagataaggtgttttgaagatctgcattctggcatgtctccatgtgtgttttctttgttttctcagtttgaccttgtctgtgtcaatgcgtggatgctggacctcacccaagccatcctgaacctcggcttcctgactggagcattcaccttaggctatgcagcagacaggtaggtaccaatgtgacagccattttatgtcactataataccatgcattaatacggggagaaaaatgttttatgttaactattaaaacaatatttttgctaaattcgcaaacaattcttgattccatcattcatgacatccacacttggttggtttgactaattcttttcttttcaaacttcatctccttattccttgaacttcacaaaggtctgaggctgttcccggtaggactgagagcatcagaatgaaaacacagacctccaaagcaggaacatcatgactgggttgatgcactgttatgctgaatactacagaatcaatcaattcgatgtgcttcagtaacaacttactgattgtggttttattaatttagtcataagattagcctattccaaatttgtttcacctaatttttttttaaacgaaatccttgtattttattctacaaatgtaaaactctgtgaaaaaaatatttttccaaaaaccactaaaggagtttttttctattattttgtattcataaatgcaactgcccagtggcaggcatggtgagtgtgtatattcaagacatcatgctttctatttaaatattcttcttccttaagattattgatgctagctattgtattcatgtttaactctatttttaattccaattctaactatgaaaatacttgcagtaatttaatattcctctctatcccccttagcaggagtaataggaatatagactggaaattgctgactcatggctgtatctggcctaatattgttctggttaatccatctctgactcatggccatatctggcctaatattgttctggttaatcgagcccagcccatggtgggttcttgtgactgtaccattcagtgggtgatactaagtttacctttagagaactgcaaacagcaattaattagctaatagaacaacaaaaggccccatatcctgtagccaattgaagatctgagtttaatcagaccagtgcttcaaaatgggtagagccttgggtttcattttctgtcactttttctttctctttcatgtttctctctcgccctctccacagctgtcctttgcatgtgagtttctgctggatcctttcatgtgtgatgccctttcccctttttcttctttttatcgatgtccttttctcctgttctacttctagccctttcaagcttcatctttcctttcctaatttcccccacatgccactctttttttgctggctacaatttggaactgtgcagtttaaatatttatttattttgttttgtttttactctttctaatttggatattaggttttgcttcatctgtgttttttttctcttactcagtcaataaccatatctccaaactaaattaacgttactaaagtggggaatttccccttcctatattctcataagtgattgagcatctgtcctcatataggacttgctgccttggaggggaggggccagacctgggaaaaagaggagccatgaataactctgcttcctacatttggcttcttctcttcctccatatccatgatttatatatgtgaaggaagaacaagaaataacttaataggccatttgtcaatgagagtacagtgtaggaagggtggaaagtgaatataaaatctagattggggcttctggtttcctgttcagcctataaggagcttagaatttgccactcagtcttgacaacaagtaaaatgctgaacaaactgaaaaatcaataattcttctcagatccataagagaagtgagattacagggcaaactactaccttcagcatcaccccgcacccccaaccccactaaatagaaagacaggagaatacagagaatcataacacaggcgcagaaacctccttgagagagccagggtagataaacatgaactgtaattgatgaattcctggaggatcactgtggatgacctgaaggattaaaaactctagagggactcactcaaaggagggcccaagcttttgtgattttttttttttttttttttttttttgccacctgaagctctacaaggttccaaaggtgaatattaaggaaaatccctcatgctctggcagccagaggggaaaaggaacaattttgaaatatgccagaatatcgttcttaacaatgtctgccctcaggagaagatgtttaaccagagcctaatcttctggggttttctgagagcctcattgatctgggggaagggaaataccaactccagccccttctagccttccaagtggagaaagagaaacaccaaattctagcctcctctagctttcaacttggaagaagggaaatacccagctccagccccctctagcctttctcccctagttcagaggagagggatagagaagcatttgtgaagttcaccgtttagagacataggttcactaaaagactgagagctactcatagaaccacagaatgccttccctcccccaacacctcaccaccacattactaaaggtctatttatagcagttccgtttacccagtacaccatgtccacctatcaagaaaaaattacaagacatactaaaagccaaaacacacacacacacacacacacacagttgaagagacagagtaagcatcagaactaaattcagatatggcagggatgttggaatgatcaggctaagaatgtaaaacaactatgccaagaagtctgatgcataaagtagcatgcaagaacagttgggctatgtaagtagagagatggaaattctaaaaaaagaaaccaaatgaaatgctagagatcaaaaacactgtaacagaaatgaaaaacgttgttactgggcttattaggagattgggcatagctgaggaaagaatctctggccttgaggatatcccagtagaaacctccaaaactgaaaaaaaaaaaaaaaaaaaaaacccacacacacaataacaaccacctgaaaaagcagaacagaatgttcaataactgtgggacaattacaaaagatataatatatgtgtaataggaataccaaaaggagaataaagagagcgagaaatagaaaaaatattttaaacaataatgactgagaatttttcaaaattaatggcagacaccacagatccaggaaactcaaaggaaatcaagcaagataaacataaaaaagtatacctagttatatcgtagtcaaactacagaaagccaaagataaaggaaaaattctgaaagaagagtggggggataatgtcttactatagtaaaagagcaatgataaaaattacaccctacttcttttcagaaaccaggtaagcaagaagaaagtggaatacttaaagtgtcaagaaaaaaaatccaatctagaattctatactgtgcaaagttatcatttaaaagtgaaggagaaataaagactttgttagacaaaaattgagggaatttgatgccttgtaataaatgttaaaagaaattatttagagagaatgaaaatgatctaggttagaaatccagatctacataaaggaaaggcattggagaggaataagcaattgagaatatgtttcttattctcaattgatctaacagataatagtttattcaaaataatagcaacaatgtgtttggttgtgtatgtttatatatataagcatacataagcatatatagagtattttttgttataaggtactcatactactcatgaagtgatacagtgttatttgaaagtggatttgaattagttataaatgtatattgtaaactctaaagcaactactaaaaaaagattttttttaaaaaagcatgactgatatgctaaaatgaagaaaatgtggaatcctataaactgctgttcaatgaaaccacaaaagccaggaaaaagtgtggaatacaaacataagaataaaaaataagggaaacaaatagaagatgataacaaatacggtagacattaatccaaccatgccaatactcactttaaatgtaagatggtctaaatgagccaactaaaagacagagattttcacagtggatcaacaaacaagacccaaccatatatgttgtctacaagaaatccactttcaatatacagacacatatacactaatagtaaatggatggagaaaactataccatgatagcagtaatcaaagtaaagcagaagtagctatactattatcagcagagcagacttcagaggaaggaaagttatcagggataaaaacgggcattatataatgacaaaggggtcaattctccaagaagccaataatccttaatatctatgtgtttagtagcagagcacaaaattataagaggcaaaaactgtgataaaactggaatgagaaatagattaatccacgatttcactggagacttcaacatccctttgttggaaatggtcagattcaacaggtaaaaaacctataaagatataattgaactcaacagcatcatcaatcaactgtatctaattttcctctttagacaaccttatctaacaacagcagacttaacatttttttcaagttctaatgaaatattcacatgcaatattcaagataaatcacattctgggccataaaacatatattagcaaatttgaagaaataaaaattatacaatctctgctcccagaacatagtggaattaaactagaaattcataacagaaggatagatggaaaatccccaaatacttggggatgaaacaacacatctatagtaacacataggtcaaagaagaaatctcaagagtaattaaaaagtatagtaaacaaaatgaaaatgaaaacactcaagacttttggaatgcaacagaaacaatgtttaaagggaaatttatagcattgaatacatatattagaaaagaggaaatatataaaatcaataatctaagctttcaccttaggaaactggagaagagcatattaaacccaaggcaagtagaagaaaaaaaaatacaaattggagcagaaatcgataaaattagaaacaggaaatcaagggagaaaataaaaccaaaagctggttatttgaaacgatcaaaaaaaatcaataagcctccagtcagactaagaaaaaagaaagaggagagagagagaggttgaagacataaattactaatattagaaataaaagaggggacattttgacggatcccatggacattaacaggataataaagaaatactatgaacactctgtgttcacaaatttgataacctacatgaaatggaccaattccttgaaagattacaatctgccaaaactcacccaagattatatagacaatctgaatagggctatatctattaaataaattgaatcaatagttaattacttttcaaaacaggaagcaccaggcccagatgggttcacaggtgaatttgccaaacgtttagagaagaaactctaccaattccctaaaagctctttccaaagatagaagtagagggattgctttctaacttattctgagaccagcattactttaatacctaaattggacagacattacaacaaaagaaaactacagactaatatatttcatgaacataagtgcaaaaatcctcaacaaaaatttgcaagtagaatccaatagtgtataaaaaaaattatacaccacaaccaaatactgtagcataccaagtgcgtagtatcccaagtatgtaaaactggttcagcattctaaagtcaattaatgtcatccatcaatcacatcgacaaactaaggaagaaaaaatgacatgatcatatcaatagatacagacaaagtatttgtcaaaatccaacatctatatatgacaaaagctctcagtaaactagaaatataggggaacttcctcaacttgataaggaatgtctattaaaaaaactacagttaacatcatacttaatgacgataaactgtacagaagctttctcactaagatcagaaacaagccaaatatgtcatctctaataacttcttttcaatgccatgctagaagccctcgctaatacaataaataagacaagtaaagaaaataacaggtatactgattggaaaggaagaaataaaaactgtctttgttcacagatgtcatgattgtctatgtagaaaatcaaaagaattaacaacaacaacaaccaaaaaaaaaaactcctgaaactaataagtgagtatagtgaagttgcagggtacaaggctaatacacaaaagtcaactgctttcctatgtaccaacaatgaacaagtaggatttgaatttaaacacataatgccatttacattagcaccacaagaatacacaacacttagatataaatctaacaacatatgtacaagatttatgtgaggaaaagtgcaaaactctaatgaaagaaattagagatgatctaaataaatggagagatattcaacattcatggataggaagactcaatattgtcaagatgtcagttcttcccaacttgatgtatatattcaatacaatactaatcaaaatcctacagagttattttgtggatattgacaaactagttctaaagtttatatgtagagacaaaagacccagaatagccaacgcagtactgaaggagaagaacaaagccagaggactggcactacttaacgtcaagacttaccgtaaagcgacagtaatcacgacagtgtggtatttgtgaaagaatagacctctaccaatagttcagtggaataaaatagagggcctagaaatagacccacataaatatagtcaactgacctttgacaaagcagaaaacaaaaggtactggaacaactggacaaccacatgcaaaaaaaaaaaaaaaatgaatctagacacagaccttacaccctttaaaaaaaatggatcacagacctaaatgtaaaatacaaaactgtaaaactcctagaggatgggataggaaaaaaatctagatgaccttttagatacaacaccaaaagcataatccatgaaaaaaagaactgataagctggacttcattaaaattgaaattttcttgttgtgagagagacattatcaagagaacaaatgaaatgacaagacacagactgggagaaaatattaacaaaaggcaaatatttgataaagaactgttatccaaaatatataaagaactcttaaaacacaacaataagaaaataaacaacccaactaaaaagcgggccaaagatcttaacagatagctcaccaaagagagtatacagatgataataagcatatgaaatgatgctctacgtcatatatcatcagggaaatgcccattaaaacagcagtgagataccactacatatctattagaatggccaaaatccagaacaatgccaacaccaaatgctgactaggatgtggaacaacaggaattctcattcattgctggtgagaatgcaaaatgaaaggtgactttagatgacaaaattcttacacatttttgtaattcttacaaaattaaacatacttttactaaatgatccagcaattgtactccttggtattccaattccaacccaaaaaagttgaaaactcatgttcacccaaaaacctacacatacatgtttatagcagctttcttcataattgccaaaacttggaagcaaccaagatgcccttccataggtgaatggacaaactgtgatacatccagactatggaatattattccatgctgaaaagaaatgagctatcaagctatgaaaatacatagaggaaacgtaagtacttattactaaatgaagaaactgatctggaaaggctacatactataagattttaactatatgacattttggaaaaagcaaaactatggagacagtaaaaaaaaggatcagtggttgctagagggtggggagagggagggatgaacaggcagagcacagaggatttttagagcagagaaactattctgttagatactttaatggtggatacgtgtcattatacacatgtcaaaacacatagaatttgcaacatcaagagtgaacccaaatgtaaactgtggacattgggtgattatgatgtgtccctgtaggttcgtcaattgcagcaagtgtaccactcccatggggaatgttaacaaggagtatgctgtgcatgtgtaggggcaggggacagagtccactaaaaaaaattttagataaactaaggctacttccatctctactctgctgactcaagcaagatgctatatgtacatattttatggaaatttttatgaaaagatgtaatagaatcaaatctcttaatggacattgatagcaaacatttaccagacaataatttgacaccactatgctgaaccaattcacaccagtctctcagaatgttgtgcatgttaccttgttccttttcctaaactatttaataacacatatgccaatggtgaaaataaaatacaaaatttaagaacaactgacattggctgtgaactttgtagtttataaaacactttcacattaacatctcatttgatcctctctacaacctccctctagaaaaaggtgggaataaacaaaaacaagcaagcaaaaccttcgttttgaagaccttaggaattagcccaaggtcttatgactggtagatggttgaggtgagattcaaggcaaggccttctggccataacacaccattccttcttctttctgcctctctgtccttatgacttgacacataaaaaatgctagaaagtgtcacatctgtaccaccggggagactctgtgtgaaacaatagtttcaaggagggtcatcttttcagaaactgcaatcacaaaggatgcattctgtactttaaattttgtaattccagcctaggcaacatagggacaccctgtctctacaaaacatctttaaaataaaatgatataatgtaatacagtataatatggtatgatataatattttatgttatattttcccattgtgttgaagaaaatgtttaaggtgagctcttttcctgtctttctcaaaaaggtatggcaggatcgtcatttacttgctatcctgccttggtgttggcgtcactggggttgtggtggcctttgcaccaaacttccctgtgtttgtgatcttccgcttcctgcaaggtgtatttggaaaggggacgtggatgacttgctacgtgattggtaagacattcttacaccatcttctctatttggaaactagggccagatagccaacaaatgctagttaatcaaccttcctcttcctcatgtgtcctttaacaaaggaggtttcactgcagctacagtaattatttctgcagatgggagagctcagaggtaggattctgagtgctttagaaactaaaataccaccttactttgggagccaaatatagaatattataaagcactggggcaaactacttttatgtacttctacactgttataatatggtttctagctttgctttataagaaattaatttttataaaatctcagtagcttcttgaggcatttttgaggcatttttaaagcattttctctgcactgtgttatgtgatacagtttgagattactttcctgtgttgccaactctcctctttctgtacaagtgggaaactttttactatgggagaaataggttctaaaaatgagaagttcatttgtgacccttggataccttctatagccagaaagtttgaccttctggtgatggaagaaagaaaaagttcactttacttttttctcatgtcccttgggaaagccctggctactccttttggttccatttctagcttgggaccagccacttactttaagagtagtggtggatttctgaccaggaaaatgtgaattctcatcttagattattgctgcagatctttgcacttccactctcctctgtcactgctatacaatctccaagcagtgcgcattttggagacccctgaagacctttctgtgagtgggagaaggagagaagatgattagagggattggttgtcactgtctggaacagaaggagtaacattggaaggcaaggcatttttaaggagactcagcctaggtgaatcttcaaagttgtgatctgagggcaacaataaagtagcctatcccaggataatcagaatatgagaaaccaattagtgggaaggggcaggaaaggaaaagatttcagcaataaaatttcccatgtgatttttagagcatatcctgtcaatgaaaagtataacactgtggagagaattatcatttaatagaagttgtcttgtgataacgaaaagtctttgtagagtcttatatttataatgaatcttctaaggagactagaatgtgcatatctctagagatacagtgataaaatgtagccatcttaacatatttatgttttgataattacaattaccttttaaaataatcatcactgaagctttcctaaaaccaacacagatattcttcgtatttccctattgtacccagaagagtgctggtctgggtgcataagaggaacatggcaagtgcctgtgataaatggcagaggtgagagtgggagaaaagcatttagtatcaagaaggacacctccatcctttctgcaagtgtggaagcctccgtatctgagtgctagcgtgttctagcaatgctgatggatgtaacaggtgtaacatctctgtatttgtttgtttattttggagctgaccttgtgcttctgtgacctcttgtgtttgttttcctttagtgacagaaatagtaggttcgaaacaaaggaggattgtgggaatcgtgattcaaatgttctttacccttggaatcataattctccctggaattgcctacttcatccccaactggcaaggaatccagttagccatcacgctgcccagctttctcttcctcctttattactggtaatgtggttttggttatcatcatatttatactgattctgcagaaattagactccaaacagacatgaaaatgaaagcaataaagaaaattttcttttttttttttttttttattatactctaagttttagggtacatgtgcacattgtgcaggttagttacatatgtatacatgtgccacgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgttttcaaacatctctaaaatggctacatgctttgagaatttttagagaattttaggatttaaagagagtatttgttgatgattttattaataattgtgaagaaaaatgaattaataaaataccagaacgcaaaattttaagtagggtactgcattatgttttgttttgtaataaatagcttcatgaaaactataaagtaaccaaccatatctgccagtatttcaacatgcaaattaaatgcaatgaagtctatttgtttctctgtgtgttctataaagcaaatgaatattactcagaaattctctgaggaataaggaaatgttaagagcatcaaaaaattacattatcaaaaagcaacagaaaagcatttgatttttgttgttgctgttttgagatggagtctcactctgttgcccaggctggagtgcagtggtgcgatctcggctcactgcaacctctgcctctcagattcaagtgcttctcctgcctcatcctccccagtagctgggattacaggcatgcaccaccacacccagctaatttttgtatttttaatagagacagagtcttaccatgttggccaagctggttgcaaactcctgacctaaaatgatccacccacctcggcctcccaaaaggctgggattacaggcctgagccaccacacccagccagcatttgatttttattggaatgaacatgttttaatgattcttctaatttaattttaatatatgggcaagtcagtttacataaatcagattcctaagcttttcttaatatttactaaatcccaattcttttcatatatggaatcaatatattgtaagatagcctggttttgcaagagcaatgtcatgttgattattttgatgagcaatgatccaattatcaagctagcatttttccccatccattataaccttgcaggaataatctgtatttcagggacctattatcaactcttattgactcctaaatgtatatctaattgcaagatccattttgatagaaaaactcaaggcaatagattttagcgtttgaaattcctagacataactcacaacagcctccttctttgccagggtggtccctgagtctccccgttggctgattactcggaagaaaggagataaagcattacagatcctgagacgcattgctaagtgcaatgggaaatacctctcatcaaattactcagaggtaatttctttcagtatgagtaacaaatattgctaaagctggtgaattgattttgttgcttcttgtgtacttaatgttgcttcttaaatttatatacaaaatatgcatattatatatatatatgtatgtatgtatatatgtatacacacacacacacactaccaaacatctgggaaatcattttcagtttgacttaactgaaaaaaatctagggaaaaatcataggacatattaaagaagaaatgattatgaagctctattagcattatagccaaggttaattgatcatttcagtacatattttaataattgcaccaagttacttgaattattatactttacttactgtaagccccataatattgaatcattcatcttgattgtacaaactgtaaaactttttttgacttttaatttaaatctttaagtttggccctgaaaaaaaatctgtttattcataccagagcttgagcagtaatgtaatatttcagcctctaaactcctatatgctggtctttctccctttcttcttttcttcctccattccttccttcttccaagaaaggctttttggatgcctctgcatcagtgtaccaagaaataggggagggccgggtgtaatggctcactcctataatcccagtgctttgggaggctgaggtgggaggattgcttgagcctagaattctagaccagcctgggcaacatagcaagaccccatctctacaaatagaaagttttaaaaactatgtgggcatggtggcacgcacctgttgtctcagctactcaggaggctgaagcaggaggatcatttgagcccaggactttgagactgcagtgagccatgatcacaccactgccctccagcctaggagacagatcaagatgctgtctctaaaaaagattttaaaaaaatgaaatgggacaaaaattaaaagcttttgccctttggaatatttgatatgcacttgaggatataacatatatttaaagcaacccataaataattagagaatagcatataaagaaaaatatgatgatgttttagctccaaagactaagtgactacagaataacagaaaggttgttataaaaggaatgttagagaagaatttttggatgatatgaatcttgatttaagactaggttgtcaacattgttttcttcatagcattcagtttgatttcacaggaaccttctgataagaacgttctgataagaactgggttttggggctgggtgcggtggctcacacctgtaatcccagcactttgggaggccaaggcaggtggatcacctgaggtcaggagttcaagaccagcctggccaacatggtgaaaccccatctctactaaaaaatagaaaaattagcgaggagtggagacgagcacctgtaattccagctacttgggaggctgaggcaggagaatcacttgaacccaggaggcagaggttgcaatgagacaagattgccccactgcactccagcctgagcaaaaagagtgaaactctgtctaaaaaagaactgggttttgttggttctattgtcccctccccagcccttgaagcttggtcatgtatatttggatttctgccttcttcctctctcttatattaagtggcaagcagtaggctcttttccaaaggtttcaactgaacagatgtcactggtgcaatggtgcaagtacattaatgatgtaccttgaggtttacagatcataaaatgtgtggtaaagataaagcatgatctttttaaaccactatgattagtccatccttgtcactctttgagtgaacacatttgagctgtgtgttccttttagggaaaaataatatacccctgtttcccagcttgcactcatccattgtctatagtcctcatagccaggtcaaagatctgatcatttgtattcaattttaatcatccagtgaataatctctgctcttttgcacacatagtccagaggtaagtccaaggttttgatcttgatttaaaggtctaaatatagaaatatatttaggaatatagaatatagaagaaacaaatatagaagggaatatagaaaaataggatcatagaaaataaataggaataaagaaaggaatatataaaaataggaatatataaagtgttctagaaaaataggcatctagaaaggaatatagaaaaataagaatatagaaaggaatatagaaaaataagaatatagaaaggaatctagaaaggaatatagaaaaaacagctgtgtgctggtagcttgtgaaatataatgttggattaaccaggcatgtcatgtgtgatgatagtgagtatcactgagagatgagtctgattccccgaagcagctgctgttacacatcccatgagtgtacagtttagcactgctcccacagacccactgacccagctttattcatgagcaccgtagagatcatgacaacaggtaagtagttcaatgttccacatggctgtgcttatgagagatcatgaactatgggatccagtggcttccaagtcattttaattttaatatggaaatttccaaacatactcaaaaatacaaaaatagttgaatgaatctctatgcatatccctcagctccaacagttaccaactcctgatcaatcttagtttttctatactctgcctagtttccctatccactgagtaggaatcaatccagccatcatagcatttcatcttgtaatattttcctctaaagtaggaacacataggtatctctggaactatgtgtgcactatcttcaggacactgctgaaggaggagcaagaactattcctgtggttcttaaaattcaatacaagtaatcacacctttgatccacctgtggggactgatccctcttgtgggagcaaagatggggccatggtatataaaatataaatataaaactaatatcaatgtcattgtcctaagaaaaataaccatgattccttaatatcaagtcagtgttccacttccctgattgtcctacaatgtttcaccctgtctatgtgcattagactcctcctgaagttatggattatgaattgttgatctctttgggtttatttaattcataggttcctgccctttttcatttcattccaactttgggaataaaaaaattcctggggtttttctcctgaagaatttccacagtctaaattttgttgattatatctgtaggatcctttaacacgtttctctgtcttttatattccctgtcaattggtagttagatctagagcttaatcaagttcaagtttaatatttctggcaagactacttcataagtggcttagtacatttccattgagagatacctggtagctgcttgtctcttcttttggaacattacttgccactgataatcactgcctggatttactaactcatcagaggttgccaaatgacaatattctcatcttatcattacttcttcatttattgctgcagtgcttaaataaagaccaatttctcccatcaactcttggtgacactgagatatagctcatatagggaagacaagacatatgcatcattttttcttttccaaataataaattggctccctacatcctcccaaagtgattaatgagttgagtgtgtttatttaaacatagtttatatgtttcaatcctttgcaattgcattagtctgttctcacactgctataaagaactgcccaagactgggtaatttataaaggaaagaggtttaattgactcacagttctgcagggctggggaggcctcaggaaacttacaatcatggcagaaagggaagcaaacacgtgtttcctcacatggcagcaggcaggagaagtgccgagcaaaggggaaagccccttataaaaccatcagatctcatgagaattcactcactatcatgagaacaacatgagggtaaccatccccatgattcaattacctctcactgggttcctcctatgacacatggggattatgggaattacaattcaagatgagatttgggtggggacacagccaaaccatgttaacagttattttggtgagtactctttcggatgctcaaattgctccatctttgggcacacgcagcttatccagagtctgccaccctctagtagcttctgaatacctccttgctctttagcacgatgagattttccagtctcatcttgtaagttccagtctcacacatggaatcacctatttctccaagggagctttggtttttgaaacatatgtcttcaaaccgaacctacccatctttaatctttttaattgtacagcgtaagcagaaaagcaaagtgttatcttcaagagaaggatttaacatttaagtttaaaacaccttgctaaaagcggaattcagccacattatgggccacgtcatagttttccatctcaaaggtccttatgtccccacaagcaccatcctgagcagaaaacctcttcgtgatgacgcagaaggactggccagcagggtaggcactgtacttgaactccaaccccaaaaatcacagcaggattccattataggttttgtgcaatgacaggtatgaccagtataaattactcatattttgtgattcaaatacatactgtccgtgtctatgttaggatagccttgaaactgtatgtttacacagttactttcacattaacccacatccctctctctggatacagtttccaggatgttcagacccacgactgaagttcccagcaatctctttttacttttcacagaatctctcttcagtaacttctgacttttagaagacgttatcactgtgtaaatgacctcatccttcacgacctctctaattcccacctcattctcagggtgcccattatagggtgcggagaaggttagaatggatttgaaagaatgtggttggattcaaagaagccctaggagacccaacaagtcagcatttttctcttgtgaaaagaaccacctgccaaccccagcctgttccattgctgacatcagaggatcaggtatatttaggagaagctaaggacctagcttaaatctacccaaggatgttccatattacagataagctaaattaactacaaactaagattacaccaatctccagagctttagtgagagaagggaaaatatgagaggaaaatagtatgacagatttgatccaacattgaaacaggtgcattttgagggttgtttatcctgtaaatcatctcagttacagttcacatggatgttactcatttcatgggtaggcaaactctgtctctgcctcacttgttcctaggcttccatttgccaaggtttctggctggcctctggctttgttgaagagatagctagcactagcagggagaaatacaggtgatcagagtccaggctctctgaacatacaaacagtataactgttgttcactaaatggaaaaatcccaaaatcaaaaaccaatgcaaaacagtgaagtggcttgagctcctaggaggttaggtagaaattaaagagaatcagtggatgggtagaattttaagcagtaggtagttacccaatgtagaacgaggattagcttagacacctagtctggtggttctcagcctttcagcatttgcatacgataacttttaaggcttacttaaaaaaaaaaaacaaattatgggtaagtctacaataatgatagcacaggcacagctacagcatgacagcgtctcacaatgtcttcaggagcatccacaatcatccactgaccccagagagcatgtcaaggatgagaactgctttctgccctggccacaccctctgttttgctcataatgcaaagttcttttacagtgcagtaaatgtgaaatttttctttggtattagttagacattattcctgcttgttacttgtagtgccctgtttcttgccttacacctggtcactaaccactcaattcaacttttcactctcatatgatagacaagtaatagtactgtgtgcaagtgtgaataatggatggagtaacaatgcttatctgaggatatggccattgccccaggtactgaatttgtgtgcttgtcaaaataaaaaagaatgggcaagtacttcagagtgtccacacttctggtggtagtagacttggtctattggtgagtaatggagagctgggattgtttctaagtaagcatgaactgctaatatctgtgataaattgtattaatcctctcagctattcacttcctctctgtaagaggattttacatcccattcccacccattgccagatgattgacagcagtatctctctgtaggcaatatacttccccacccagtgtcaggcttggccacctgacttgattgcgcccaaggagcagaagtggcagaatatcaattcagggcagaagctttgagaggcatcatgaattcctgacagccctcttgctccttctgtctgccacaagaacagcagatcccaaatcagtgctgttccttcagggtgggtctcagaaggagagctacagcctggagcagagctgcagcagctgacctacagctgctgtatgggacatggccaagaaaaagctgtttccccagtaaactactgctcaatgtgtctgcatgtactacagagatttgggggtatctgttcttgcagccaaatctagctaatgcaattggtcatattactagttcaactgccagagtagggttcaacacattctttggtgatgcaggggtatctgattgtggtagattaaattactgtttggagagattcacattttccctcatttccaagggatggaaatacttcctgggtctataaatgttgggcatggcaatgatattgctttggcctcatgataggtgcagtggacttcctgccctttgatgttggggttgaccatgagacctgctttggccaatggcaggttgctagatgtgatgcaatagaagcttgaaatgtgcttgtgtggttgggctttatctctgcacctcagccatcaccatgaagagaaaattcccaggcttacctatgggccccaaaggaggctgagagacattcagaatggagttgacctagcaaagcttcctcaaacctacactagcaggccccagccagcccacaaacacatgagataaatgaatgcttactattctatgctgctaagatcgatggctcttatgcagcattatttatcaatagctctgatggtaaagtgtcaacttgattggattgaaggatgcctagatagctgggaaagtattgtttctgggcgtgtctaggagggtgttgccagaggagattcacatttgagtcagtggactgggagaggaagcctcccctcaatgtgggtgagcaccatccagttggctgccagtgtggcttgaacaaagcaggcagaaaaaggtgggataggatgtcttgctgagtcttctagctttcatcattctcctgggctggatgcttcctgcccctggacatcagactccaggttcttcttgcacttacatgagtggtttgccaggggctctcgggcctttggccacatactgaaggctgcactgttggtttccctacttttgaggcttttggactcagactgagccactcctggcttcctacctcctcagcttgcagacaacctatcgtgggacttcaccttgtggccgtgtgagccaattctcctaataaactccctttcatagatatgtagatcctatcagttttgtccctctagagaaccttgaccaatataatagctgactgtgtcaacactgagtgagcagccactgtcactgtactgacctggatgatgcagctacacaggtagtaactgtggcagcagttttggtttcctttttactcccaggatcttaaaggcctttatcctaaagatccctctcctctgcccccaactgcccattcctcccgtttttgtatgggatatactcatagagaatagtaggttacagttctagctaacaagaagtctctgatactacagaactgaatatgcccatatttgttagtgatattttatcctatactggcgcaataaacccataagctttgatcgtagtttccttattttttggatacacttatgtattgtttatagtgaatctactgcttttaaaattaaacattagatgttatatcaataatgttcacacataaacatgcttgaggcagttcccatggtggtatgtttatgtgacatcaggaacggaatttgagctttccaattccaaagggattcctttaggcccatcatcaatataaatgataccattgtttgaaatatttgcaaaatagaaaaaattaaaacctcattagaaagtgtcttactgattttttttattaccttagttgtcagggagacttctagaccttaatagctaccgtcttttctataatttaatgagcagtcacacaaacaccaatattgctacagaaagggactttccagctttgggaatatctgtttctgacatttcctttcaaagggggatttttataaacataatttttcttcttccaaaagaggaaccacactatgattccaacttccatggagcccatcggggatggtggtatttcagttcaattagggtgctgtctttgttaactgttgtgtttagttgtgatctcagacttcagatttgaaatctctcttcggggaattcatttcaaaagatccagataacatagtttaggcacatggagtatctgagggcagtccagtgttggaatgagaaagattgagtctcaaaaacaaagaaagtctcaaaaacagttattagaaagaaagtcactgggaacccatccagcactttctcctgacagggctgtcttcctcctctcactttacaggatgaatggtgccaattctaccagcaaagccttcatctttaaaatgactcataaaaatggtaactgtagtatgtgtaccatcacactcactttgacttagaatatgcttgaatgcataaaaatatgtcaggacactggacatactcaacacagaatggaactttgtagccaataattaatttaataatacttcctattttaaaaaatagcctgagttctagaaatggtgtgtatttaaatggatttgtttactttccatgtctttagctttttgaaaacaagactatatcgcataaaatgagaaaactgttcatgctacagtgaaatagccataaagactgtaccagtaaacagttccatccacagcatgtcaagacccccaacttcctttctcaagcatggtgcccagcactcatttccttccccaaatggaaactcagcctggcattgctcaggtcagtgggctgtcattcaacaccgaaagatattgaggggaggatgttctcctacacctttaattgaaatggaaattcaatttaaaggtgctttaaagaatgagattgcagccttggagcaggctaggcagacttgtgggatgcctcatcagacagcagcattttgcacaaggaactatggtgagccagggcctttccccctactcacccaaactcatcttccagatttcctctgggaaaataaatcattgggccatgcctttatcaaaatgttaactatctctgctgtacaagttagggcttgaaaactattcgtcagaactgggaaaggaaagcattccacattatggtcccataaacttcctgcattcagtacttgcaatcaattctggtgtctaaggacatattactaaagagtgagtgtatttacagaacctaggacaacagagggactcaggcagtgtccagcagggtggccaactgtccttgtttgcccagggccggggagttgggagtttcagagctaacaccaaaaaaatgtctcaggcaaactgggtagagctgttccctccatgactgggtcagtcctcatctccccagttatgctcagaggaagattccaaaggtctacacttgcaggcgtcacaagtcctccctgcccatcccatgggccctgatgcctagaagaagacacgggattcccgcctggctggaggatgggtctgggatctgcttgccagccgttcccgggattgggggcaggttgctgagcctgtctagttgcctgccaggcttcccctttctttccgcaccccttcctccgcagagcctcatgtctacctggttcttcatctggtcctgagtccttgcccattctactgtggctctggccctgcttcattcctgcctgattcatcctcagaaggcaggtttctgtcctgtccctacacatccatggccttaaagcaagatgctgacgctgtcttgatggctggacctgcccttcctagagacggctgctgccaacccatttcccagacaagtacccaggccacagacagcagggccagcccacggaaaacacaaagcccttttttccctagctagcctctccatgtggaggaacaagtcctattgcttggtggagagccaaagccctttcctttctcacttactcttctctcactgctactgggatcctggcaaaccacacaggcaggtccatgtggcttatgacacaggagttccgagctttgcgacatgacattggcaactgctcagttatccgtgattagttatgaatctaaatgcgtgggcttcccccttttccttctcaaaggctgagcttccccttgccctttaggagcaaaagtcttcccctttctactccagcactccttggtaggcagagaagcatttacttcttccctgcctaccctgagccccggcagtattacaaacaaaagtaaaaagtaaaacacaaggcaaaactcatcagccacacgggcttgttttattccattaatattggttgttctcttttctgggagttgtgtaggcatctaatttgattattttagttatgtgtccctctctaatagaaaagaggagtgagtttgcctgtcctttttccgtttcaagcgtctgctggggaagggccttctgataccctctctggaatccttccactctatcagtgtgagggaagaggctcagcttcttcatgtatgttgctcctttgccatttggtccattcttgtgttttcagcaaaaccagtttccacaatccaaattactgtgcttctcgactgtggataaatgagaaaatactcctctctgtgaacgcgctccttcgtggagacagtaatgagtacaacttccagagctctgcgcagccagcaaccctggcaggagtccctgtgttattcataacccagagctgtgttgccatggcagtactgcttgctagaccttggacccaccaggaaaattatctttcttcatgaaataatcctaagaagagagatgtggcttgaggagcagatgaaattcatttaaattccacagcactagattgaacattgatgtacacagatgtgcccctttgacatagatgaagctggaggaaattgtactaaaaagtaagtaagtgagaaaacacattgtcattcaatctcttgaggtcccatccaggaagatgataaaaaaggtatcaggtgctggattttcatggaatcaatcctgctttccctagaaagaattaaaattaagatccatctcataaatgggtggatgaacacctgggttgtgttggcatagcaacacttcttcatgtgggggctgatggtgggacccacccactcatacaaacagcgtgcggcccatgcaacacagagatggctagattacttggtctggaaaaaataagatggtcctgctctgttttcttttttctctgaatttggtgctatttgagagacggaaatagaatttcatatacagaaaggcaaacagattgagacaaagtctttgtaaggtgtctgaataaaggaggtgttaattggtgatgaagtccttttatcctttgcgggagaaggatttagatgatgttagggaaaacagccagaaccaagaatatttttctgctacaggaatcttttgtgtaacagcaaaactatgtcaccttctttttttttttaagttatactttaagttctagggtacatgtgcacaacgtgcaggtttgttacatatgtatacatgtgccatgttggtgtggtgcacccagtaactcgtcatttacattaggtgtatctcctaatgctttccctgcccccttcccccaccccgcaacaggccccggtgtgtgatgttccccttcctgtgtccaagtgttctcattgttcaattcccacctatgagtgagaacatgcggtgtttggttttttgttcttgcaatagtttgctgagaatgatggtttccagcttcatgcatgtccctacaaaggacatgaactcatccttttttatggctgcatagtattccatggtgtacatgtgccacattttcttaatccagtctatcattgttggacatttgggttggttccaagtctttgctattgtgaatagtgccacaataaacatatgtgtgcatgtgcctttatagcagcatgatttataatcctctgggtatatacccagtaatgggatggctgggtcaaatggtatttctagttctagatccttgaggaatcgccacactgtcttccacaatggttgaactagtttacagtcccacaaacagtgtgaaagtgtttctatttctccacatcctctccagcacctgttgtttcctgacttatttttaatgattgccattctaactggtgtgagatggtatctcattatggttttgattttctctgatggccagtgatgatgagcattttttcatgtgtctgttggctgcataaatgtcttcttttgagaagtgtctgttcatatccttcacccactttttgatggggttgttttttcttgcaaatttgagttctttgtagattctgcatattagcccattgtcagatgagtagattgcaaaaattttctcccattctctaggttgcctgttcactctgattgtagtttcttttgctgtgcagaagctccttagtttaattagatcccatttgtcaattttggcttttgttgccattgcttttggtgttttagacatgaagtccttgcccatgcctgtgtcctgaatggtattgcctaggttttcttccagggtttttatggtttcaggtctaacatttaagtctttaatccatctcgaattaatttttgtataaggtgtaaggaagggatccagtttcagctttctacatatgtcaccttctttagtgatgaacatggagggtaagcagacagggaatcctggatgttcttgttaacacattcttgtctcctagccgctgtaacctcagccctggagttgacaaaagaatctgtcccagtgggccacagatcctagggattatggagttattgcaaagatccacaaaccattagcaaccaagccttgtctgttgaatgaattaatacatcttggattaaaaaaaatgtactttcttcagataaaattaaatacagttagaattaataaccaataataaattgaaaggtgttattaaatcatagtaaatttgtgtcattatgtggtctcaaagaacagaagtgaagagcacaattcctgtcatgtgggcaatctttaaatttttttgacattaatcagacatcctcatactcaaaaaggatgagtcactgtaagcacaaataaggtgtctctacctgttgctgagagtcttgacatacataaacttcatgacaacaacttctaggatcccttcatttctttcattcaataaaatacacttgagttcattatatttttatcttccactgaccttagggacaaattctgcatgttaagtagggtggattgagtgctgtgactcccaactgcctactgtctctcaaaggtgaataggatgggttgagtaccacggttcccagttgcctgtctctgaaagatgaatcttggccttttctggcttacatttcagagccaacacatgacaaatagtttagatcttgaggaagactgaggaaggcttatggaatactcagcacaattatttttatggcacagagtgaaatagagattgaatacttacacacgttttgattagtatgtgtgttccaccaggcttacacacttctctttgagatctgatctagacacatttttctaaagacatttcaggtattccctctgcagttcataacagtttatgcactgcattgatacaggctgctctcaagttagcaggggacaggtttttgatgtcaactaagtgaaatatagtatcaacttcatgtagggttgcttgctgccatcccctttctttccacaattctgtaaacaacttggtacattttgttgtctagaaatagccaacctctaaatttaaacaggttgagtattaaattattgcagtgaacattttttcacattaaaaactgaatcacagaattcttatttgatcaccacatgtttagaaaaactattttaatgtcactgacatgaagttgtcccagaaacgaaagggtatgggtatacacaatgtagcagtcatttatcttcatttgttcctccatttattcagcagatagttactgggtgctgtattcaaggcatctatttttaaaataacctctgtgaaatgttcatttcaaaaatgtctccccagatgcattcaagatgccttctattttctctaatcctctataattgcttttctttttccttttttctttttgagctgttttccttctctccctcccaataataggtctttatttaactatacttattttcatcatataaatatgcacaatataactaaacacgaagttgaagaacatgcatataagacatgtcttatatgcaatgtctggaaatcactacagtgtgttttaattttgattgatgtacacatagcctttcacattgaaatctaggtaaggtaagtacagctattaattatggaaactagtctatatatttgttggaatatgataaatcaagtcaccgttcaaagttgaataaatagtgaacacaatataacattaatgcagattaattaccatggcccagagaccagccatgagacataacatgcttcgctgtcaacaacattcaggattggaattccagagatggcgtgtgctactggcttatggctgatacgtaagagaatctcatctatctctaaatgttctgccttaagccgcacaaaggacgtaccagtgaacaatgagttaccatgtgcagaaaatattctgcaaatcaagaaccagaaaagtaagcaacccgcaaactccaaaactcattacatgattgtgatctttattttgaggtgcatctaaactgatcttcaaactcttcagctatacctgactttctctggaatacttctcagcattttcaaactaaaccaaaggctttctgagttacataaggaaggcaaaatttggatatttgacaaatttggaagcactgaaaatggaggaaattccgagatgacagtggttttggttcttgtggttcttgtggttttggttcttgttttttgaggggtgcagagttgggttacttaagactctgtgcatggctcaggcatcattgggctgtgcaacactcgtctcatgtcctacttgattttcttctccctttcctcctctattcccactcttccctcggcaggttcccactctaatgtgtctgatttatatgtttgctattaatgtgttcttatgaagtggagtgtgctgtgtgtattcaggtgatataaatggtattgtgccactccagatcttgtatttcttactttttcactcaactatgtgttttaagtgtctacccaacttgttcatgtgtgagtgcattgcttccaactgtcgtgtgattttcattaggccatacctgctgtgtctctggtctccatcttcctaatgatgggcacctgggttgccttcagtaattgtgatcggtgttttcatacatgtccttttctgacctgcgtaaggctctccatggagttcaaggcctagaagcggatcccttgggtcctggtgtgcaggcaagctttggaccctgaataacgccagcttgctttctgtgtctaccgcactagtgggacttgtgggtccctattgtctacatctagatttagtatgcttcagtttcctaatttttccagccccctcagtgctttaagttgcacatctctagttactggagattctttgtaccttcactggagcacttggaaaacagaagaaatcaaagggcagtcaggactctcccagcaggcagggaccaggtcagagtcaggatgaagacaaagcaccctgagcaagaagcaatggaagagatgcttgtgacccgagctgatggggaaggttgagggcaacgcagagaccccactgccgacttgccaagaaaacgtgcaggaaatgagggaaggctccattttcctgagaaaagggatggaggaacataggcagcatcaagctccagctactggctctttgagaatgtagtcgggacttgccccagtcacccttgccctgagaactcagtgactggggctaatgtcaccctggctgtccttgacctgtgcagaaagcactgccaaccctggacagtgggggaagggccttatgtgcccaggccccagcaggagacacctaccaggaatctagtgggacaaggtttcagggatcctggaatcctgcccacacccaacagctggaacagttccctcagctggcgagtggacaggtggtctgatgagctcatatgttattgatgatgatgttaaagaccatgttcccatagaaataattcccaaagcattcagaagactgagaagaagtgatgataagaattgttctgggcaggagtgtgtagttttgatttttacttgtgataaagcagaggatttgcttgaattcactcaaacttgctttttctctctcttcaaaacaactttggctgaccagtgtctcatagacactcaatttgccttttcatggaactcaaaattttgtgtatccatacatgctaccatagtttcaggcactgggcatttcaaaaatgtgatatttagaacctttctatttccgtgatgactgttggcatagatgctgctggagatttcgatgacatgttggattcagtccacgcaagttttgatgcatattcccttaatttctgagcctttagagttagagttttagaactgagagtacattctcttcttttttcctttctcctcttatgtcaacaggctcccttccccacccccccacccacacacacaaacaaaaaataaaaataaaacgctctcagctttgcttttaagaaatgaagaaatgttccaacatgtgacccacagctgcaatccgttcacctttgccaatactgaggctgccctctgggtccctcctgggactgcatagatagaggcccatttgctgttctgggcagcatgcccagtcatctaggaggtgggggactggggcactctttcaggccaactcaaactaatggaataaaatatcttctccatgcagtgtctcaaagaaagagccacctgggctgcaggtgaccagactcgctcagtgcagcacggtagctcctagcctcatgtgcagtcaaacacatgagatgtggcaagtctgaactgagatgtgctatcaagtaaactgtacaatggatttcaaagatttaataggaagcaaagagtatggaacgcctcatgaataatttcatattggttacaccttgaaatgatcatgttttggatctattggattaaatgaaaagtattataaattaatttcccctgtttctctttatgttttttaatgtggccactagaaaatgtaaatgtactcgtgtggctcacattatattcttactggacagcattggtccagaggactgggatttatttttaactactttaataaacatcaaacatttgtgataattttaatacaaatatttccccatcgtatatgctcttgcatggtaaatattttatctactcttgttttaaaggataaggaggttttcaaaaattgccgaagtactacaggtaatttggcaaattctcttttatgggtaccagatagtgctatttccacccagaagctggctacagctctgtaatgtgacatgcttactcctggctattctgggctggtcctcgtctgactaatgagctcattatccactgggcagtgggatggaaggacatgagcacctcagctgtcactgccgagcttcctcccagccccaccaggccctctggttcctgatgcttgtctgtaagaccaatgggtactttaacttttgaaggtggtttctggttcccccaatcggtgagcccaaagacctcaaataacattttattcacacagacttcttagagatgaaaagtttctagagagcagagcctttagggaactagtgatgatgcattcactgaataaatcacagtattatactcaagagcaaatacgttttctttcttattggtgtcatctttccttgtgaaatacggcaactgatgaagaagtctcctattgagaataaccagacgaaatcacaaggctagacaagcagctactaacaccatccccttccccctgcccatggtaaaccctgctggcaaatgtatttctccctcctaaacctgggaggactcacgtttctgcacccagagccccaggtggaagtaaacaatgggagtgagccgatgaggtgggattgctgttccttgactcttagtgcttctcatgctagtctcctggggatgcagttaaaatgcagattctctctctagatctggggcggggcttgttcagcaggctcccaggggagaccaacgctgctgacttgtgggtcatactttgagttgcaaggttgcgtacgtggtatttgccagtgtgcacattcatgaaaaagtatcctgccttaagcctggtagatccacagttccaaatcaacattaaatacatctggtatacttaagaaaattcaacataaaaagaaatccatttcttaaaaaaaaaaaaggcagagcaaccattctctttatctgaggacctttaaaagcatctgcctttatgtgtcacagcattagctactaattactaaaggaaaaagtgctgggtgaattatcacctgaaaataaagtaactctcaaatgttataaaacataagattaatgttgacagcctctgttactatgacatattgtgtgccaggtgtgtgtgtgttataggtgcatatatgtatatatatacacacttgtatgtatctgtgtatatgtacacatatctatgtatctatatagacagatgggttatttaaatgaattttcaaaacactaataaggtgtgatttgataaatgaataatatttaataataatattaaaataatatatttgaatattattattctcctgctactgatgagaaaactaaggctcaaacagtttaagtaacatgctagtaaaaaaatgttctgagtagaataccacatgtctggcctaaccctgactgtcttttttctgacccgagaccagtcctccacgtggggagctctgaacaccatatttataacagatggttatttataatgtctttctcttctttggcaatttaaatgaagacgtcaacttgaagaaatgtttcaccaggaagaattgcaaagagagctgaattaatcaaagaaagacgaataaagtgttcttttaatatggagtacataattgttgatggaaaacacagtcttggcagaattaaaagataatcaaagagatgaatagggcaaatagcaattcagctcattaaataaatacaaggaaactaacctctgcagtttaaccttgagcgataccttttcccatgaatagagagtgtcgatactaggcaacaagcctctgaacagatagtgttacccggaacatcacccttttctccctttgcttcaaatcaaaaccagcatcccccatttagacagcataaaaggtatgacaaaacgggacgccaagtgagacactgttgattctgtttctatgaaattctagaaaaagcaaaactgtcatgacagaaagcagatctgggtttccagagcccagagtggggggaggggactgacttcactgagacacaaggaaacttttggggatcatggaaagggtccgtaccacggttgtggtggtggttataagactatatatttgtcaaaagtcttcaaagtgtgcacttagaattgctgaagtttattgtacataaattacatgtaaatatcataaagtgcatgtaaatggtatgtgaggtaataaagcaattttttaaaaacaattttaaacctggtatagcattttgtttttttgtgtgtctgactcagaccaggcaaaatttagtaaccctttggcaacagaaaatcagcacagatatagagctagaagttattgtaaaagaataatagtggcggccgccacggcgcaggagttgccaagattttcctggatgaattccatccaagatacggttttaagtctctcaaggcctttggatgcctagaaagtgggtcatctttcagaatatctgcgtcactgtggagatgttagtaaatcaaagaccagctggatttgtccttaaatgtagcaaaatatgtacttgcttggaagtactcttaatcctttcattcactggacagggaagactggtttcacagtcctgactcccttcattcgttatcaacacctcgtattttttttttggtagatgatatatatgaggcagtaaacttgtggtctggaaaagcagagatcatattaccactctgttttaacttctaaaagtttgaaattaagacttataccaggtatttttatggagtggattggagtatagaagcaattattttaactatttgctaaaaaaaaattgcctaaaatattcagttattaaaggaaaagcattgttctggattggattcttcagataattctgcttttggcaacaagtaacagaaaaccaacttaaataggtttggacaataaggacattcactggctcgtgtgtctggaattctagcaacagcagcattcagggttggccagaccaggatctcaacaatcttattaaaccatggttttcttctcctctctccactctgttgacaggatagcttcatcttaagacttgttgtctcatcagtgtaagatgactgctaagttgtatgtgagcccacaatttcctcattcattccttgaaggaagaaaaaagatttcttcaggaacttctgacttaaaagcaatgaaggactttcccagaagtccatttctcattggcccgaattgggttgtatgcccatttctcattggttcaaattgggtcacgtgcccagtcactgacatggaggatacgatttccctaaactaatcaggcctcccgctacaactagaaggagactcagctcccacaaacatatgaattgatggtgcgggagagtgtagtgggaattctgttaggaaagagaaggaagtcaacaatcgggtacgctgtgtctaatttaagtccatgactttaaaagtgagcttttttttttgttacaaaaataatgtaggcttaattttttttttttttttgagacggagtctccccgacacccaggctggagtgcaatggcacgatctcggctcactgcaactccgcctcccaggttcaaacgattctcctgcctcagcctcccgagtagctgggattacagatgcccaccaccaagcccagatattttttgtatttttagtagagacggggtttcaccatgttggccaggctggtctcgaactcctgacctcgtgatccgcccgccttggcctcccaatgttaggcttaatttttaattttcagagattatttgtagctgaaaagaagaaagtaattaatgaaatgatacggcatacttttaaacaataaatatcatattctacatactgcagacacattaccgcataatggttaaaaatacagactttgctatcaacctcctggttcatcttcttactgtctgtgtgtcctccttgggtaaggtacatagctttcctccacctcaacttctttctctctgtaataggaatgatagtagtatctgtacaagtttctccagcactaagcctctcattcaggggtcagcaaactacagcttgcaggccagacatgcaggcaacctgtttttgtaaataaattttattggaagccatttatgtatcgtctatgactgttttcacactacgatggtaaaggtaagtagttccaacagaggtcttagagctcacaaaaccaaaaacatttaatatatagccctttgcagaaaacgttcgccaacctctaggttaatacataagatctttattttcttgtcaaaatctaacatgtcataattctgtggtcattgagtgactggagatctgccagagaaaggcaattatctacagagctaacatgaaagcaagagatgctcctttattttatcacttaaaaacagtgaagaatcatgaacaactgaaaaatctacaaatgtgtttaaatgtcaaattaggctgggcatgatggctaatgcctgtaatcccaacattttgggaggcgaagtcaggaggattgttcaagcccaggagttcaagaccagcctgggcaacacagcaagaccctgtctctactactactactactactactactactactactgctactaataagccaggtgctgtggcatgcacctgtggtaccagctactcaggaggctgaggtgggaggattgcttgagtcgggaggttgaggctgtagtgagtcatgattacaccactacactctagcctaggtgacagagagagaccctatctcaaaaaaaatttttttaaatttttttaaaaagtcaaactatctacctgaactgaccagagatcttgaaatatgtgatgtaggatttcccttcaactctgggatgttggaactggaaacttgagtgagagtgaatttgttcacactcatagctagtggatagaagtcatagctctcagcagaagtctgaagaggaaataaaagagagccagtaataaattgctgtgaatatttcttttgaaaagcaaagaaaaaagtattgccacctgtgtgtgctgaatggacagtggtattgatatgtagacaagggatcctgtcagggaatccctggagagagaagagtctgagactgacactgcccggcagccccaagtctgagttgtggaaaagccctcagtaaaaggaaaaactcatggcaacgagttggtggtgatactttcatggaggaacattgtccttgcaggatgggtggttttaatcctgaatttaaagatctttaaaatctaaattatctagtcaaatttttttcataaaacaatgttttaattaaagattcagttttaggtcaagtgcacagtgtctttctttaaaaatatttagatgtggccatcaactatcaagaatgtttctagaatgaaatatattcagcagtgctgtgtggggatcaggaacacaggctccaccaatcagttgcctggtttcaattcctggctgatttacctgtgtactattcactcctgaaagtcctaagccttgttttccttatttatagaataagattaacagaagtactaactttatagagctttgatgagacttaaaataatccacgtaaagtgcttagtctagaatctaatatcacacactccataaacactagccattttaatgtattaacacatagaaatgaattgtagaaaacattttggcaacaaactataccataatatatatttgtaatctatggagttcctatctttcacttttgatattcctgtcttgttttttgagcagcaaaggttaaggtagacacagaaaaatccctcactggggtcttcaaatttagaaggttagctcaggggtcatcttaatagacattatattagttaagatccaggtcaacttgctaatgaaacaaggccccaaaaatacagtgatgaaaaagataaaagtgtctttctctctagcacacgcacacagaggtgagcagccaagctctagtgaggcagctctactccatgagttccatttatcttgcatctccaccatcgcctacacaggtggtatggttgaagctcaccagcatcttcttccagcaagttattacctttttaaatgcagagacctagaacttatacacatgacccctacaaccacctcattgctgaggtcttaatcacagtgccactcacagttgaaaaagaggatagaaaaaatgactgtcactaggctgccatatgcccaactaaaattctacgtattctcaaaagagggaagggaagcatggatggtggaatccatcagcagtcttccacggcgattgtcatggaaactattgttttgttgactctagacactattgattttaagacacatagtcattttatgtaccactaagtaaaggaaaccatgttgtttaaactgggacacatttctttcttaccagctcagttgtaggacaccttccaattaagagatgttaaaatgtagaaaaccaatgtgtcttggtatagaagaaatacaggattgtgaagactttggaaaagaaagtgaccaaaggcattcattttgcagtctacttttgtgtgtgtgtgactttccttggagcaaagataggcataagatatcaagctttggttgatctattgaatttactgtttagaatctgtgattgacaaggtactatcagtgtgtgtatgctctaagtcaaattcctgtgattactggtagagagactttagctcaaagctttggggaaaatgtgcctagattttcattcaatctgggccaaatctggagttgtacaaatagatagcatcggtcttgtccttagtagccagcatttttgtttaataggaggagagaaacccaggacgacactgaggaacagatatgaccagggcacttgacttcttgtttcagcactcagtcattacacaaacagttgttgaacaccaggcactttgcttggtgtgacaatgcactcccgccttccaagagctccagacccacaggggagtgctgttgtacaggtgctaggatagaggtccggggagtagaggcagaatttgggagccatcagttctatctgaggctaggaaaggcttcccaggggaggtaaaatcaggactgaggaggtcaaagagccctccatgcagaggtaagagactgacaagcacaggaaactggagctgcggtcactgcagggtatcatgctctgatgcttccgcatgttagactggaggcaggatgtggggattggggggtgtcctctccagcttcgcttttttcagtgttttgtatgtagttggccaatagcagtatttgttgaattgaattgaaaagaccagtttcttggatggccagctagagatgagctgaatttttctggatcaaaaagatgttagattacaataaatgggcaaaagcaaaataatacctttggtgcttactcttaaacttaacattactctattttgtttgtgaaagtcagatttgaggatttagtttataaagaaacccttaattggttggatcccacttgcttcacccaccctgactctcatttcccccaatgtaataaatgtgcatatgtatttagaacatacagagcagtttaacataaagtactgaaattatcctaagaacagattctcagtgcagcaatcctatctttgtgaatttgatgtgttctaaatgcaagagcagaagtgttttaattgtcaggttttaagatattatgaaagcccctagtcacttcagtaagatcatttgattctggttaatgacaagtctatactatgcaggttttttttttttctgtctattgctactgaaatctgcttttcttatatagatcactgttacagatgaggaagttagtaatccatcctttttagatctggtgagaactccccaaatgaggaaatgcacacttattcttatgtttgcttggtaagtttgacttgtgatggatttaaaagcttgcgttaaatttacaatacatcccttccttcaaatcagcttgaagttatctcttacttgttctctggtgtctttcaatgttgctacaggttcacaagcgcagtggtgtatcaaggacttgtcatgcgcctgggaattatagggggcaacctctatatagactttttcatctcgggcgtggtggaactgccaggagctctcttgatcttactaaccattgagcgccttggacgacgcctcccctttgcggcaagcaatatagtggcaggggtggcatgccttgtcactgcgttcttaccagaaggtaatcttaccccacatctgtttggcagccaaaggacttgaaaacacctaaatccacaatcaagtatagggagccacttgttcttaggaaatgtgcaatggaatcacagtctttcgtgatgtcactccattttctgcttaatcagcataaaaacttcgaagtaagagattggttctgtagatgattctcttttctcaattgctaggatcatttatgaatgaaatagatattgtgcccaatctagctgatagcgatgtggtttctgttactcatctttatgtgacttacttttgtgatatctctgatgtttaacttatttcctgaacctctgccatgctgctggcaccatgctaaacgctgaggttacacatagaagaacgcagtcttgacttcgaatggttcacaatctattaagggatacagatactttaatattgtcacgattcttattgtcatgaattatttgtgagatttagaaactaattaaactatttacaagatttagaaatataaaaaaatagattggggaggagtgatcaatccagaaggggattcaagaaaagcttcccagcagtgggaactaaacatgcgtgaagactcaaatgtgccagatatcagggagagagaggacggacgtttccaaactagagaagagtttccagaagtatgaaacacctttgtgcatgcaggaactgagggttcattgctgtgactggaatccagacaaggagcctgagagatgatctgtcaccagcatgaccagccctgcaggtggtcctgtgagcttgcggaggaggaggagtgagtttggcataactgcagcagtttagagatggctatgagcagggggagatgctgagagcaggagttacaattggggcagtcagacctagatgagagagggtcatttcatttcagagatgttgcagagttaaatttttcagagctccatgcctggtagatggggtgcaggccagaaggaagcagagggtgccgtgactcctgatgtgtggtgagcagcacccagaagatccttaccctagaacacaccaggaactgggaggaggagggcttcacatcccaggggatgtgtgaagtagagcaagttcatcattcccctcttccaggaaaggcaaagtggggattacagagaaagctggattctccaggcatcctttgtgtctgcacaaaaaaggctgtctttctttgagaatcctctgaggaccagccaagaaatggacaatatagtgggagtcagaacagtcagacatttacagatgagtttattaattaaatgaaggtttatgaattcttaaaacacgaggtaggccctatttgaataaaattacaggaatgccaatattcggaacacacacacacacacatacacacacacacacacacacacacacaatgtacaagtcccctgacatgttggaatgtttgatgatgaacagcaaccacctatttacatttctcttgttttccttgagtgcattcgcttcccagggctgctgtaataagtaccacaaactcaccggcttgaaacaacagacatttatgctctcaggggtgtggaggctgggagtctagaatcaaggcatccaagggtgcttatgtccagaggttctggggaagggtctcttcatgcctctctctggcaatccttgcagctccttggtgtcactcctatctctgcctccatattcacaggacattctcttctctgcttgtgtcagtgtcaccttgactaattacatctgcaaagaccttatttccaaatgtagtagccttgaggttccaggtagacatgaattttgggagacactgttcaacccactacatggaattaacatattataagagttggaggatctgtacaatagctatctcttaatacgtatctatttagtatcgactaattgccagccactgaactaggaggggaatggagaggtgaacaaaatagacataattcctgccctcaaaattgtataatttaagaagagtgaaaaatcgcaaacattggagacgttactgttctattttactttggtactttggatataacatacaactgtagctccctgagatgaagtcttctgttctcatcgtatgtggactaggaatgaatgaaatattcattgtatatgaaattagaaatgcagcgagaaagatgcatgcttcggtgtgtcccctcatttcatgatatatatatatactttactctataagattttctctggtcctagattgattgggatgactttaatgtttgttgcattcagaatgaccccagaaagcattcaaggctgtgtgtccaaatcaagacagaagtaactagccggatagtcatataactattttgtagagaattctttcatatattggaaaatataacaccaagaacagactgttctcccttgtctaaccagttttattttatagatataatttcctgattgaagctttagaattgttctcagcaagactgaaaatgaattgctcttattctagacacattttatttttaccttctgcagacttggctgcttttatagtcatatgtcagtcatgactgactggcaagaatacatttcaaatccctaaactgagttccaaatattaacagacgatcctcccttgagtccttccaatttaaagacccattggacttgattccagccactggttaattagcacgagaaaggcttttctgctcagccattcctgacgtcagtagtaggtcgccagcccctggggagaatacagatgagcttttggagaaaccagctctaaaatagtctcacagcaaacactttaatcagctttccctccactcgacccaacttttcatggtctaaagaatggaattctggaagaagaaatagtagttctggttgtattctcatctcagactcactgcttctagtccaaatttcttaacactcattaatgtctggaaaataaagacctttctttatccatacctgtctgccatctttaatttgagtttatttaggatgaccacaaacctagcagtttggataagtcgtcttcttgaactggaaaacttgtcttccacttttatttttctttaattgaaaagtgagttcatgtatcttaatttagacatttctactagaatttctcactaaactttatttcagaactcagagtagatgatccattcagaggacatataaagttttgtttaagtcctgcatcctttcttcaggaattgaggtattattcccaatcatctctagtagcttgaccaaatccacattcagaagaaaacattttctttgttctcatgtaattccatggaagacaattttagtttcagtactcatttttaaattgccctgtggtttttgtcattgctaccaaaagatgtctatggccacctcaaaatgaatttagcttattactggaatcaagaatttctttgtgtgtatatatttattcatacttcctacagttttcttttcactctttagttaatgaaccatgcaatgccttagaaacttttctttggttacacatttcaacaaaatctctgttccagtatagtttgatactggactctactgcttggaaaagagttgggagtctttcagattaaggtcaatgttccggacagaccacatctccacaaatggggcaacttggcattttctgaatgttttactgaattgactggctatttatctgagttaaccacatatgtttatcatggtggagtgtgtgtgtgtgttttaatttggtctctggcttttgtttggatttttccatgaaacaccttgcctcggttataaacccaaattgcccttgaatttgtcggtgggactcaattttagagcaatcttgatttagtgaaaagaaacatacaatggaagaacccaacctggatagtgaagctgtttcctaggtagcaggcagccttcactgcagcccgggagtggcaggagatggtcccatcgggctgggacccagggaatctgagtctctgctcccactttccccttccagtaccacatgctcattgaaagatggagtggaatgcattacctagtctccactccccccttttcttggtcttcataaagaagcaaagcctaaataacacatgttgacaaaccttctgctccagagcagacagtggcccagcacatcagcacaaccctggcctcctcactgcctgatataaccgttaacgtgacagctacaagggttctcatgtgggaaaaacatcaagtgcaccaggatgtccttggccagtttgcagtcaaaatatgtaaacttcagactcccagaaatggtttggattcttgagccatcttttccttacacctgtgctcctgggcaattgttttatttaatgaattttagcttttttttttttttttgacttggctattctctagagagaacacacagaagtctactgggcttgattctcttctttcatcctcctcattcatttctactaaaaaattatatattcaggaaggttcaataattcccctaggaaacaggaggactatttagtgctaaatgaacatatgtgttggatataaagggaaaatgaaaggcacatgaacactggacatgcttcgttttgctttggagagcagatatggtcttgttcatgcagacatatgtcctcaataccaaatcccctaggaaaggatgacatcaattgcacaacttctaggaaagctagagcagtgactttttagagtaaaaatggttaactcctctgcccttaaaacataaaagaaagaaaatatttaatatagaatgtttggcatttcccactagttagtagggaggaaaggaaaatttcttcatacaaccagagcagtcctaaaacagttcattttaaaatggacgaaccaattagcattgatgaatgtggctccttctggatggtttattgaaggaagtagtacaatgggggatgaagaagacaatgagtgacatttgccttagtggtaacacacagaatagatgtccccttccaaagatcctggtcctcaaagcttgctccactctagaaaccaaggtcagctcacgtgaggaactccccaggtgtgctgggaacggctattccttgtgtcaccaccgcaaggtatgcacagaaaggacagctgggcaccagctgtgggaacgtggtggctcaaaggcatgactggaaactaccacctggacaaaaagccagtgtgctttggctctctaggaggtcattgcctggaacaatgttccaatgtagtggctgctcatgctcaacaaacggttcttgaattgtacttcctataatccaacctgctcagaaaggcatctagcgctctaaaatattagctatcatctagtttcattgttgttgaaatttggttacattattagaaagttctatcatttgtgcttaaaattggcaaagacttcagactggaggccactaagcaaatactttttgttgttctgtaaaatgttaatgaaatcagacccctaactcctccctttcaaactttctgtgtttgcaggaatagcatggttgaggaccacagtggctacattgggaagactagggataaccatggcctttgaaattgtttatttggtaaattcagaattgtacccaacaacattacggtaattctaacaaacgttatagtttctcctaagtaactctgtagaccagcgttttaagttgatttagttaaaaactatgaagtcgtttccttagctcagtgatatattagcctaggctgaatccagctagtaaagaagatatgctttgagttatcactgctttctgcattgctgcctgctgcattttgtgataaaagtatttctcatattaatatcttcacacactgttacggttttgaggaaaggcccttaacttgaaaccagaagacctctaggtgcccttgcttagactgtgggttaaatctgtatccatcagcatcacctgctgcaagactatggcctctctttgactgcattacatgcattgcagtggtgagcagctggttatgaaggatgaaatgaaacagtgtgcacggattagtgcaaatcaacctcctctgctgaggaagcattccctgggcacacttctccctcagatgaggaaaccaaagtagcacaaagtgacccagagcaggcagggcagtgggttgctgatggataacaccctccacccacgctggagacttcctcactagccttactgtgaaacgtgcagaatggaaatgttttgcttagagttctgagagtagtcgttttcaaagttagaaaatgcaaagtatcttcacacttcctttggttttttaatatgtctgaatatgttgattatcttgaagtcacttgttgaaatagttttcacttaaaattacttttcattcaacagaaatttcggagtttcgctctgttcaggtctgtgtgattttgggggaatcatagccccatttctgctctttcggctagcagccgtgtggctagaactacctctgatcatctttggtaagaactcatttgctattcttaagagccttcatctacattctttgtactaaaagagacctataataattgttaggttcaataatgataatgatagtcatttatcttattataataactatttcattgataattatgatattaatttcatcttattataataactatttcagttttgagagccaattcagttataatgaatggttttaatttactttatattaaagggtgctgataaataatgttcaattagcattctttgggttctgagttaaatgctgtgaaactcttatggtattggagaacataaccaataattttcaggggactaaattaaatattcaatatgtttaaaaatgagggccaggtgcagtggctcacacctgtaagaccaaaatgggaggactgcttgggcctaggagttcaagaccagcttgggcaacatagcaagactgccttgacaaaaatttaaaaattagctaggcgtggtgatccatgggtgcctgtagtccaagctactcaggatgctgaggcaggaggatcaaggctgcagtgagctatggtcacgccattgcactccagcctgggcaacagggtaagaacctatctctaaaataaataaataataaaaaataacaaaaataagcctaatgtctaattgtatttctggtgttctctctctatggatatcatatcttcattggcccgatgctaaaaatccatgtggagggagcaggtgacacaggatcccgggcacacattccatcacctcctccaggtccctcgagtgcacctctcctcctacctccagcttccataggacttgtgaaggaacagaatcatagtctaggagggaccttggggaattcagtgtcccacttctccagggctgctccaacggtcctgcctgggtttcacacacttcccctgtgccctcttctgcagtaaaggatacgggttggcccctttctcacgcaaccgtttctctatctccacttccttacttctggtagagaatgtttttcatttatggttcagcagttgaaatttgaatgaaaatactgagcccatgaggacagaccttctgcttcatgcaaaagtcctttgacagtgtgagggacaaagagtcggcttctaccacttgacaccagtgacctcaatacaggatcacctcaaattattgtatgggatttggtcatcaagctgagtgttaattctgtggtcagcatgaaaaagcagaaagtgctactgtccagcaaagacagagtagtccaggagacaagacacatgaccttcaggactgcagcccacagcccagtggcaggcaggcggggcctgagactgcgaggggagacagccgaatttctaaaaactcagcgacaacagaatgtgataactgctgagaccctgaaagcagaggctcctatgagaataggtcacagggacccttgacccctgagtggaagggagcaggccagggaggaaggaagcaatgtctaggccaagaggggctggctgtgctccaggcagtggaaagttcaaagcaagaggatgccgcatcctcaagcacctggtgctagaggatggagtgcagttgtgagctgggcctgaagagaggtggtgccagggcagggcagggactggatccggaagggcctcaaggacatgccaaggctttgctctttatacacacagcagtggaaagtgactggacagtttcaccctgaggtggacagagctggccttgcattgtagaaacacagatatgcaagtgggttggaaggaccccccagcatcgtccctctgatggtagatatgcaagtgggttggagggacgatgttgggggtgacaattcaaggatgtcatcatcaggagatcacagtggcttcttctaataaagggatggcaatgggaatggagagggtggacagattgagtaaacatcttagaagccagctgggcaagatgggatcactgatgggcacagggagaaagcatggtgacctgagaagcccaggtgcctggggagaagcaggtggcacaggcactgtagcagcaaggctgagggtctgcagggtgatggggctctgtgtccgctgtgcataatttgaggcacctggaagagttcaagtggaaatagaaaccagcaggctcaacaccgctgagctcaggagggaagagtggccttgggatgaagagctggaagccacctggcagtagagaatggttgaagctgagggagtggcccaagccccccagaaaatcaggacaaagcaagaggaaagcaggaggcctaggacagagacctgaggggtggcaaagtgacagacctaggcagaaggagaggaggtggccaaggaagtggaaaccaagtgagaagcccgaggcaggagggcacgagaccaggtccaacctaaggactgaaagtagcacatgtggatctggtggccagcaagaggcagaaggaacctgactggagcagagccagggagaatataggctgagtctggaggagggcaggcagaggcaggacctggagcatggtcctatgctggtgctggcacctcccactcaccagggccaactgctaccatattagttcgtttgccactgctataaataactgcccaagactgggtaatttataaagaaaagaggtttaattgactcacagtttcacatgactggggaagcctcaggaaacttacaatcatggtggaaggggaagcaggcacgtcctacatggtggcaggtaagagaagagcaaggaaaattaccacttataaatccatcagatctcatgggaactcactcactatcacgagaacagcatggggaaacctccccaacaatccagtcacctcccaccaggtccctccctcaacatgtggggattacaattcgagatgagatttgggtggatagacagagccaaaccatatcagctacattttcaagaattttgtaagccagtcatcaagcacagatatcatcaaaaagtaaagaatatgaaatatatgagaaatagaggcaataaatgcccaacactcatcagtccctaattcagctactacaccttcagtattacctgtgctcctgagattgtgtctgctgcatctttatggtggaagccccattgatggggctcctgcatcacttcccagtggcccaggcagggatgttgtgtcagtagcctgaagggcccacagtgggagcatttaaaccatgcacattggcagatgctgccaatcagggcttgattgcccaaagagggttgttaggcatttaccagcacaccactaggctacaaagaagtggagaaaataggggagggtggcttttcaagaagtttggctctaaagagcagaaaaagaaaggatggtaatggaaggatgaggtgagattgagagaaggctggtcaaacaggaaaggtctgaatgtgtttgaaagcttctcccaataggttgaagatactggaggaagggttgatccctacagtgaggagcccaaagagacaggcctaggagaaggctggtcccggagtagacaccaggacaagctttccactgtaaggtaacaggaggaatcggagggagaggggcaggtaagtgagagtgtcagtgagcgggcgcagaggggactcccctccagcacttctgtttccctgtgatgcaggagaggaggccttgggtgttggaccctaagaaggaactcagtcaatcactgtgagatgtgtgagtgaacacatggctgccaggtatacaggggccgtggtgctactcagggtttgaggaagggagagaacctttgaagctgtggtaagggagagctggggcattgatctgggatgcagaggttgctgtggttgagagctactccagtgagcaacatgatggcttcagagtgagcaggccccatgggagagggcccagctgtgtcttcctggagcggtaacacctttcccctattccataggtatcctggcatccatctgtggtggccttgtgatgcttttgcctgaaaccaagggtattgccttgccagagacagtggatgatgtagaaaaacttggcaggtactgtacaaaattcaatgcaccctaaataaaagcaatatttaaaaccacgggggaaagaatgacattgagaaaattgaatatccacagggaaaaaaataagaataaatcctcatctcatattgtaagcaaaaaattcaaagtagatacaaaaggttaacataaaaaaaaccctccagagctagataagagtatgcattgttttttttaatgtggttgtgaagagagaagcattttcacataaggtgctaagactcagaagtgatctaaaggcaggaactgctgatgtgggaaagtggaaattgctgggacatacagcagcaggggattaacagtgtggcttactctacagagtgaggatgcgtcaggtctgtctagatggaatggcataggcaggttttcaagactgactacaaagtgaaatgtcactgaacaacatgttatagtatttataaaaaactaaaaccaaaggtgttttctctctgcagctggataggaagacagatgacacacagatgatagataataggtagatgatagataataggtagatggatgatagatagatataatagatgataatcatagatagataagtgatagtagataaatgataaataatagatgatagatgatagatagatacagatagataaatagacaggtagatgataggtaatgtctggatagataggtggatagataaatagataatagatgatagataataaacattagtaggaagatagagagattgagttttggaggggggtgtttaaatagggtataagtaaaactaatacccagccaatatattaacatgaggagtaatgtcaagaaaaattcacattacacaaattctttctaattgtttgaaattttttcattaaaacatagagatatgaatatgagaatgtatagtacaagatgtaaaatattaatatgtgccctctgtggacacaaatgggctgggaagaggggtagggaagggaggaccatcactttcttgccagagacttccatactgtttgattttctttaaaaattagaacacgtagtcttgtgttgcttgtgtagttttaaaaaatgatgtaacagctaatttaacaactaaaaagcaatcttaataatgacttaggaattaagaacatggagctctaaatatttttaatatataaaaaatcctgaggaacagctttcttccctttgattctattccactgactgccttctgtttacacaatgagagtgatgctttcattctttatccccaaaccaatcaggatcagatttgcaaactcatcaggaaaaaatggaagaaaagggagtcctctgaaatcaagacttttctactgcttcagtaacattaaaaataaacagctaggagaggtttttttgtttttgtttttgtttgtttttggcttggggagtgtgggtggaagggggttgtctaaatggtgtgcaaggaaaatcaatacccaactaacatataaacatgaaggattataccagcaaaaatttaaggtacccagattctttctaatttttttctgtttataatttttcataatgaaaagttgggtacattaattaattatacctagtctctatacatgaaaaaaaatatagtagaagtatggtttacagtgctacaatttaagcacattaattgtgatccatggttatttactctacaaaaattacttagtgctaaattactaaaacttgctagcatttcccttttaaaaatcacactggattattttatcgtttctgctggtttttgttcatgttaacagctcatttccaaatatatgttaattcagtagaagttcataaagaacttaaatgctataatgctaacaaacccctgtatcagaggaaccagcccccaatatttcagcataggttctattttccataagtgttggccagctgagaaataaaaagagtacaaagagaggaattttacagctgggccgctgggggtgacatcacatatcggtaggactgtgatgcccacctgagccttaaagccagcaagtttttattaagggtttcaaaaggggagggggtgtaagaacagggagtaggtacaaagatcacatgcttcaaagggcaaaaaggagaacaaagatcacaaggcaaagggcaaaaacaaacatcacaagacaaagagcaaaagcagaatgactgaaaagggtctatgttcagcggtgcatgtattgtcttgataaacatcttaaacaacagaaaacagggttctagagcagagaactggtctgacctcaaatttaccagggcggggtttcccaatcctagtaagcctgagggtactgcaggaggccagggtgtatttcagtccttatctcaaccgcataaggcagactctcccagtgcgactgtttatagacctccccctaggaacgcattcctttcccagggtcttaattattaatattccttgctaggaaaagacttcagcaatatcttccctacttgcacatccatttataggctctctgcaagaagaaaaatatggctgtattctgcccgatcccacaagcagtcagaccttatggttgtcttctcttgttccctgaaaatcgctgttactctgttctatttcaaggtgcactgatttcatattgttcaaacacacatgttttataatcaatttgtacagttaacacagtagtggtcctgagggacatacatcctcagcttacaaagataacaggattaagagattaaggtaagagatgcataagaaattataaaagtattaattttgggaactgataaatgtccatattaaaatgaaatattcacaatttatgttcagagattgaagtaaagacaggcataagaaattataaaagtattaatttggggaactgataaatgtccatatcaaaatgaaatcttcacaatttatattcctctgctgtggctccagctggtccctccattcagggtccttgacttcctgcaacacccctaaggtctgaacacagacaaaaaatgatcctggagacagatattgttgttaccttagagttgggttttcatgaatgtatttgatcaaaaccagctatactattaaataataacagaacaccctcttctaactagttacataatctttcctaaagactttctcctttgttttttcagtccacattcctgtaaatgtggcaggaataagaaaaccccagtttcccgctctcacctttgaggcccccgacaaagacagaaagaaggagctatccaggagctgatcctccttgcaaagctgtgccttgcagagatgcacgtgtgcatttcagctacatcatgccgcgctgttgtaatactgtataaagacctcaatctatccagagtatttttatataatgttggatgagttaggatttgtaatgctgttgaagtttctgggaacacataatatgtagccagtttaacaaagaagctgtcaggtgcacagcccttcctgggtttttttcttgtgttccctgtggtctctgacccattaggctaaagagagacaagagaagcccccaacctgattctcatgacagctccatcaagaatgtgggatgtgccgaccaaggatttgagaaagttgtacagaaatgtgttcatcaaatctggtcaagggactaagctcctagctgaccattcattctgaagattgcatggaggatgaacatctgggaatcctgttaatgagaaggctgaatcacaggcacctgggccaaagggtgtgagcattcatgttctctgctcaccttggtttccgcacaccttcgcaatgtgaacaggtcaggagtccctcccgtccacctcctctgtaacagctggggttccaggcatggtttaggccctgttccagcaataagaaccaatctgctgtacaatctgaggacttggctctgttatttacaaaatgatgctgtggttctgagattatttgggacatttttggctctcctttagtggacacctagagccacagattcccttctttactaaacaaatcccatggattctgatttctgggtcttaggattttaaaagtgaagggatatttttcttatatttgtgagttcagttccgatggtgcccgtggtcaaaagcgaaaaacatggacaattcctattcattcttagcactttgacatgtcttggggaaaagcttacattttaatttaaaagaaagatcaattatatccatgcttaacaggatcagcaggagctttataaatgactttacagagactaataagggatttgatctttctttttttgttatcgaggcttttgaaatgtggaacttgtgtgttctgctttatatgttatattcaatatcttttcagatgcagtctatattttatgctgagttttaaaaatgaaatactttatgcaaacaggcaaaattggtaccaaagggaaacattaaccatgaggaagagcatttttctaaggagaacaggtgacaatatacacatgtgcgctaatcgtaaaatgagcatcttagtctttaaaacacatcagaattgaatacgaataatctatttgtcgatgaaataaacacaactctttgaggatttgagactacattcaccctttattcacagtcacttgcagttttgcttttctctgcatttctctgctgtaagatgactgttgcattgttgaattgtattttgagtggatatttttgtttggtaacaattaaaattttaaatcgtaaaaaatgtacatttgccctttctcttccttctaaacatgtgtctctcccacaggtcattctcctgtgacacgtgtactgcagagtgtttcaaaaccgggcaggcaattagcaatgggaaataagtggtccaccttcaatatttgcttgttgttcatttacatgctcttggcaccaatcctagactcacgtgtgccccagaataacattcagactctcagctggtcttgtgttacacatccatggaccggttcactccatcatatacagctctctgctccgtgtcccctgggctcaagtcaagcagtcggtgacagatttcattcccaataacagaatcggtttgcatgactccccatacatgttgcagctttgaaaacattcatctcagagttaggtataaagacataaaaatgtgtgtcaagccctcgttagctgatgaggtaaatgcatggacaacttcctaggacttctcggctctgccctctgtgaccttgcagcctgctcaggtctttgtgctctgttccttatcaaaaacagcacaaccccctcaatctgcccatttaaaaattggtggagtgaacaaagagcatgaaaatgttgaagaccacaaccaaaatttactcaaatcaaagttaagtacagagtttatttttaacaaatgtcatagctatgtcaccttactacagaatccagcagtcagaaaataacacaaaaaatgccgaggtttggcgtagctggtagctggggacagtgtcttcgtttgattactgccagttatttccagcatgctaaatccctacccacgttccagcctctaggtgagtcagtgcgtcactctgtctcccgtccaattaattatttctcatcactccctcaatccaagtaacaaaccttgaaacacgaacatagacaccaggcttattggggcgtgcacagccaagaccccaagaagtgactccttgtaaaatgtatttgtccttctcaaagcaaaccagaggccctccactgtcaccctaaatagaggtagggaaaaattcatgtgagggttaggctgccagccttttattgtggcatccatctattgtccatatgtatattttcccagtaattgaaattggaaaggaacttatgggcatattactggagcatctgcagtgcttaagtacttagcaaaatctattcagcgaaaccacaccacttagtttctcccaggggtaaaaaaaacccttgtgaatcctgcacacatcccttcctgtgttggtgtttcctttagactggcctagcctgggcatcactgtaaagtatgtgcagttggtctctgtcctgtaccctctacctccttccctgtcggaaaagtcaccactttagtccctggccaccagcacaccccaggagggtgagtggcctgaggtagttacggcacttaaaactcccttgctaccgatctggaactcaagccccaagacatccccttagatgatctgaatacgcattcagggacagatctaggcagtttctaaacaacacttagactggggtctaacgttgacaaatccttctagaatttgcctctttgggactgaagtctaaggggctgagaccaagaagggagagcacaagactaactttggtctcttgaccttttcttaccttgcaactgtcagtgcctccagccaaatgcctagcacagagctcagtggatttgattcttccattcagatactcatagcgattgcacactttattctcaatcacaagaagctggggcttccttgagaaggccagccccaaaggtacctgtgtttaaaagatgaaagaaatggttgctgaacccaaaacatgtttaggaggaaaaccagaagaacagagcagtggcactggacctcctgtctgtccgtgaggctgcagaacacaaggcagctcccaatgccgctggactctctgaccttggagagtgtaaacatcatatatgattctgtgttcctgagatctgggtttaacgatctgggctttgtcatggtgttttacgttcgttgttgtttgtgtactttttgcttttcttttgaaagtatgaaaatgatttttacaatgtaaagagagtctgagaaatgcaattgctattctttttatatactttttcagattttttatatgcttctttactacttacatcataatgcacaattttatatactgattttttcaatcaatgtatatcatgagtttttaaaataatgctacaatcttcataactaatattttaatggggagtgactgcttaattggcatgaggtttccttttgagatgaggaaaatgttctgaaaatatggtgatggttgcacaccattgtgaatgtactgaatgccattcagtggtaccctgcaaaataattaaaatcctaactcttatgttgtgtatattttattgcaataaaaagaatagtcgtcatttactaagaattaaccttttcaggcacaagctcttaatgtggtgtatctcacttcatcctcacaaccgtcctatgaaacaggcacttttatcattcctgttctacagctgaggaaactgaggtgtaaggaggttgtgtagttcagcttgagcctgggtctgcggagtcactgcccaaatgcttcctccccgtgcacactggccccactcttgcttccaatcttccacatgtttgttcataaagttcattctcgtttcttttctgaagtctaagttcccataattatgttgacatatttccatctcgcggtaacactcccaaattattttctaaaagtgtgtgacagtataaaatgttactggaaacaattctcctcacccttgtgagtattcaatttttaaaagattagctaacatagtaggtggaaattgtcctgattcattttctgatttacacttccttgacaattagggagaagaaatacaactagggacaattctcctagttgtagtttttcttttgtgaaaaactgctttatttcctttgccaaattgaaacagaacatctgctaaactgccagagggaatgctgtttttccagatggacacgccaaggatgtctcagtgctctcacaaataatcgttttccaattttgcaagcccagctttgattagaatttctcaaaatattttgctttgcgagcatgacacaggcaaaagctgaggcactctttctttcttcccccaaagtgttggactgcacttagatcattgtctcaggttcagaaaactgacactgaatctggagtttacatgagcagcgtagaagaggctcttcccagagcctggctccagagcccagctcagccctagccgggaaggagctgcatggaggaagctcctcctggctaccaagcatcgggcagggggtgcatgacgtggactgtgtagatgggtgagggagcacccttttcaaaatattttgctgaaaattaagttagatatcactgctctcagatctgctctcagagcaaggcaaacatcctgatcaggaggtaaacccaccactagttgccaggaaattgacgcggtctgtgagtatgtgctgccatccagtggccaatgtagagatggcacctctgagggcggggggccacgggtgaccttgaggattgaagccctccctgattgggtcctggggagagggccacaagattagcccagtgattgtggatggggctgacacggaagagccccttggcctcaacacctactctgcatttggaatatccaagtcaaggaaggtctggaaacatgaaggggagagggggagaatttcgacctccctctgagaagctgagaacacccattgatctgatgtcatcaacatatagaaaatcgataaacagatctgagttatgttttgtgactcctcctggtctagttagtgttctgagaatcattttctcagtggacatgtgggtgagaccagaggagacagggagccagtgcaggatggtggttagaaatgtgcagaagggggtgggagagaggacacagcgagtgggctctggggtcaaggcccggttacacgccggttatgtgatgtttatttatgatgatagtggtgatagtgatggtgatagtagtgataatagtgatgatggtggtggtgatgatggttgtggtaatgataatggtgatggtggtggtgatggtgatgatggtggtggtagtgataatggcaatggtggtgatggtgatggtggtgatggcggtggtagtggtagtaatgatgatgatggcggtggtgatggtgatgatggtgatggtggtggaatggtggtgatggtaatggtagtaatgatgatgacggtggtggtgatgatgttgatggggaggatgatgataagtggtggacggggatgacggcgatgattaataaccctaatcctcacaatgaccttatatgtaagtacagatgagaaagctgaggctaaaagagattaaataactgcccaacgtcacatggaatatgggagagacagaactcacacccggatccttatgattttagcttcatgctttcatcagttgaagtattgtagaggatctgtttgttttctggctgcccagcagcctttcaccctacatcccataattctggtgagggatctaccttttgctcccttctgggtatgaatggggtcctgcctccaccttcagcatggaacagctgatgcaggtcagagccaatcagtgacgggctcaggggcaggaccatgacccaatttcagtctctcagagtggacagactattgttcatgtaagggagagagtggcctttcttattctttctcaacagagccagagccaccacagcatctgcagccacgggagtgtcacctttgtgccccaaatagtgcctactccatgattgggagggtctggggtctggggcctaatgtgagcctgaagacttttcagctcactaagaatttgccttgttttgcttaatccaatttgagttggattttctgtcacttgcaagaaagagtcatgttagattcaactctattccatattattagtaggagctgccatggtggagtgcttaggatgtgctcggcacttgatgcactttcttattatttccctgtaacagccctgcagcccacatcagctaggaaacaatcagcgagagctcacgacttttctaagtcccgacagcccataggcgggagccagggttccaattcaggtttgtctgtaccaccctgcaccttctctgagccccagcttcctcaatggtaaaatggaaacaacaatacctaacgcggagaggtttctagtatttaaattttaaaatatgcaaacaccaggagcagcctggcacacccataggtgtccctcaagccaagtttccttttatttggcctcactgctcccagactaagcagtgcagaaaaagggaacaagaagtcaaggaggtgaggttttaaatataataggaaagagacagaaatagggaacccagctttgaaattatctaggccagtggtttttaacgttttttaaaaacccaaaagacatttcattaaatgaaagcttatacaaaaggctgatgtgcaaagcaccatttgaaaatgctggttttacagggattagagccaagtgatacaaagaggtaacgtgtgtagttcaggtctatctggctagtggcagagtcagaacgcttttccagggccccagactccctacgccctcacctgcacctctgagaaagcggaattgagacattaagagttttagttttcctactgccaagggggtaaggctgatgggtataataattgtcagagcatactgcaaagagaaggaatccttaaaatgtaatacaggtgctgacaccacatcctgcacaagtgttccctatcttgctctcacccatcaaccaatatcaaatgccatcctagatttggggccacggggcctgtctgcctcttccccagatgtaggtcccctgcctaacaccctcccacacacgttagacatgtgggtatttgggaagaagactagtttaactataacttttgttgttattgttttacatcatatttagaaacccagtctggtgaatttcaaatgaaaaataatctaacacccttaacttgagatctgggtcaaaaccccacttacctgggaagcaatatgaacgctgaaattatgattaagagactcagtgacctctactggctttttgcttgcttttggtgtaagggaaacatacgatcatttaaaaaaagattctgaaagcaaaaaaagagagagactcaaagaaatggccccctccccttgcccacatcccttgaagactgattatggagacatagacaggtgcccaggcaaagtcaggagagttggacaatgttcatggataggaatttgtacaaggatctctaaaatgctcattttgtaacatgcactgtaggtcaaaaacaatttgttatacgggcaatggaattgatctcaccttgggtttctccccagccagtgacataacattcaatccaggcggtgaccacgtaatttggggatggcagacaggctgggattactctgtcagtgatgatggcaggcctataagggaagtattagcagttatgtttgactgcccagctgggagctgcagtacctataactaggcatccttaccttgaggccccagagccctctgagctggcactgccttgcttcaatgacacagagcaacgtagaacacagcgtttcaccctcacatttgcctgtggttgcctatggactacacagatgtaaggtttcatttgaaaggcatgagttgcatgcaagaagctgagggtggccttcacctttgaaagtagggatgacaaaggcgcacttctcatgtatattctgtgcacgactgggatctcatgccaagtgtgtcctttcatattaattgaagagggcattgatgactgggcagaatgtctggccgagacatcatcaagagggtataaaattgcaaatgtgttgtgtgcccagagcaagttgctccatctggatcctccacttcctccttgtgaatgttactaaaccgtggttgtaagaatccagtaaaatgctagacatcaaatgaaagaggattggaaataagcaccttgcatgaacaaaatggcattgtcaaagaacatttatatatcttagagttccaggaactctcaaacattagaactctggtttttagacctgattctactttagtaagttcaaggggataaaggactggatatgagaaatgccctattctgacaaagaatcatcattgccaccaactttgaagcagacacactttctgcttctgggcaacagacatctgtggtgcagaagtcctcagtctacaggttccctggtggagcactctagggtgtgaggatgtggggtgggaactctaaactcaaaatgtatcagcctatcagagaatacctccaaaactcaaaatttccaaattgctttttcaagccatcagaacaccctagctctctgaggaccatgaggagcggagaccttgtatttgcacatttgctgggatggtggggaggagactggggagcacgagagagatcagctactgtttaggctgagccagaaaggcccttctctccttcctagagtgtcagagcatcccagaacatcacttgctttctaggactgcataggcaggtgatagctcagaatactggcgtgagccactcggagccagagtgtaatgaagagtacaggtaaaaagtgcatgttggcagcactttgataaatccatgaggacacagaccaccacgcagtttaggaaagaatgaatctgaaatatgtggaaggtgaaagctctgtaaagcaaggagtttctaaccaataaagtaaagaaaaatcaaatcaacggcagagtgaaatgcaatgtgatcaggtttgtcgatggcatttcataaacctgtgaaaagaaggctctttaggggagaacagtaattgagcacaggcaccctgatgtagaagtgagccaaggaagcaaaacatgcaggcggttgggcctgtttcctatgcgtgtttcctaagagatacccaagaaaactgaacttatgaaaggcatgttccactgaaacaatacccaaaaggtccaggttctgtgggattggactgattactcttcatttatggggatcatgacctataattttttcctgtgtttgtgaatggatgagtagcctcggcattgaattcaatgattcacaaaagtgtaaaaaaaaaatcgtgcctgtgacagactgtaggtaagtttgctcttgtcctccctcactgcaaagtgtcacatttctaaaaacttccctctcttttcatctgacagtgagacaatggatatccatagaaaccctcagagcatcttcaatattttccagcaatatcggaacttggtgcaaatcactgcgcctacagattttgatgtagctacttagatcaagaaaaagattccaattttggccattttcaaagtagagaacctaaaataatataattatttttatttttctatattttttcctccttcagaaaacatagaggcaggtactgatgcctcagctgtgtgggttctgtgtaaatgtagaaggattttgtggggcttgtgtggaaggacaatatagttggtttctgggcctgttcttaccttgttgtaagactgacttgccagggccaggaatgtgggtgggccacacaaccccctacaatgcttctgggacatttctttggctccacttgaggcttcccacaatcaaatgaagaggatgctgtggcacaaggtgggaaagaagtcgcatttgagtccaagttggcaattttgtcaattaatttaggacaaattccaagcactgagtttttgatatttcaaaggtgaaattaaacagtaaaattataaacaacttttagattttttttctaggtttcaaaagtggtagtaaacaacacaggatgctctcctttcaaggaaatataagcgctttctaattattttgttggagaagtgatcaaagaaattggtatagttcagcattagaatgagatcttttctgagaagaccttgattggcacaaatagttattcgtcattgttattccgaacaatgtttagaacatgatgtcatccttcccatcatcatcctcatcaccatccccatctaacccacataaagtttacagaaaggcatgaaggtttcttttgcatgtgagtctgtgtgtgcacgtgtgtgtgtgtgtgtatgtgtgtgtgtgattgtatgtagcaaggattactgtcctaagttgaaatgttgccttctctcagccagcttcaggacagctcctctggggagcctcccatgactaactgactgtcattggggtgacttacacacatgtgcctttatttttcttttacctcctctctgccttctctctgcagccagcctgcaagatctctggaggtaggaacagtgtcccatctttggtaccacccatcaatgcctacaacagtgcataggctacagagggtgttcaaaaatgcttctctgtctccagtccttcaaggtcttcaaaattataaacattaatatagttaataatattcacataattattaataacaactgcaagaggaatttcctccccaaccaaccagagattctacactccagtgaatttggaacctgagttttccaaataactgtccatttgccatgggctgttctgagaatctatctatataagtcttttttttttttaaagaaacattgcatggaatgaaatcatcttccctagtgctgaactcaatttctgctaatatgccttacacacagtatacatgcatcattgtactaaaagagtaactacagaaattatggtacctgctcctactatttaaaataaaactgaatgtttctatttatttttacttattatttatactgaatgtcttagtggaaatgaactagctattaaaatcattctccaccagagtctctagatttctcaagcatgagtcaaacctgaataaaccacatccttctgcaggaaaccaaacccaccaaccacatccttctgtaggaaacagttctgaggatttccaagtgtcttatgggaacccttctcacaaggcttggggttaacctcacttgtcttacatcaaggttaggtgggggacctcacagtccattgggaaaaatcttgctcccattcttccttctttctccaatctttaagaactcgattctcatacaacctttatgtgggtgaggacagcagaaatgcacctgggaagctactgcactttcctaccataggagtcaaaggtgcatgagtcccaggcacagtagtggggtctgaggcaagaaagtcagtgtgggctcaacttcaaggcagcctgtcaaggatagagagcccaggcagtgagaggcagtggcatgtaccagacggggccagaagtggagaactggaactgaccccatcgagggactttcaggtagaggagccaccaagatgcttctgcagaacaaacaaaaacacccactcaaggaaaaggtcagctatcaactcacactaaatccagagaccacaatgccacaatacaataatattggccaagtagaatctttactatcaccctaacctctcattcttccctcttgctctccccaggagtgtcccaaatgcgaagctgggcagtgtggctcccataatcttcatcactgccctgtaccgcctccccaggaaatcttggaatggtggtcttcagtggacttggaggccaagctgcttcccccagctcaaggttcttccacatggcagacccaaccacaagcaaccaaattatacaaatgaaaagtccaggacagctttctgtaactaggacagacaagttgattggtcagcagaaagtaaaataggggacaagtccaagtggctttttgttttttcagaaatacccatggatttgttatcccagttgtttaagatctaatgtcaactccacttaccctgatccaagcctcatactcccaacaagagtcttggagcaatgaagagggaacccaacaaacagtctctaagcaatgatgctaatgtgaatcgtgaggaataatcttaggagaaaggccatttggggctaaagagctgcactacccttcactgaattcctaggatggccatctgtaggtttacaatgtgcaccacatgcttagctgtgccctgctgttcgtatatttttcatacttctcagctgcagaagagaaaggttttttatccgaatgactgtaaatttctttttcatgcatcccatgctagacactgaagtgctcagtgggaccaccctggggctgattagatcacctctaagtgtgctctttgggaattttacatttattttatttatgtgtgtgtggtgggaggggcgggtgtttccctaacaaatggggccaattgtagggcaggttcaagatgcccatgacgaagggcaggctctggtggagagggcagccatctcctccccagaagcactcagctcaaaagccattttctggtttttttttttttttttttttttgcaaatccatatgaaggaagcagtttccttaccaaaacagaaggcaacttaccacagagagggatatcacagtagtcaaaaagttttcttggattcactctgtagcaccagggaccattgatgtcaccatcagggttacggcagtactgaaaacaagcaggcatgtaagctccagctcacgtggggcaagagagggagaaggtgttccaaggcacacatgtttcacatctattcttagagacataaaggagtgtttcttcttcctttctttctattattattaagatatttttcgcaaacttattttttgtatgctctaaagccatcagtcatgtgttccagttcaaaagaagctatgaggccacaccctgaccaaaggggtggtgaccctgaagggtctttggagaatgggcctcttctccagaaacccgacccagtggaggtcttagagccagagccccagagaacagtggaacatcattgatgagctttgtcccttgggggctcagggctcttctacctgataaagcctgttagctgttgagtcagaaacacttacttccatgcatcatgcaccctccacgggcgagacacacaaaggcagtgtcatccttcccttcctgtgatactgagatagaataagaaatgtatattgggtctctgccccccagttcctaacagagctcctaaatcccttggagtttcctgggtgaagggagctgcaatgaagcaactcttggtgggttcctggatagcctccggggctggttgccaagggaaccaaccatgtgatttgagtgttggaaccagtcagccccaccc

SEQ ID NO: 1320 - DNA, 23839 bp, Homo sapiens
tctcctgcctcagcctccggagtagctggtactacaggcgcctgccaccacgcccagctaatttttttttttttttgtatttttagtggagacggggtttcacggtgttagccaggatggtctccatctcctgacctcatgatccacctgcctcggcctcccaaagtgctgggattacaggcgtgagccaccacgcccggcctgatttctggatagtttttacatcaaccgtggtcaagccagagtcccccaccttgttcttcttcatttctgatccagaaatgctgattctccccctgacatttcaccttttccccttgcctggggatgtccctgggatcctgcatctgtcacagagcatgctcattctctccagctgtgaattttgtttgaactattgggactcaggacatagtcctgaaagtttacctccacagtgacatctttaggcaagtccaacatttacgtgcctcctgggctggagggtcgttgtgcagacagctgtcccctgagccctggtggctggtcctagcacagttgctggagacatcccatgtccgtagttggaaatatgcacaaaggattgcttactctttttgtttgtttgtttttttgagatggagtcttgctcttgtccccaaggctggagttcaatggcacgatctcggctcactgcaacctccgcctcctgggttcaagcagttctcctgctcaccccctgagtagctgggattacaggtgcccgccactgtgcccagctaatttttgtattttaagtagagacggggtttcaccatgttggccaggctggtctcgaactcctggcctcaggtgacccaccagcctcggcctctcaaagtgctgggattacaggcgtgagcctgccgagagcttggtcggggagacctgaacccagcggtgctaaaggaattaaagacaaacacacataaatatagaggtgtggagtgggaaatcaggggtatcacagccttcagagctgacagcctcgaacagatttacccacatatttattgacagcaagccagtgataagcattgtttctatagattatagattaactaaaagtattccttatgggaaacaaagggatgggctctggttggttagctgcagcaggagcatgtccttaaatcacagatcgctcatgctattgtttgtggtttaagaacgcctttaagcggttttccgccctgggtgggccaggttttccttgccctcattccggtaaacccacaaacttccagtgtgggtgtcgtggctatcacaaacatgtcacagtgctgcagagattttgtttatggccagattttgggggcctcttcccaacatgagccactgtgcctggcaggatgtgcttactcttggtgaacccacacaatgtccttctctttcttaatgctcagatgtgcatttagtgttcagtttgtagaccgttctgaaatttggctggatctgtgggtctgtgtttttcagaatctgtgcaattcctctttgtctgcaaccacacttctggctcttcccatgaaacgtcagggctgggtcgtaattatcagatctgacaacctggctttcccggaagaccagagttctgccagctcctctagggatcctggtgcctgatccctcccttacatgcaccatgctctttatagtgtcacctccctcagcagacaccgctgagcctccccgctgggccagggggctagctaggctaaattcacaaaactccatctcccatacttcaaagaccacccacatggacagcccagcccaggtggcaggtcctatgatgggacagaggctgtaggtgggggacctagggctgcacttgagcagaatcttttttttttttttcttttttttttttttgagacagagtctcgctctgtcacccaggctggagtgcagtggcgtgatctcggctcactgcacacctccacctccttggttcaagcgattctcctgcctcagcctcccaagtaggtgggactacaggcacacaccaccacactcggctaatttttgtatttttaatagagacagggttttgctgtgtcggccaggctggtctcaaactcctgacctcaggtaatccgcccaccttggcttctcaaagtgttgggattacaggtgtgccaggccaagcagaatcttaaaaaaaggtggggagaagctggtgagcaggtggatttggttgaagcaggatgtcgacacagagggggcttggtgggtaaaggccctgagctgtgtgaggtgaggtgcctttagggctacctgccactgggtggagctgaagtgaagatttggactggggtgggaagaaggtagttcaggatttcaggggcccctgtaagccccactaaggagctaaactgtttttgtttgtttgttttctttttctcttttcttttttttcctgtagcaatgaggtcttgctttgttgcccaggctggtctcgaactcctgagctcaggcaatccgcctactttggactctcaaagtgctaggattacaggcgtgagccactgtgcctggcaggagctaaacttgattagaggaacagaagagagccacacgtgggctcagaggcagggtgctcagtttcctgcacattgggatgcaccacttgggctgctgggcataggtggatgagggtatgggaagacgtgggggccccactggtggtcactgtggggtctagttggaggagacggtagcccagctggggtgaagaggagaggcagacacaggacataggtagggacaaagaagcagagcatgtggctctgctccgacctccacccaatcacgacggccctgtctttcagaaagtcccaccgcctcattctggcttctcagaggccctcagccttccttgcgcccctggtgctggtgttcttcctgctgcccctgagctgagtgccctgggcagcagtgtccatcctcagttggggcaggaccatgcctgggagagtgcccgatgctcaagggtgccttcgtctctggggtctgggaccccagaaagctcacctgtcctccccttctgccagagccccatagtcctatgcctctgtgcaggcattaatgtccccaggttacagaagagcgagcaggaaggagtagcctgtggtccctcagcaagggtgtggggtcctgcttcaatacccaagcccctgactctagggccctgatctttgtcagctatgtccccatgccgggcatcaaaaactcaccctcccaaggtatcttcaccttccctgatctgtcatccaaattggaccagaggagctagacctggaagaatcacttccgcatccaccagggacagaactgtcaggagggaaggggcagggtgcgttgtctcacgcctgtaatcccagcactctgggaggctgagacagaaggattgcttgaggccaggagttaaaaaccagcctggtcaacatagcaagactccatctctacaaaaaaaaaatattaaaaaatcagccaggcacagtggtgtgtgtctgtagtcccagctactgggaatactgaggtgagaggattgcttaagcccgggagggcgaggctgtagtgagccatgatcataccactgcactagagcctggacaacagagtgagaccgaatcactaaaaataaattttttgaaaaaggaggaaaggggtctccctttgtctttgaaatacagtactgtaccttcatctggccagggcattgctccgctccctcctctgaccacctccttttatttgcaccctccagctttcctgtgtggccccacactcagggtactctggcggcggggtggtgaggttgtttaaggtgggaagggggcctgtccttcccaccttgaacctccctgcctttgagactgggctgtggaggggagacatcccctgtgccattggtgactgctctctctcccacctcagcacccgtccgtcccactggctaactgctgggtcgacgaggactgccccgaaggggagggaggcacacacagccacggtaactgtgggctctgtcttccagtgcccccagcagggtgggggccgggctgggatcctgggtggctcctgagtgcaggccctgctcgcctctgtccctgcatctctctttctgccaacaaccccctggctgaaggcctccccaggcctgcagagatttgaaggtctggagttcatcttttgttttctaggtgtaaaaacaggccagtgtgtggtgttcaatgggacccacaggacctgtgagatctggagttggtgccccgtggagagtggcgttgtgccctcgtaagtgtccccacaatcccctaccccaactggcgcagggccccaggcctggcagaggctgtcacctcccttccacctgcaggaggcccctgctggcccaggcccagaacttcacactgttcatcaaaaacacagtcaccttcagcaagttcaacttctctaagtaagcagagtgggtctcatctgccccaagaccctccttgtcccctacctcatctgacctttcccactcctcccaggtccaatgccttggagacctgggaccccacctattttaagcactgccgctatgaaccacaattcagcccctactgtcccgtgttccgcattggggacctcgtggccaaggctggagggaccttcgaggacctggcgttgctggtgggtcccaagttgggggcagggttcctagagggctctgggagagggtcccgggcccacccaccggtggaaaagctatgtgctatgtgcagggtggctctgtaggcatcagagttcactgggattgtgacctggacaccggggactctggctgctggcctcactactccttccagctgcaggagaagagctacaacttcaggtgaggccccactgctcccagtgcccagctgctgggcccatcgccctctcactgtggcggccaggacagaccacacccaggcccaggcctctagatattccactacgtgtgcaagggggtcccaggagcaggagagagctgttctcaaccccacatcctccagcacaggctccgtcctgctgccccaagtcctgagccctccaccccatctgtcccaggcccctgcccagctcaggctcctcactgccagcccttcctccaccccacctcgcttctagtatctcccctccacagcaatggggtgtttcatttttactttccccttctccccttcagctttgttttttttttttttaagacagaatctcattctgtcacccaggctggagtgcagtggcccgacctcggctcactgtaacctctgcttcctgggttcaaccgattctccttcctcagcctcctgagtagctggaattacaggtgctcgccactactcccagctaatttttatattttggtagatagagatgggttttcacaatgttggccaggctggtctcaaacccctgacctcaggtgatccacccacctcagcctcccgaagggctaggattacagacgtaaaccaccatgtctggcctcccttccgcttttacctaaactttttttttttttttgagatggagtctcactctgtcgcccaggctggagtacagtggcgggatctcagctcactgcaagttccgcttcccgtgttcacgccattctcctgcctcagcctcccaagtagctgggactacgggtgcacgcctccacgcccggctaatttttgcatttttagtagagacagggtttcaccatgttggccaggatggtctcgatctcttgacctcgtgatccacctgcctcagcctcccatagtgctgggattacaggcgtgagccaccacgcccgacctttttttttgaaacggagttttcactttcttgtagtccaggctggaatgcaatggcgtggtcttggctcactgcaacctctgcctcctgggttcaggtgattttccagcctctgcctccagagtagctgggatgacaggtgtgcaccaccacacccaactaatttttgtatttttagtagagatggtgttttgccatgttggccaggctggtctcgaacttctgacctcaggtgatctgcccacttcagcctcccaaagtgctgggattacaggcatgagccaccaagcctgttttttttgtgttttttttttttttttttttagatgaagttttgctcttgttgcccagactggagtgcagtggcccgatctcggctcactgcaatctttgcctctcgggttcaagcaattctcctgcctcagcctcctgagtagctgtgattacaggtgcacaccaccacacccagctaatttttgtgtttttactagagatggggtttcaccatattggtcaggctggtctcgaactcctgacctcaggtgatccacctgcctcagcctcccaaagtgctgggattacaggtgtgagccactgtgcctggcctcaagtttcataaattgcatttattatcatgtctttgagtcttctaagcagatctattggatccttctgccaccgagcgtcacctcgtcatgcaggcaggcacacacgaccaccaggcctggggatgatgcccctcaacatagctcactgcaccccgtctgatctggcttccccaacctccccagcccttcgaaaccacgtggggctggctcccacccacatcctgttcccctgacctctgtgctggcaaaccacctgtgtgcatgttccttcaggcccagcctcatgtcccctccaggaagtctaccccagttcccagggaagagtgagttcccatctctggaatccctcagccctgagcctgccccttcacatcccccgctgctgggtctgtttagggactcctctgtcccccgtcctctcagcaggcagggaacttctgagggacaggtcttcgtttgctttttctgttttctcaccaattacatagggctgagacccaggactcaggcttgggctgggggtttatagagtcaattgacaagttggacagaggtctggcagggccagccccacctgggggtgggcaaagcaggtcaccagagccttctttcctgcccacaggacagccactcactggtgggagcaaccgggtgtggaggcccgcaccctgctcaagctctatggaatccgcttcgacatcctcgtcaccgggcaggtaggcacaggtaggggtcaggccggggatgggatggggcaggcagacagggctggaggaggcatgaggctgacagtcgtgggctgagaggttcagctcagatctctctcaggcagggaagttcgggctcatccccacggccgtcacactgggcaccggggcagcttggctgggcgtggtgagtgcgagcactgtgggcacctgcaggctgcagtgagtgctgctgaccagggtgtgtccaatgcatgctggagcctccggtgcctgcacattgagtctcggggtgcaggctggggaggtggcaggagagcaggctcgggggctggaacatgggttggccctgcctctcccaggtcacctttttctgtgacctgctactgctgtatgtggatagagaagcccatttctactggaggacaaagtatgaggaggtgagctgaggtcgctctgcttggaccctgggttctgccacacttaggaagatgttggctggatccctgacctgctgtcctcatctgcaggccaaggccccgaaagcaaccgccaactctgtgtggagggagctggcccttgcatcccaagcccgactggccgagtgcctcagacggagctcagcacctgcacccacggccactgctgctgggagtcagacacagacaccaggatggccctgtccaagttctgacacccacttgccaacccattccgggagcctgtagccgttccctgctggttgagagttgggggctgggaagggcggggccctgcctggggatctcaaggatgaggccccagcatggaggattgggggtagaattccacccttgaaccccagcagacagtccctcccctgactcccaccttggtagggtgctgcctcagggagccatagaagtcggctgtgttttgagacggcgacagaacctgacccgtggagactgggagagcccagcaggcacctgtattgcagggctccgactgcatgtggcaggggctcctgctgcgtctgggcctggaggtctctctcccagtgctctgtccccagtgttcctagcagaggtatgcttaccagctgtcagcacagaccctcctgctgcctgggtcctggccctcctcccccatctgcacccccatcataggtagagaccccaccctcccatcggtcctacatggggctgtgcagctggagccaaaaaggcaaggtagaaagaggagtgatgggggagggggattgtttcagcttctctggtgctgtgatgccccaggagagtcctaatctagggaatggggtggagtaggcagataatccacctccctatcccccaggcaagggcggagcatgtgtcttgggcccacacctgcttagtttatgaggaccggctgctttccagtggtagcccttttgccatggaggtctgggagagagagcagagggcggcagggctaagttggtgatcattgggttcttcaggaccttctatatccctcctcggtaaccccccagcccaaccccttggaatctttcctccaggcttcctgagagccctgggggtgggaggctgtgggaggctgtacatctgaaattcacttcagtccaagtcatacctaggaagctgtctgggcagctgctcgagggaggccctggctctgatcccaggctggatggagtggctggaaggaatggttccaaacaacaccaccgagatctccctcaggctggccaggttttgcagctggaattctcctcttggtcccagggcggggcagggaattctaagtgtccaccccagggaggcaaggggctgctttccactgtgggtacctggtgatcagggcaagctgtggagggccaggggtggggctgagactgggctgacatctagaatcacctgccacctggagcctcagtaaaatgcctggggtccctgctgcctctcaatctccagagccatgtccatggggaggtgggctctgaagggcgaaggtgggagagcagggcccctgaggcctgggtatccaaggaggggcacgtgcacctgattctccttggggcccagaggaagctgatgtcatggctggacaaagtcacggagtaaagccagcaaagccaccctcttcctgtgtagtccttacaggcatgactggaaagttggggggcatctatggtagacatggcacagccatgaagagaccagtggggtggtgcagggtggacttggggaccctacccctgaagactgaggccctgcagctaccaggtgggctagaaggtaactggaacaggcctgggcacttgtgcacccatgtaggagcatgagggccacactcttttcacctcaaagcccttgaagagtgggcaaagacagcaagagagctgcagcctgggcccgagctcagaaacagctgtcgcctcagtctgcgcacaggcatgcaccccagggtagtgcctgcagggatgcatgtgtccccgtgggggtgcctgtgccaggcaggcctcaggtgcatgccatgctcagaaccctgctgccctttctaggcagcctccttggggcccaagctctgctccctggatctgccacctagcagacgtggggagcctgaccccatgcctgtcatggaaccctccttgcctggtgtgtgtggctcccctcttcactgggcacctggatccaggcccacctgtgtccctgactcagggtggtcccaggactggcacctactctttagagagccccagcatctttgatgtggattggagacaattgcctggttccctggggcaggtgaagacttggtgccacaaagaatgccacagtggatacgccagcaggccacatggctggccaagcaattattattatggatcccttgggctgtgggccttcccatccaccccaccacaactgcccaggtagctggagctgatcataaacaagaaggctctgggcagagtccatggcaccagcaccagccaaggcccactcctgaagacccgaagcccagcccctggatgaaggtcctaaggtcctgaggactccccagcctgtgcaggcctgcaaacccaggctgcccacaacagaaggggctctcggcttgtctggcctctctggcctcccaagcaggtgtgggagggcggggcaagtgtgggctgatcagctactccatatggccagggtcctgtgctggtgcctggctggggggctgcatagcctgcactgtctcctccaggctgcccctggggaataccacgtagtgtgtggagttcagccctggcagctcccgctggttctccttgctatgccggatgccatagccgaaatacactgcaagtcctagacagggcaggaggcagggcatgagcctgaggtacaggttccagcccttcctgtcctctttgccctcctcctgaccccggtcccagcctggcccccactcacccatcagcagccagatggagaagcgcacccaggtcagatagctaagtttcagcatgaggcagatgttgaggacgatgctcagggctggaatcaggggaaccatggggatctgaggaggcagaggcagggcagggctgggccgggctgcaggaaagatctgccagcccagggctcactttctcgggaatccatagagcctttgttcctcacgggagattgtggagacatgtgctcactcaccatgcagaaaggggtgcgggatgggtgtgtggtcctccccagccccgtgagacttgttcattctgggatggtagtgggggaaggggaggcagctgcctgggccgagtgtgagtgggtgttggctaggggaggtacctgaaataagtcttcccgatactgttgctggtgagcccccaggacaaggaggctgagcagaaacatgacactggtgagcaggagcagcaggatgtaaccccagtgtgggaggtgcagggtcgagttcccaaagacaagcacgcagcctatggtgatggctgaggccaacataacgccaagcgcccaagtcaccactgctccagggctgtacccatccaagaagcccaggtagggcctcagggctggcttcagctcccctggctcagggacggaggcgtgtacagtgcccaccagctgtaggtggtctgagaaggagctctgctgcttggtcagggggccagggctggctgggcctggggagctgggcggggaagacttctggaagcgcagcacaatgatactggtggccacgaatgtgtaggccaggagtgtgccaagggacaggaactgaaccagcgactccaggtccagcagcagtgccaggaaggccgtgaggagcccgaacgccagggtgcccgccacaggcacctgtgtccgggggtgcacatgggcaaacacctggaagaagagcccatcggcggccatggcatagacaatgcgtggcagggagaagaggaggctgagcaggacggtgttcatggctgtagcagagagagtggggagggtcagcatggcggagaagcccaccaggggcctctgctgggggtcggtgcatgggtggctccttgggaacaagggcatgagcttgtctgggctctcagagtaagcatgagtttgtgtaggagtaatagattgtcagcgctttgcccaagaacaggacatctgggttaggtcacaggcccactggagcatcggatgagggctgagtccctctgcctaggaaataatctataaggacatgcccagaactaatatgctatggaccatgtgtggggcggtcccttccaaagtttctgaagaaactttttttgaagtgaagagtttctaataattagcactttccttgccccattatgcaactagtaaaacagccccagttgaaggtgcattccccaagaatctgaggacaaggtcccccttgctcttttccctgccaccctgcccaggaagagtctctcaccgcagatggagccagctgccacgatgaagccagcccacctgtagccccgctggtagaaggcatctgcaagcgctgagtcggggtccaggctgtgccagggcaccatgagggttagcacggtggagacaaggatgtaggcaccagctgcaatggcaagcgagatggcgatggccagaggcacagaccgccgtgggttctgggcctcctcactggaggcggcaatgacgtcgaagcccacgaaagcatagaagcaggaggcagtgccggccatgacgccggagaagccgaagggtgcaaagccgccttcgtcagcgctccagttgtgaggctgggccaggatgaagcccaggatgacaatgaagagaatgacaagcaggctgatggccgagaaggtgtgattgagccaggaggacacgcgggctccacaggagacaaaggcagaggccaggaggatgatgccagcagccaggaagtccgggtagtggcccaggaggggcacctgccaagaacccacgtgggtctcagtgaagttgcggatgctgtggctgaacatagagtccaggtagccactccaggcacgggccacggcggcgccaccgatgatgtattcgaggagaacattccagccgatgaggaaggcccacagctcgcccatggatacgtaggtgaacaggtaggcagagcccgtgcgtggcacacgtgccccaaattctgcatagcatagggctgccagcagggaggccacagcggccacaccgaaggacaagagcacagcagggccagccacctccttggccacggcacctgtgagcacgtagagacccgagcccaccatgccacccacgcccagaagagtcaggtccagcgtggacaggcagcgccgcagtgacgtctccatggtggagtcctccagcggcttcaggcggttcagcttctggcataagcgtgccaggctagcaatggtgggcagcccccgggccatggcaggtggccgagaagagcaccgagccagctactggaacctgctagggccagaggggaatgacaggatgcgtagccggggcctgaccagccttccatccctcctggtctgaccacccccagtcctctctctgtccctgacctggggacctggacaccctcaccaggggcctgctggagagctggaatggggcaggtgtcagaacctgtgggcaggaggtcacaggaagcctggaggccctgtctgcatcccaggcagcaaaggaggcctggtgaggccccacctgctcacccgctcggtggccctgaggggtggggagggagcagctccagggggagcagggtgagaggctgggaacggctcagtggtggggtcccagagccaggtgaaaccgaggcttccccagagtcgagccggacccggaacaggagccgcggctctgcgtcggggcgggtgtggcccaggcagccacctggccacagacagacagtggcggctacatacacccccgcccctgcacccgtggccaggctggggtatccgcgcgccaggcggaatgcaggggcgccctgggcccgcacacctccccatgtccgacacgccgctgctgctagagcctgctccgccgcgcccccgtccccggacacctgcgccttcgcctgttcttgggcctgagcccgtcccagtccccgtccccgcaggatctgctgcaacccacctgctgctgccgcagccgctgcctccgctctgagcactgagcccgcccagttcgccggcgccgagcgcagggcccgcccccatcccaggccccccgcgcggccccacccgctgccacacacccagatatttcaccctgcccactctgcccgacctcgcaaggtcgttaccggagctcaccggggtctagggaagccctgtgactgtgactcagtcacagatggagaaggtcagaccgccggctgactgactagcctaggtcagttcggggaggttaagggccacgtctgaaagtccgcagcccaccttctttctactgcagcggacacccttcttgatccctcaccccagtacatgaaccccacccagctgggccccagacaggccccacagcaccgtcatgtgagcttcaggcacagtgagttagatgaagacatgggtctggcagagtggcctggggcggtccctgacctctactcttacaatggaagagactgcagccttttgagagagttctgcgaattgagggaatgcattctggctgttttgagcctgcagctaccacgtcctgcaaggaagcaagcagcttctgggaccagcctgcagccctcctgtgggggagtagagctcctcagaccccagtggcagcccttcctagcctaggcacctctggcaggccgggagggccctatgggaccccaatagcagatccccacttgtgtttatcagcgacagccactgtgtcctgagtactgcattccagtgccccacgccccaggcaggcagctatgcaacaatacacctggctaattttttaattttaatttttttagagactgggtctcactatgctgcccgggctggtctcgaactcttggcctcccaaaaggctgtgattacattcatgaaccatggctcctggcctccccagaacgctatactagacatgtgttcaggcttacatgtggtttgtggaatggaatcttaggagcatctgcagcctatccagcctattgggctggtgacaggatgatggactcccagacaagatggtgccaatttggaacattctgcctcggccagaatgccaataccttctaatatttggctggtattgtcttgaggaacttctcagatggctcccacttccggtgggatggtagcttccttaccccatccctgtgttgcctgagcagacgtcccttgtcctgaaatgtcaccacaaaagtctaggcacttcaggccagagggttaggcagatttgtaatgggagctccccaaaggccttaccaatgactgccttattgctggtgtccagtgttttggagtgttgactttttatctacctggagaaggtgtgacaccacaccctctgccacaggcaccaacatacaacggatatgtgagactaagcagggctgatgcagtaaattgtacatttccagagatatttccctcactactgagtgagacagctacacagagcaaccccacagtgatgcagtgaagacaaaccaccaggaaacaaaaactttctaactcattctgcaaggccaggattaccctgacactaaactcaacaaagacatcacaagaaaagaaaaccacagaccaaaatcccttatgaatatagatgtagaaatccccagcaaaacacagtggactcttgaacaacacaggtttactaatacatagatatttttcaaccaaatgtcgatcaaaaatacagtatttggctaggcccagtggctcacaccggtaatcccatcactttgggaggctgaggtgagaggatcacttgaacccaggagtctgaggctgcagtgagctatgatcctgtcactgcacttcagcctaggtggcaaagcaagaccctgtctccaaaactactaaataaataaattaaaataagtggtgggtgcctgtaatcgcagctacttgggaggctgaggcaggagaatcgcttgaacccgggaggcagaggttgcaatgagctgagatggcgccattgcactccagcgtgggtgacagagcaagactctgtctcaaaaaaaaataaaaaacaaaaaacaaaaaattcatatggaaatgcaagggatccagaatagccaaaatacttgggtattttgcctgggtaacatagggagacctcacctctacggaaaggtaaaaaaattatatgggcatggtggcatgtgcctgtggtctcagctactgggagtcgggggtggtgttgaggtggaaggatttcttgagcctgggaggttgaggttgcagtgaggcatgtttgtgccactgcactccagcttgggtgatagtcagaccctgtctcaaaaaaaaaagaaaaaagtaaagaaagaaattaaaggcaacataaataaatggaaagacatcccatgttcatagactgtaagactttaaatataaaatggcagtattccccaaactggtctacagattcaggggttgcatagattgagtgcaattcctattgaaatcccaactacctgttttgcaaaaatcatcaaaattcatgtggaaatgcaagggatccagaatagtcaaaatacttttgaaaaagttttggaggacttacaattcctgatttctaaactgattgcaaaatgactgtaatcaagattgtggtggtgacataagagtagacacatagatgaacggaatagaattgacagtccacaaataaacagttacatttatcgtcaagtgattttttaaaaatagactttattagctgggaatggtggtacacgcctgtagtctcagttactcagaaggctgagttgggaggatggcttgagcctaggaggctcaaggctgcagtgagcttgatcatacctgtgaatagcctcttcactccagcctgggcaacatagcaagaccctgtatctaaaaaaaaaaaaagttgagttttcagagcagttttatgttcacagcaatattgagcagaaagtacagttcccatatacttctgctcccacacacgtgtagccccctctcccactactgacatccagcaccaaaggggcatatttgttacaatcgattaacctacattgacacatcattatcacccaaggtctatagtttacattagggttcattcttccggttgtacattctatgggtttggacaaatgtgtaatgacacatagacacaccattattgtatcacacacagtagtttcattgccctaaaaaccctctgtgctctgcctgtccctccctgctaacacctggcaaccaccgatctttttcctgtctccatagtctagtcttacttttgcagaatcttatatagttgggattatagagtatattgccttttcaggcttctttcccttaataatatgcatttgagattcctctatgacttttcatggctgaatagctcgttttaattttattttttatttttgagacagagtctcactctgtcgcccaggctggagtgaagtggagtgatcttggctcactgtagcctctgccttcaggattcaaacgattctcatgtctcagcctcccgaatggctggggactgcaggcgtgcactgtcacaccaggctaaattttgtatttttagtagaaatggggttttcccatgttggccaggttagtctcaaactcatttcctcaagtgatacacctgcttcaacctccccaatgtgctgggattacaagcgtgagccacccaaccaggcctgtgctatttctaaaatgcaggagatgaagttgccatgtgaaagatgcaacattcttatcttcaaggatgagaagttgaaatgagagaattctatacagaccttgttaaaacactgttatcttttaagcctccccatataatttagttgcctcttcataacttattattatttgtccaattcagtgtataagtaacagactctaacttcttctttgggtcttcaaatgtccttatgagggttcccaacccatgtaaaacttgtactcaataaatttgtgggactgtgtggtggctcactcctgtgatcccagtgctttgggaggccgaggggggcttgcttgagtccaggagttcaagaccagtctgggcaatatagtgagatcccggttcaacactttttttttttaattagattggtgtggtgggtggcatgtacctgcagttccagctactcaggaggctgaggtgggaggatagcttgagcccaggagtttgaggctgcaatgagctgtgatctcaccactgcactccagcaccccttatttataaataaatataatggctagccttagggactctgttcgcaagattaaagaacagaaatcagatgtagaatagcatataaataaatttatgtgcttttcttctgttaacctgtcctatgtcaatttaattcttgggcccagctgagactctagggatggaagtggagttttgccacccctacagtttctggtgacaaggatgggatcctctcaagcctaaagatgggatcctgggagaacaaataaaagcgggcacaggtaggaattcttaccaaagtgaactctttttttttttttgagacggagtctcgctctgtagcccaggctggagtgcagtggcacgatctcggctcactgcaagctctgcctcctgggttcacgccattctcctgcctcagcctcacacgtagctgggactacaggcacccgccaccacgcccggctaatttttttttgtatttttggtagagacggggtttcaccgtgttagccaggatggtctcaatctcctgacctcgtgatccgcctgcctcggcctcccaaagtgctgggattacaggcatgagccactgcgcccagcccaaagtgaactcttctggatctctgtctgtaatgcctggttgaaagaggagagtaaaatttttccttgtccctttctaaattcaaactggcaggagaaaagcatggtaagaattgattctttgagttatgactcttatgtcaaccttaaataatgagattcagaaaatatcagctaggcacgttggcttatgcttgtaatcccagcactttgggaggccaaggtggaaggatcacttgaacccaggagttggaggctgcagtgagctataattacatcactgcattccagtctgggtgacacagacctagtctccaaaaaacaaaaacaaaaaaaaccaaaggaaatatgatttttattctagtgcaaagcttgaggatggacacccaggaaacagcttccaaagggttggggtcattgctccaaagtggggaagctaaggtttcactcatagaggcagaaacagtgtcagcaggattgcaacatcttctgtacaaatccagtatgttagattccattagtacagcttgctacattccaaggaaaattgtttcaacattctgtgagaagaagtcaagctctgaggtcatcttatctctgatgctgctcagacatttctaaccatttacagggaaaagcagaagttgcaactgcatgctccatgcctcaggccacatggccacattcctcctgaggctcataataatgtaaagttccaacagcttggtggtggctcacgcctgtaatcccagcactttgggaagctgaggtggctggataacttaagaaaggagtttgagaccagcctggccaacacagcgaaaccccgtctctactaagtatacaaaaattagcccggcatggtggcgggcacctgtagtcccagctactcaggaggctgaggtgggaggattgcatgatcctgggagtttgaggctgtagtgagccatgattgcagcactgcactccagcctgggtgacagagggagaccttgtctcaaaaaaaaaaaaaaaagaattatttgatttcacacttccgaatttggtatttggctctgcatacatagtggctattgacccacagcctcccagaaataaggcttgttttccatgtctctgttgtgtggtttatcatatcttgttttatgtcttgagaacatggctctgtgaccaattgaaatattctctttggtttctgccagctgcaggggttgggaggacaagtccttgttaggctgctagccagctgcccaggaatcagaaacacagtgtctctgtccaacggttccagctctcagaggagtttgtcctacttgtctcagctttcattgccttgataacaattaggatatttgcctgcttaggctatcttgaaaaagactttggatcttgagggggattgtatcttttccagcctgtttgggatgctcttctgtgcctccagttaagccagaaaaggcatactgattttaagccataaaaaggcttattggttttgagtcacaattaaagtaggtataacattgaagatttggacttttgaatctaaaagctttttttttttttttttttaagacagagttccgctctgttgcccaagctggagtgcagtggtgcagtcttggctcactgcaacctctgtttcgtggattcaagtgattctcctgcctcagcctcccgagtagctggtattacaggcatctgccaccatgcctggctaattttttgtatttttagtagagacggggtttcaccatgttggccaggctggtatcgaactcctgacctcatgatctgcctgcctcagcttcccaaagtgctgggattacaggcatgagccactgtgcccagcctaaaagtatttttattaaagcgtgctattggccaggtgtggtggctcacacctgtaatctcaaccttgtgggagactgaggtgggaggatcgcttgagcccaggaggttgagctgcagtgagctatgatcttgccactactgcactccagcctgggcaacacagtgagaccccatctgtaaaccgtccccccccacaaaaaagggtgctttcatcccaaacaaccgtcctattggtaactagagaaatatcaaattaaaaagaagacacaaagaaatataggccaggcacggtggctcatgcctgtaattccagcactttgggaggccaaggtgggtggatcatgagatcaagagatcgaagccatcctggccaaaatgttgaaaccccatctctactaaacatacaaaaattagccgggcgtggtggcgtgcgcttgtagtcccaactactcaggaggctgaggcaggagaatcacttgaacccaggaggctgagtttgcagtgagccgagatcatgccattgcactccagcctgggtgacagagccagactctatctcaaaaaaaaaaataaaataaaataaatatggttagctttagggacttcctttaatcttcctcaatattaaagaacagaaatcagatgtagaaaaaaagttgaaatctgcaccctctgtaaattatcctcctccacccacctgtgctctgctcaacccccaagtccctgtccctgatcccccagaaggtctttcggatatctgggcccctgacttacacttaccctcctcaaaacttggccctattctccttagcaaatttcttttagacctaaaacttctccaaatatcctttcaatgcccagctgcctactttaacttctcttttcctataaaattcacagaaagcaccccagcctgttttccaggcccaagatatacaggtgacatgtatatactgatagccagaaaatagacctaacacaggctctgggaatgagcagccaggcttgcttcactgtaccttacaattcctcctacttcctggggctctgtaatcaaatctcatcagctccaggcattcccatgtttaggccgaaaccacaaaaaagtctactggactatcgtactcttaggaaaaagaaaccataaaaattaccctagatctctgataacaaaaaatatgctctgaaactccttggagaaaatctacattctttctcagttttcttgctctgtcgccagtcttatcatatctttaaaacttaagggccaggcacagtggctcaagcctgtaatcccagcactttgggaggctgaggcaggcggatcacgaggtcaggagatcgagaccatcctggctaacacggtgaaaccccgtctctactaaaaatacaaaaaaattagccaggtgtggcggcgtgcgcctgtagtcccatctgctgggaaggctgagacagcagaatggcgtgaatccgggaggcggagcttgcagtgagccgagatcgcgccactgcactccaacctgggtgacagagcaagactctgtctcaaaaaaaacaaaaaacaaaaaacaaaaaacacaaacttaagtatctgaggaactgggctgggcacagtagctcacgcctgtaatcctagcactttgggaggtcaaggtgcgcagatcgcttgaggtcaggagtttgaaaccagcttggccaacatggtgaaaccctgtctctactaaaaatatatatatataaaaattatccatctgctggggaggctgagacagcagaatggcgtgaacccgggaggcggagcttgcagtgagccgagattgcaccactgcactccagcctgggtgacaggacaagacaccatctcaaaaaaaaaacaaaaacaaaaacaaaaaaaaacttaagtatctgaggaattggctgggtgcagtggctcatgcctgtaatcctagcactttgggaggtcaaggtgggcggatcgcttgaggtcaggagttcgaaaccagcctggccaacatgatgaaaccctgtctctatgaaaaatatatattaaaaaagttagccaggtgtggtggcatgcacctgtaatcccagctacttgggaggctgaggcaggagagaattactggaaccactcgggaggcggaggttgcagtgagctgagatcatgccattgcactccggcctgtacaacagagccaggctccatctcaaaaaaataaaataaaataaaataaaagaatctgaggaattaactagaacaacccccagtatgctagtctgagattaaaaaaagtgttgaatgtttaacattttaggtgctttacttcaataatgtttgatatttgcctaatatatatgtcataaaaattgccagcaaaataaaacttaagataataactagctttgtctaatgtttcatgaagttttcacaattcagatataattgttaaataaactaaacttatataaatgcaagtgggaaaaaatttgtaaataagttattattattattttttgagactgggtgttgctccattgcccaggctaaagtatagtagtgggactgtagctcactgcagccttgaactcctcttgccccagtatcctgagtagctggggcaatgcctggcaaatttttagaaaaattttcttgtagagtggagtcttgctatgttgcccaggctggtctcaaattctgggcctcaagcaacctcctgtcctggcctcccaaagtgctgggattacaggtgggagccactgtgcccagctataaataattttttactgttttaatttttatttttgactgactcattgctagccagagctcgggtttctgtcacccacagcctgggaggccttaagtaagtgattcaacctcactgagcctcactctttgcctctgaaatggggatcacaggaattcctgccaggcaggggatatgtgaagactgaacgaaatgattcacacaaagatgtagcccagtgcctgggggacactaagcacatgctgagccttcagccacctgggaaggataaagggaaacacgggtggccacctggggctgatggaggaatgaggggcccgctgggagtatcctgggcaaactcacctctgggcatctgccctgatcttgggctggcgtcacaaggaagttggtcaccaagaagaacacgttctctccctaggaggcaagtctcaaagttggcctggctgggcttgcattgactggaaaggccagaagccggcagcctggtttatgagggaagggatgttggccccatgaaatcattaaccctgtccccacgtaaggcagattgaagcaga
